United States Patent 12,642,819 (COMPOSITIONS AND METHODS FOR TREATING INFLAMMATORY BOWEL DISEASE) - sequence listing, part 59

SEQ ID NO: 27 - DNA, 2225567 bp, Bifidobacterium pseudocatenulatum
tccgatattgtcgtttcgactggttcagtatggaaccgatcagtccttgacgatggttttgcctgccgtagcgcccggagtgagatcctgaatttccgtgatctccaaaaccggaatggtcattggctttttcgtgccgcgttcttcggcgactttgacctgttcgtcatagatggcgtcatcggaatgcagcacgacgttgccgcggaaacggtatcccttcttctgttcgaggttggcgaccgcgacgaccagatcactgccgtcaagcaggttacggtatgtctggcccgcggtgcgctcgtggtagccgatatggttgttgtcgatgatgaacatgctcatcttcggaccgagatcgacctggccttctttgctgatggtggccacccatgcgaggttgctgttgaggaatcccttcatctcatcggtgagatctgccatgatgccgtcctttcgtctatatgcccatggaatgcgggcatactttcagactacgacaagaaaccccacaacgcatgttcgcccaacgtgaataacatcacatacgcgctccatctgaaaccgaatttaggagagataacacctgtttcgcactttgctgaggcgtcagaccacgatcatccgctatccaatcaatcatggaaaagaaaggattgattttgggttggcatcagcggtatctgctggacgatatgcacgtcgagttgattcgcaatgggttcaaagacaaagcctgcagcatgccgatatccgcacttggtttagatattgtgtgtgaattcctttattccattgatgggtttttccctcaaaagaatttatgcagattcagacatttccgatttagcctgggctttttgcgatgtggcaattcttgtttgctggcttagatatgtcagacagtatctgccagagaaagcacaaaggcattttattccatcccccattctcgctttgcttgtatgcgcgtacgcaacgccccggaggccctgaatctgagagggcgtcttcctgtgaactcgatgaggctcgcgcccgccagctcatccacgtatttgcggatcgtctgtttcgtcagcatgaggtcgccgcctgcatcttcgagcgtcatggacttggtggtgtcgaacagctcctcctgcatgactgcgtagagaagcagggtcgcgttcgtggacagtgcatgttccctccgtagctcgtcacgcaggacggtcgccttgtcgagctggtcgattttgacgccgagctcctcgatcagggattcctgcgcccgttcgatgagtccgaggatggtgtatacgaagaacgtgagttccccgctgttgagtttgtcctcggcctcagtgaacgccttgtagtattcgttcttgttctccgcgatcgtcctggagagggacagcacggtgggcagagtgagatcgttgctgaggtagagcgcgagcagatacctgcctgtcctgccgttgccgtcgtagaacgggtggatgtattcgaacaggaagtggctggctatcgcccgctgcaggaacggtatggtatccgaccgggcgaggtccatcatctgtgcgagcagcgctgatatccgcgcctcgctgctgacgccgctgtggatgacggtgccgtgcggtccttggacctcgacatcgcctttcctgaacagctccccgtcgggcctgttcttgtcgtcgatctcgtcgagggctatcttgtcgtagatgtccctgatgtcctcgagagtcttgggcagttcaacgtcgcgattggtgaggttgagatacagtttcgcgaactcgccgaacctggccttctccatgtcgccctcggtcctggcctgccgggctgcggccacggcggcttccgtctccttccgcgtcgacctgaccccctccatctcgttggtggcgagcaattcctcggatatggcgtggtagatatagttccaccgcatgactcctgggatgctccgccacatggccgatacctggcgttcggcgaggagcaccttctgtgtgagcatgcacacgcagcgcggcgtggcgatgaacagttcgcccaagggtgtgccgattccggttgtgaatgtggagtccgcttcgaggcgttgtctgacgagccggtcgtggttggcgtaggagtccatgctcctgtcggcgtggaacagccgcgccaaagtcctgtattccatgctcataacggtcactgctttcaaaaagtcatttatattttcattataattataaattagaagcactcagaagacaagacaaagcatctatgaatgaaaattaacaataagcccatgtcggctctaccgtccgtcgccgacacccctgccgacacgggtcgttcatgcgtccgtctgttcggcttgtatacgatcttgccgaaggttctccgcgtcgtcgtggaagtcctgtttctttaccaccttataaccggtttctatcaccttgaaccgtttttgaggttcggcaagcacgtccgcgaaacagcgtcgtttcaacaaaaaaggccaccccttacggagtggccctcgataatcgtggagctaaggggattcgaacccctgaccctctccatgccatggagatgcgctacgacctgctgatccgtagtcagctgctctaatccgctgggctactcgcgcaacgttgcttgttttcggcaactcgtataagatacacccaaatggccacgcagcaaaatctcggcgtgtcgcacttgttttcatggattttatagagagattcgcatttgcctcagccccacaaaatctgaattctcacgcggtgcgtctgcggggaatctcctccgtcgaaaccttcagcagtttcggggtgccggatccattgacggaagcctcatccaccaccacttccgacacgccggtcatacttggcagctggaacatcgtatcttccaaggtcttctcaataatcgaccgcaagccgcgcgctcccgtacccctgcgaatcgacgtggccgcaatctgccgcaccgcatcctcggtgaacgtcaacgtcaccccatcgatcgcaaacaacttctgatactgcttgaccagcgcattttccggttcgaccagaatgcgcgccaaatcatcctccgtaagatcctcaagcacgctcaccaccggcaatctgccgatgaattcaggcaataaaccgaaatcggcaagatcgtcggccgaagcctgggcaagcagctcacgcttcggcacctcgcgctcatgccaggccgcaccaaatccgctttcgcgagcacccaggcgctgtgccacaatatcggcgagtccaacgaaagcaccaccgcaaatgaacagaatgtcgcgggtgtcgatctgcaccgtttccatttctcgatgcttgcgtgaaccttccacaggcacggaagccacagtgccttccaaaatcttcagcagggcctgctgcacgccctcacctgacacatcgcgtgtaatagacgtgctctcgccgcttttgcgcgctatcttgtcaatttcgtcaatatagatgatgccctgctgcgcacgcgccacatcgccgtcagcagcctggataaggcgttgcagcacggtttccacatcgtcgcccacataaccggcttcggtgagcgtggtggcgtcggcgatcacgaacggcacgttcatgactttcgccagcgtctgcgcaagatacgtcttgcccacgccggtaggccccagcagcagaatattcgatttggccacctgcacgccagccaacggatcgtcgttttcgcgggttgcacgatcgcttaattccgtggattcgcgcatttccatgttgacgcgcttgtaatggttgtatacggctacggaaagcgtacgttttgccgattcctgcccaaccacatagttgtcgagataggcgctgatctgggccggtttcggcaactgcaacgtgttcagctgggcatccttgacacgttcttcggaaatgatgtcgacgcatagctcgatgcattcgtcgcaaatggccgcccccgacccggtaacgagcttgcgcacctgattttcagttttaccgcagaacgtgcatcgtgacacttcgtcgttgtagctgaccactcgtcccattcgcacccctttgtttttcgtacctgccattgaacaactgacgccatgcaatcgtcattgaaaacacaatacccctgccgacgcctggcaggggtattgatttgtgaagatgcgcaactcgaccttcggccaagattgccgcaacgactgctcagccgcggtgttccagcacctcgtcgacgatgccgtattccttggcctccggagcggttaggaaggtatcgacctcgatatccttgcgaatcttctccacatcacgaccagtatgcttggccagtgtattttcaagccattcgcgcatacgcagcatttccttggcctggatttcgatttccgtagccttgccaaaaccctggtcgatggctggctggtggatgagtacgcgggcgtttggcagcatcagacgcttgcccttggcaccggctgccaacaggatggcggccgcagaagcggcctgaccgaggcacacggtctgcacgtccggcttgatgtactgcatggtgtcatagatggcggtcatggccgtcatggatccgcctggggaattgatgtacatcatcacatcgcggttcggatcctggctttcgagcaccagcagctgggccatgatgtcatcggcggaagtgtcatcgacctgcacgcccatgaagatgatgcggtcttcaaacagacgggtgtacggatcctgccttttgaaaccgtacggtgtcttttcttcaaactgcggcaaaacgtagcggttctgcggtgcgaaagcggcttcgcgagcagccgccgcccggaatccgactactccggccggacctgcaagtcgctctgcgcgggctacgaactgggattcttcgcttgccatgttcactctcccttggtggcgttcatcgtgtcgtgcgtggaaacgagcttgtccacaaagccgtattccaacgcttcctgcgcagtgaaccagtggtcgtactcgttgtcgcggtagatttcctcaaccgtgtggccggtctgctcagccgtcagctcgctcatggtcttcttcatgtccatgatcagctcggcattgatacgcacatcggttgcagtaccgccgatgccaccggaaggctggtgcatgagcacgcgggcgtgggatgtcaggaacctcttgcccttagtgccagagctcagcaggaactggcccatggatgcgcacatacccaagccaacggttgccacgtcaggctcgatgagctgcatggtgtcgtaaatggccatacctgcggtgatggatcctcccggagaattgatgtacagccaaatatccttcttcggatcttcggcagccaacatcagcatctgcgcgcaaatgcggttggccatctcatctttgacttcctcgcccatccagatgatgcggtctttcagcagacggttgaaaatcggatcggcgggccctgccggcatgtcttcgccggccataacgggcagaggtgcactgaagttgctcaccttgtctccttttcctatgttctctatagcttcacagcctaccgcttcgaagcgactgggaacgaaattgcgctgacagtggagtcttcgcgcacctcgatatgcgtctttgaggggctgcttaacgaacctatttgacgatggtgttgtattcgggaacgcccatatagttgtagttcacttccacgcctttggccgatgccgcggtcacgttggtataccacaaaggaatcaccggcatatccttcagcaacacacgttcgctctgctgatacaggctcacggccttgtctagatcggtttcggccgcagcctgatcaatcagcgcatcgaattcatcgctcttgtaatcaccgttgttcaagcccttgccgtccgctgcagaggaatcgtatgcctgcaccagatagccttccggatgcgggtaatcggattgcatgcccgacttgaacgccgcatcgatggtacgctcctgaatggcgctcctcagctctttggacgtggcgaatgggtaactttcagcatcgataccaagagcgttgcgaatggaattggccgcagcctccacccattccttgtcggtgccatcggcgctgtatgcgatgcggaacgttccgctccatggcgaaatcgcatccgccttcgcccacaattccttggctttcgcctcatcgtacgtaagcacgtcatcagcgtcaagatcggtatcgtatcccttgatcacgggagcgaggaaatcggtggcgggcgtcacggtaccgctgaaaatcgcgtcggcgatgttctcacgatcgatggcatgcgcgatggcctgacggcgatacctgccttcctcaccttggaaatgcttgagattctgcgaaatcgtaaatgccgaaaaagacggaccgggcttgctgacggctgtgatgttcttttcgttctgataggttttcagcgcggaggtaggaatggaatcaagcacgtcaagattgcctgccagcagatccgaataggccgcgtcaaggctttgatacaccttgaaatcgatgcctgcgttcttgactttgcgcggtcccttgtaggagtcgtctttttcaagaatgatttcttcgccgctcttgtacgccttcagcttgtacgggccgttgccaatcggtttttgcccgtattccttggggtttttgatgacttcggacggcattggcaagaaggcgatgtctccgattttgtacaggaacgccgagttcgacgctttgagcctgaccttcagcgtggtgtcgtcgaccacggtaaggccggatagctgcgcggttttggagccttcggcatcctgcaaatcatcgtagccctgaatgtcttcgaaaatagaggctcccacctgcccgttggccgcgttggccgcgaacgaccagcttttcgcatacgtgtcggcggtgatcttctcaccattggagaacgtcaaattcggcttgagcacgatggtgtattcggaagcgtcatcattcggcgtgatcgattcggcctcgaccagtgtttcattgccttccgcatcgaatgtgaccagaccgtcgtacagttggctgacgatcttccagccggacatgtcgctggtgtcgcttggcagcagaccattcgacggttccgtaacgttgacgctgaccaccttatcggcactggtggcttcggttacggtatctttcgcttccacggatccgcagcccgcaagcagcgcgacgatggaaagcgctgccgtgattggcttgagcaggccggtggtaatgctgccatgcaggcgttggttgttcattgctgtcctctcgataaatggtagagacagcatagcaagccagcatttccccacgaagcgctttcctcacattacgctacaggctttttctatagccggttatttacgttttgcgccgattcggaacgccgcaatcaggcagcagatggctatagagacgatggcaatcatcatggcgaacgtccaacttccgccaaccgccgtggcatgacggaacgcatcactgccctcttcgcctgaaccggcctgggccaccgacagaatcgtggaaaagagcgctgtaccggcggcaccaccaaactgcaggcaggtgttgaacaccgcattgccgtccggcatgaactgaggcgcgatattgcgtaacgcattggtcatgatattggaaaaaccaagcgaatagccaagtccgaaaataaagtagaaaccggcaagcatgacgggtgtcagtcgcatggaaaataccagcagcagaatcggcccgcaaatcgcggcgaaaaacgcaccgagaatcggacgcaccggtccgaaacggtcatacagcatacctccaaccggtgcgaaaaacgcgccgatcaacgcacccggcagcaccaacgcgccggacaggaacgcgctggctcccaacgaaagctgcgccacattggtaatcacataaccgaaaccgatgccgacgatcggcagcaacatataggcgatcaaatgcagcaacaccatcgggtcatgcagccagcccaaacggatcagcggcgagaacgaacgcttcgacgaccagccaaaaaacagcaatgctcccaacccaacgatcagactcaccacggcgaacactgccgacaccatggcgctgctaccggaaaccgcggcgctgacggacactccagcttgatttaggaacatcaccaatccacacaatgcaagcacaatcgacacgaactgcaacgaattgagacgtgcctcttccgtcgggcgatgctgttcgatgcattttaaaccgaccggcaacgaaatcagcagaacaatcggaatgacgatcacgaaaatcgcacgccatggcagaatgctcgacaccgcgccaccgacggtcggaccaattgccggagcgacggtgatgaccagcgaaccgacgcccatcaaacgaccgattttgctctttggcgactgttcaagaatgatgttgatcatcaacggcgtggccacaccggaacccatgccctgaatcacacgggcaatgagaatgaccgggaacgcatgaccgacgatcataatgagcgagccaagcacggcaagcgccaccgcggcaaggaacaacgtgcggtgcttgaaacgacggttgaggtatgacgacaacggcatggtggccgcgaccaccagcaggtagatggtggtgatccattgcacggttgcggtgtcgacgttgaattcccgcatgagttgcgggaagagcaccgtcatcacggtttcggtgagaatgccgatgaaggcgagggagccgaccgccacgatggctccaatgagcttgccgggaatgcgttcgtccggcattttcctgacgttttcgttactgtttcgactgatatggctggtggtttcgagcgttgtattccgttcttgcataatcactttccgcgcactttttcctgcggccatgtgcgacgccgcgattgatgcatggaccttgctcatagcaagcaagcatcaaccccaacgaagaattttagcggacccctagtccaacggcaacgaagaatgagaaccggcaccacactaggctcgattagagttgccggtttgaccaccatccttctcatgcagaatcttccgaattttctccaatctcggtttgatctcatgctcgtagccgcgatcgttcggatggtagtattcccgccctaccagctcgtccggcatgtattgctgcggagctacggctcctggccaatcgtgcgcgtaccgatacccctcatgattgccccaacttttcatcagggcggtcggcgcattcctcaaatgcaatggcacttggccgatcaatcccgcgtccacatcggcgagcgcactgttgatggcgttgtagccggcgttcgattttggcgcggtggcgacggcgagcgccgcttctgcgagaataatacgcgcttcgggcatgccaatcatggctacggcctgcgccgccgctacggttacctgcagtatttgcggagccgccatgccgacttcctcggaagctgcgatcataatgcgtctggcaatgaaccgcggatcctcaccggcgcgcagcatgcgtgccaagtagtgcatggtggcgtccgggtcggatccacgcatggatttgatgaatgcagagatcacgtcgtaatggtcgtcgccgtctttgtcgtagcgcacggtggccacgtccatgacctgcgacaccacgtcggaagtgatgatcggccgtttcgcgccttttttgcgtgccttgtctccggtgagcgcccctgcggcggcttcaaggattgtcagtgtttttcgcgcgtcgcctccggccatgcgcacgatttcgtcaacggcttcgtcgttgattttgacttcgtttttaagtccacgctcgctttcgatggccctgttgatgagcgttttcaggtcgtcgggttccagcgattcaagtttgacgaccacggatcggctcaacagcggtttgatgatcgagaagcttggattttccgtggtggctgcaatgaatgtgacgtcacggttttccacgcttggcagcaatgcgtcctgctgcgatttggagaatcggtgcacctcgtcgatgaacagcactgtttccttgccttccgcgacaagacgatcatgggcgcgtctgagtacatctcgcacatctttgacgccggaggtgactgcggaaagctcttcgaagactcgaccggactgtttggccacaatataggcgagcgtggttttgccgaccccgggaggcccgaacagaataatggaactcggtgccgtcagcgagcctttggacgccggattggcgagcctgcgcagaggagagccctgccctagcacccgcgactggcccaccacctcgtccacgctcgacggacgcatgcgcacggccagcgggcgtgtcatatcttcgggagcgtccatcgcgccaaataaatcctcagtcataatttctactgtaccgcaacatacgcaataattcgaacacacgttcgacattcgagttcatgccaaccgctagactggcaatcatggctgacgatacgaattacggttctctgggcgcgttggcgccgaattggagcgatggcgagcgcaacatcgacacggacgaaatctacgagcgatttttcgagtgggtggcggacatcaaaggtgttgagccgtggccccatcaggaagaggccatcatggacctgctcgcgggcgaccatgtcattttgaacacgcccaccggctccggcaaatcactggtggcgttgggcatgcatttcgcggcgctgtgcacgggccgtcgctcgtattacacggctccgatcaaggcgttggtgtctgagaagttctttgatctggtggaggtgttcggtcgtgagaacgtcggcatgatcaccggagacacgcacatcaacgccgatgcgccgatcatctgctgcactgcggagattctcgcgaaccaggcattgcgtgagggccgtcatgccgatgtcggctgtgtagcgatggatgaattccattattatggcgattcggagcgcggttgggcctggcaggttccgctgctgacattgccgaacacgcagtttttgctgatgagcgccacattgggcaacgtcgatgcgatcgccgacaaattggaggacatgacggacacggacgtcgacatcatcgccgatgcgccgcgcccggtgccgttgacgtacgaatacacgcttgactcgttggagaagaccgtcgaactggcgttcggcagaggcgaaactccgatttatgtggtgcatttctctcaagacgccgcattggagacggcgaacgccctggcaagcacaggtgtgtccagcaaggaacaacgtgccgccattgcggaggcgatcaagggcacgaagttcaccactgcattcggcaagattttgcaacgtctgttgcgcaccggagtcggcattcaccatgcgggcatgctccctcgctatcgtcgtttggtcgagcagctcgcacagcatggcttgttgccggtgatctgcggcaccgacacgttgggcgtcggcatcaacgtacccatccattccgtggtgttgaccgcattgaccaagtttgacggcacgaaaatgcgcaaactgcgtgcccgcgaattccatcagatcgcgggacgtgcgggacgtatgggcttcgacacggaaggcttggtcatcgccgaagggccggaattcgaaatcgagaacgccaaagccctcgccaaggcaggcaatgatcccaagaagctcaagaaagtcaagcgcaagaaggcgccagaaggttttgtcacatggaatgagaacacgttcgacaagctgatcgacgcggcccctgaaactttggtaccacatatgaaggtcacgcattccatggtgttgaacgaagtggcgcagggcggcgacgcacgctaccgtatcgatcgcctaatcgacgattcagcgcaaaatccggaacagaaggagcatcttcatgatcgtgccgacgagatcttccaaacgctgttcgacacgaatgtgatcgaaacggaagaccgagatgatggcggcaaggactatttcatgaccgtcgacatgccggatgatttcgcgcttgaccagccattaagcccgttcctgctggccgcgttggaactgcttgatccggaatcggaaagttacgcgcttgacgtgatttccatggtggaagccacgttggaagatccgaagcaggtgttgcgcgcgcaggaacgtcaagcccgcgatgcggcgatgatccgcatgaaggaagatggcctcgactatgacgagcgcatggaccgcttgcaggaaatcacctatccgaaaccgctggaagacatgcttcagacggcgttcgacgagtaccgccatgatgtgccttgggccaacgattattggttgagcccgaaatcggtgatccgggacatggtcgaaacagcctccgatttcaccggttacatcgcgcgctacaatatcgcccgctccgaaggcacgctgctgcgctatctgtctgacgcatatcgcacgctggcgcgtaccgttcctttggagaagcgcaacgaacagttacgggacatcatctcttggcttcgtgtggtggttcgttccatcgactcctcactggtcgatgagtgggagaacgcaggagccggcaccgacgattccgaagccgccgcgaacctggccgcgcccggcgcgaagcaggccgtggtggaggatcgtcgaggcctcaccgtgctcatacgcaatgccatgttccgccgtgtgcagcttatggatctcgacaagcccgatgagctcggtgcgcttgacaaagactggggttatggcgtgcacgagtgggaggacgcgcttgatgacttctacgatgagcacgaatacgtcaacacggatgcgaaagcccgtagcggcgagctgtttatcctcgacgattccaaggagaacagcgaacacagctggaaagtgcgtcagatcatcgacgattccgatggcgaccatgattgggccattaccggaaccatcgatcttgataccacacagtcgagcggcgaagtcgtgttcttcgactacagcgtttccaactgacgccgcattttatcggcatcgacctccaagggcggccagatcatattcatgttcttcaacgtgttgcgaagaagttcagacacgaccgcccttgaataccaacgattgtcggcaggcaccaagtaccagggcgcctgctcggtgctcgtacgcgcgaacacgtcctgccatgctgccatgtagtcgttccagcgggcgcgagcttcaaggtcgctcgggtcgaacttccaatatttggtcggatcttccagcctgctaaggaaatgctccttctgctcttctttgctcactacaaggaatattttgatgatggagcatccgtccgcaaccaattgcgattcgaatcggttaatttcgtcatatcgcgcctgccatacttcctccggatatgttttgtaaatacgcggcatgacaatatcttcatattgcgatctatcgaaaatggaaatccagccattcttcggcagttcgcgtttgatgcgccacaaataatcgtggtccttttcctcacctttgggcgcaccgaaaccgtgataatgcatacccatcggatcaccttggctgaatacgtgacgtacgatgccgcccttgccggaagcatccatgccctgcagaataatcagcagacgacggcgagaccctttcacaccattggcatacatcagccgctgatatcgtgcgatttcagaagaactaatcgaaatgaaccgttccgcatcatccttgttgccatcaaaacccggcgtggaatcaccgtcgatttcggcaaccctcgtatcgtggtggaatcgcagcaactgactgggcggaagcgtccatacggaactgagcaactcgcttgccttggcaacattcgcaagtccttcggcaacggaactgcagttcttccccttctcaagtctgtcctcaaccttgttcaacgtcttcgcaatggacgacatcttcgcatccttgtctttgtctggcatgacaagcctccttgcttatcccctgataataaactatgcggcgattgaaacgtggcatcgccacacccaatcgccgcatcccgcttttctgacgttttgtctgacttctttcacgcaatagggcgctgattcctcgctctttgcaagaaaccagcgccctatcggtcttctcagatcaaatgacgtcactgcttgggcttatcaccctttgatttgtctgacttcggcttgtcgaatctcagcttgtcctgcttggacgtatctttgatcggcctgccgttcttatcgaactcgacttggctttccggatgcgtctcatcgaatccctgaacatagcgggtctgacgccaatggcgaatcgacgcgttggaaccacgatggtgcacatggtacaggcgctgggcaccgccaagcggcatgctttccttggccacggcgatctggttcacgttcgacggatccataatggcgatcggcgcgaccggttccggttcggcaggtgccgcagtgtgcttctgcatgcgttccggcagccattccgcaagtcggctcagcagccagcatgcgatgaagtagatgacggcagccacaaccaatgtctgcagaatattgaagtacatcgaaccaagtcgacgcgattcctgcagcaaatcggtgtacatgatgatcgagccgagagcggtatccttcagtaccaccaccaactgcgtcacggcggcaggaagcatggcgtagatggcctgtggcacttcgatttccatcagcgactgcgtgcgggtcaagcccaaggcgagcgacgcctcacgctggccgttcggcaggttgccgacaccggaacgaaccagctcggccaccacggaaccgttgtagatcaccaatgcgagcaccacagcccagtatgcggggcttgacatgcctgcgaaagcgaaccaacgccagaagaagatcatgagcagcagcacagggaccgcacgtgcgaactcaacgatggcgccggaaaccgcacgaatcacgatattcggcagcagacggccgataccgaaaatcagaccgaacagcactgcgccgatcactgccaacacggaagctcgaatcgtggcccacaatccgggcagatagaaatcggtccatgcttcagcgtcaagcgccggcttccacaactcccagctcagctggttctcgccatccggcggattgtgaagcctcatgagaatgagcacaactacgattgcaaagacaatgccggcaatccagttgacgatacgaatggttttacgggtcttaggaccgggctggtcgaacagcaccgcgctttcatcgcttgccatggtgcgtcacctcctcaccgcgagcttgttggacagatacgtggtcagcatgccgatcggaatgatcagaatcacataaccgaatgcgaagatcaggaagatcggaacaatcacgtcggaacggtattcgatcatttcgctcatcaacgacgaggtttcggtggcgacggaagccgcggccgcaaccgtggaattcttcagcaatgcgatcaacgtgttgcccagcggtgccacggagccacggaacgcctgaggcagaatgatctgggtggcggactgcatgaagttcaatcccagcgcacggcaggcttcagcctggccaagcggcacggtgttgatgccggatcgcagcgattcgcacacgaaggccgccgtatacaggctcaaaccggtgacggcaagccagaagaagttggtggcgaacgtgtcggagaagctgagcttcagctgcgcgtaggcacccagcaccatgaacaccatgatgatggtcaacggcaggttcttgaacagctcgacgtaagcacccgagaccatacgcagcgacgcgaccggcgagatgcgcatcatcacgaggatgacgccaagaatcgtggagaacaacgccgaccacagggtcagttcaatgttcaccaagaacgcagccggcacattgtactggctgaacaatgagatgaacgcttccattatctctccccctcagtcggctccggcggattgtacttcgcgttcggcgtgtatgcggtgcccttcgtgttgtcggaaatggcacgctgccaagaaccatcctggatcatatcggcgatggcgttgttgatctgggtggccagcttcgtatcgcccttcttgatgccgacgccgtaatactcctgggtgaacggcttgccgaccacgcgcagacggccgcgggacgcggaggcaagaccagccaaaataatgtcgtcggtggtcaccgcatcaacaatgccagagaacagtgcggtagcgcactccgcgtaaccaggctgctccatgagctgcacttcgttggcgaacttctccttgacggtgaccgcggaagtggaaccggttacggagcacagacgcttgccattaagatcctccggaccattgatggaggtttcatccttacgcacgagcagatcctgacccgcaacgaagtacggtccagcgaaggagacgaccttcttacgttcgtcggtgatggaatacgttgcaacgatgaaatcgacatcgccattctgcagcatggcctcacgctgcttcgacggtgcctccttccatacgatctggtcttcggaatagccgagtttcttggcgatgtacttggccacatccacatcgaagccgacataggtgccggacttcttgaatcccaaaccaggctggtcgaacttgataccgacgcgaatcttgccatcggcgtcgtccgcgccacaggcggacactgcgaacacgcatgcgcatgcgcagaaggtcgctataaccctgcgtagcatacgcttcgccctcatagaaagtctcatatcgaaaatccttcttctgtcttattcccgtcagtcatttcagtgggtgagaatcttcgacaggaagtccttggcacgatcggtcttcggattttcaaagaagtcctccggcgtgctctgctcaagaatctggccgtcggacatgaacacgaccttgtcggccaccttgcgcgcgaagcccatttcgtgggtcacgcacagcatggtcatgccttcgtgagccagctccaccatgacgtcaagcacttcattgaccatttccggatcaagtgcggacgtcggttcgtcgaacaacatgaccttcggctgcatggcaagcgctcgggcgatggcgacacgctgctgctgaccgccggaaagctgcgatggcatcttggaagcctgcgaagccactcccactcgggagagcaggtccatggcgagatcctcggccgccttcttatccatgtggcgcaccttgatcggcgcaagcgtcacattctcaagaatggtcttgttggcgaacaggttgaacgactggaacaccatgccgacctcggcacgcaggctggcgagctccttgccttcctggggcaatggcttgccatcaatgcgaatatcaccggaatcaatggtttccaaacggttgatggtgcggcacatcgtggacttgccggaaccggatggaccgacgatgaccagcacctcgcccttcttgacggtgaggttgatgtccttgagcacatgcaagtcaccgtagtgcttttcaacgtgggtcaattcgaccagcgggcggtcgctgtcttccgtacccggcatgatcgggcgcgtctcttgcgtttctttgatatctgtcatacggatagtatatgaaagccatgtttccgcggccgtcaccaccccctgacgtgctcgaaatatgagacaacgttgtcccaaaatgcatcatagcgcgttatcgaccgcaataccgatatcttgagcgccgtacgtggcagctaccaccatcgtggcaattcgatagccagcaccgctattacgaacaatacaaccaccgcaccgaacaccactcgttcgggcaccttggatttgaaaccatccacaacgcgacgccacgtatcaccaatgctcatgcataccaacgtaggaacgccaagcaacgagaaagagccgaacaggcgaacgcaagatgaatttcaccctacattcgcctgtcttttacatgcagattcgtatgaccatccgtcacacgatcgcagcatttcatccgcgatcagcgattaagcaatcgccggggccaagagagcactcagagcactttggaaaggaacgtcttcaatcgttcgctctttggatggttgaagatctcgtccggagtgccttcctcctcgatcacgccggcgtcggtgaagatcacgcgggtggccacttcgcgggcgaaacccatctcgtgggtcaccagcaccatggtcatgccgtcttcggccagctcacgaatgacttcgagcacatcaccgaccatctccgggtcaagcgccgacgtggcctcgtcgaacagcatgaccttcggacgcatggccaaggatcgtgcgatggcaacacgctgcttttgaccgccagacaacgagcgaggcatggcatcggccttttcggccaatcccacggttttcagcaatgccatcgcatgttcacgcgcctgctcgtcggtttccttgtgcaccagtttcggcgcaagcgtgatgttgtcaatcacgctcatgttgttgaacaggttgaaatgctggaacaccatgccaacctgctctcgaacctggtcgatgttcacatgcggatcacccagatcatgaccgttgaccacgatctggccgctggatgcctgttcaagtccgttcaggcaacgcaacatggtggatttgccggcaccagacggtccgatgatacagatcacctcgcccttgcgtaccgtaagatcgacgcctttgatgacttccatatgaccatagtttttatgcagattcttgacgtcgatgatcacttcgccatcattgttgccgtgattgcagttctcgctcatcgattcaccttcctgtcaacgatattggccagccatgtgaggatggtgatggccacgaagtacatcacaccgacgatcagcaacgtttcggtgacgcggaagttcgccgcatacaattgctgcgcctgatacagcaattcaccaaagccgatggccagcagcagcgaggaatccttgatcataatgaccagctggttgatgatcgacggcatggcgattgcagtggcctgaggcatgatcacgcgcgccatggcctgatgatggttgaggccaagcgagcgtgctccctccatctgaccagagtcaacggactgcacggcgccacgcacgatctccgccagatatgcgccggaattgagcgacaacgtcaacgcacctgcaacccaaatgttcacactgtgtccgataagctgcggcacaccgaaatagaagaagaacgcccacaccagaatcggagtgccgcggaacactgcgatataaaccttggacacgcctctcagaatcttgttctccgatactttcatcaagccgaaagcaacacccaacgccagtgcgatcacaaacgacagcaacgtgatcaacagcgtgttcttcagaccagtcagcaaagccggcatcgactgtttgaccagaccaaagaaaccgaccttcttctgcgcctcaccgtcggcaccgttgtcggtgaccttgccggaaatcgcctcgacctgttccttcgcgccatcggcacccaaatactgtgcgacaatcgtctcatactcgcccgaagcgatgagcttgttcagaccatcgtcgatggcggccagcagatcggcgttcttgcctttgttcacggccatgccgtattcaccatgcggcaccttcggagtcacgatcttcaaaccgttgttttgggaaacaccgtaggcaagcaccggatagtcgtcgaacacggcatccgcattgccggatttgaccatctcatacatggttgatgactggtccacggaagtcacggtatagccgtattcgcttgcatgctgtttggcgtaggattcgccttccgatccggttttggcgacaacggtcttaccgtcaagatccttgtagctggtaatactatcgttgttttcagcgatggccatctggataccggactggaagtaaggattggaaaaatcgtaggtcgccttgcgttcgtcggtgattgacatgcctgcgatcaccacatccacctgattggagctcaaagcctgcaatgctgcattgaaacccaatgattggatggtgacttcgaatccttcttcttgggcgatggcacggatcagttccatatcgataccggtcatcttgccgttctcgcgatattcgaacggtgcgaatgtggtatcggtaccgaccgcgtaggttttgcccttgactgcggagggatctccgacttcggcggcgttagcactaactggggatgcgatgagtgcactcactgccacaatcagtatcatcgccaacgcgagaagtcgcatccagacaccatgaaaatcatgtttttccaacgattgcttcaaattcatactacagattcagttctttctcataatatttcagatactcatctatgctccaccataccggcagcaagagaaaatagacagcgtaaacaataaaaacaggctgtccttgcacggtctctcatgcaaagacagcctgttatctcaaagcgaaaacactatcagtcttcgtcttcttccggatcataatcaacgccggtttccgcacgctgttcgtcggaaatcggagccggggcgccggtcagcggatcacgaccgccgccagccttcgggaaggcgatgacgtcgcggatggagtcggcgccagccaggatggcggcggtacgatcccaaccgagagcgatgccagcgtgcggcggagcgccgtacttgaaggcttcaagcaggaagccgaacttgtcggcagcctcttcaggagtgatgccgagcacatcgagcacacgatcctgaatgtcatcacggtggatacgcacggaaccgccgcccatttcgttaccgttgcacacgatgtcgtaggaatcagacatggcgtgttccggatccttgtcgaaggtgtcgatccaatccttggacggcatggtgaacggatggtgcatggaggtccacttggagtggccgactgccacatcgtcgtcatccggatcgtcggtgggcttgaacagcgggaagtccacaacccaagtgaaagcgaagtcgtccggcttgagcagaccggcgcgatcggcgagttccacacgcacggcacccagcagctcctgagcggaggtgcgacggcctgctgcgaagaacacggcatcgccgtcttctgcgccaacggcttccttcaggccagcgcgctcctcttcagacaggttcttggcaacaggtcccttgagctcgccgttctcagcgaacaccacgtaggcgaggcccttggcgccgcgctgcttggcccaatcctgccaagcgtcgaactggcgacgaggcgtggccgcgccacccttgaagagcaccgcaccaacgtacggagcctggaacacgcggaacggagtgttcttgaagtagtcggtcagctcgatcagcgggttgccgaaacgcagatccggcttgtcggagccgtacttatccatggcttcctgccaagtgatgcgctgaatcggcagctggatctcatagcctgcggacttccagatggcggcgatgaccttttcggccatggccatcacgtcttcctgatccacgaacgccatttccatatcgagctgggtgaactccggctgacgatctgcacggaaatcctcgtcacggtagcagcgggccagctggtagtagcgttccacgccggaaaccatcagcagctgcttgagaagctgcggggactgcggcaacgcgtaccaagaacctggcaccaagcgggccggcaccacaaaatcgcgagcgccttccggagtggacttgatcatggtcggggtttcgacctcttcgaagcccatctcttccagagcgtggcgagcagccttcgacatctgggaacgcagcttcagattgcgctgcatggacgggcggcgcaggtcgagataacggtacttgaggcgaacttcctcgcccggcagcttgttctcggactcgttttccaacgcggtggacacctggaacggcagcgcgtcagacttggcgagcacctcgatgttttccgccacaacctcgatcttgccggtggccagatgatcattctcgttaccgtccggacgcaggcggacctcgcccaccacctgaatcacaaactcggagcgcagcggacgtgccatgtcttcgtcgtagataactacctgcacaagaccggtgttgtcacgaagatcgatgaaggccacgccaccgtggtcacgacgacgatcgacccaaccggagagcgtcaccttctgaccgacgagttcctcggtcacttcggttgcatgatgtgttctataagccgtctggctcatgcttcccctattccttgttctctaatgattgaagtcttgcgatttcaggcttctacggtaacggtttgctgggcatacacagtatccggctcccaagactgtgcgttggccggctgctggtcgcccgtgatgatgttcttgacttcgtccgaagcgtcctgcgcggacttgtccgcggggaaccacacgtatgggatgccgagcttgtcggcatacttgatctgcttgccaagcttggctgcggtcggagccacatctgccgcgatgccacgggcgcgcagctggttggcgatttggttggaagcggaacggtcctcctcgttccacacggccacgagcacggaagccggggacacgcgattcgcgtgggcaccggcggtgtgcagcatgtacgaaaccaagcgggacaggccaatggacaggcccacgcccggatacttcctgttgccctgcgatgcgagattgtcgtaacgaccgccggaacagatggaaccaagagccgcagcaccgtcaaggaacgtctcatacacggaaccggtgtagtaatccagaccacgcgcgatcttcaaatcagcgatcacggagcccgggcgaatacgagcggcctcgtcaacaatcatcgccaacgtgtcaagaccctgacgtgcgagcacgtacgcctcggaatcattggcaatgccatgcttctcgcacagcgtgtcgaacttgccggacagttcagcgccgtcagctgcggtcagttcagccagctcaaggcacgcacgtgcctgattctcgtcggctccacagccttcgaccagcaacttggccacttcgtcggcaccgatcttgtcgagcttatcgatctcacggagcacgccctcgacatcggtcaagccaagaccacggtagaaaccttcagaaagcttacggttgttcgcatgcacggtggccttcggcaaaccgaactcacgcagacgttccaatgccgataccatgaccagcggcagctcgacctcgtaatgatcgggcagatcaccgttgccgatcacatcgatatcggcctgcacgaactcgcggaaacgaccttcctgcgggcgttcgccacgccagaccttctgaatctgccaacgcttgaaagggaatgccaaatcgccggaatgttcgaccacataacggctcagcggaacagtcaaatcgaagtgcagaccaaggcggtcctcaatcggagtgtcggactcatgaccgacctcctgaaggcggctcagcaggtaaatttccttgctggtttcgcccttcttgagcagactcgaaccctgctcaacagcacgagtttcaatgccaatgaagccattgagctcgaaaacttcacggagcgtgtcgataacacgctgctccacaacacgttcagaggggagccactctggaaatcctgaaatagatgcgccttttgccacgattccctataataaatgaggttgcggaaaatgcagcgcgtttttcaggctttgaaagcacgttcgcacgatccgcatcccctgcactacatgaagcttacttaaaggagctggccatggccgacgagaatgtcaccgcgtccgagaacaccaatgaaaccaccgagcaggcaacgacgcccgcagtcaaggccagcaaaccggccgttccgagcccggcttcgatgaagccccatgctccgagccccgcggccttcgccaagaaagctccacagcacaccgctccgactgccgcatccaccggcttctccgatgccgatgtgaagaccgccgaagcattcggccgtgtcgccgacgatggtactgtgttcgtcaaggacggcgaaggagaacgtgaggtcggtcagttccctgatgcctccaaggaagaggcgctggctctgtatgcccgccgttaccttgatttgaaggccaagttggacctgttcgcgaacaagctcaagtccaacaatgtgaagtcccgcgaaatcgacgagaccatcaagacgctgtccgcggaaaccgaacagccggcagtggtgggtgatctggccgctctcaaggcccagttcgaggcgctgcaggaggaaggcgcagccaagaaaaccgcgttgaccgaggcacgcaaggccgctatcgccaaggccgtcgaggagcgcaccgccattgtggagaaggccgaggcgctggctgattccctcgacgagaacaccaactggcgttccaccgcagacaagttccgttcgctcttccagcagtggcaggagcatcagcgcaacaacgtccgcatcgacaaggaagatgcggacgccctgtgggctcgtttctccgcggcccgcaccaagttcaatttcgcccgccgcaagtgggtgcagaaccgtgacgaagagcgtaattccgccaagtccaccaaggaagccatcatcgccgaggccgaggcgctgcaggattccaccgcttgggttgaaacctcccgcaagttcaccgagctgatggatcgttggaagaaggccggtcgtgccggtcgtcgtgacgatgatgccatgtgggagcgtttccgcgccgccgcagacaccttcttcaacgcacgtcaggccgatcgtgatcagatcagctcctccgagaaggaaaatcttgccaagaaggaagagctgctggtcaaggccgaggcgctggttcccgtcaagagcgaagaagaggccaagcaggcccgtcaggctctcgccgccattcaggaggagtgggaccagatcggttacgtgccgcgtgacgaagtgcgccgcattgaaggccgtctcgatgctgtagacaagcagatcaaggccattgaggatgccgcttggaagcagtccgatccggaagccgacgcccgcaagtcctccttcgaagaacagctcaacgctcagctcgctgagcttgatcagaagatcgccgcggaatccgatccgaagaagaaggccaagctcgaatccgagaaggccaccaaggaacagtggctgaacgccatcaagtaagtcgcacatcctgatatttggttgcaccacagagatgcggtcaaatatcagctggacttcactcaggcataatcaagaaggctggtacgtaacgacatccgtcacataccagccttcttcgtataatcgcacgtgttctcacatgcgcaatcaccatacagaatattcaactatcattcgccgaattcggtagcacaaatatcggccaccgcatcaatgcaggcatcgacgatgagcttacctcgttcggcgctggaacctgcaggagtggccagtcctccgtaatccggaacgtcgcccttgcgcaccgggtagcgcacgtaagccttcggtgtgacattgccttcgtcaatcacacggtccatatgcaccaattccggctcgtaatgcatcatcaatgaggtttccgtcactgcggcatgttccaacgcccaaccggggaacacgagtccgtcgaacacctgctcgaccacgttctccggcagcggatcccaccagttggtttcgacgatggtggccactcccctggtttcgcgggtgatcagatcgattgcctcgataatgaatgcctcgttttcgaaatgcgcgttcatcaccacgattttggtgaaaccgtccgcgatcagctcgccaagcacatcatgcatttgattgatcaccgtcacaccgttcatgtcgatggtgccggggaacaatgggccgcctccggaaagcggcttcgacttgtacccgtagttcatggtcggtgccacgatgccgtcgatgcgttcggcgaggtcttcagacacatggctggcgatcatggcgtccacaccaaggggaagatgctggctatgctgttcggtggagccgattggcacaataaccggctttgatttcgatgcttcgatttccggccaggtcatatggtccatccgacggctgctgctcatgattgctcctttatgtgctgttgttggtttgcgtttcaacaattgataatgattgcgatgatgccgtccccgcgaatcgatgttgcaatcgatgtttcagggacggcgtttattgtttcgaggaattgtttcgtaaaaaccgtttcttctcagatgcggctcagatccttatccgtgttttcgtgagagaggatcatggcgaccagtgccacggcggccaccgccaccatgtaccaggccggagcgatgctcgaaccggtggtgtagatcagccaggttgcgatgaacggcgcggttccaccgaagatggcgttggcaaggttgaagctgaatgcgaagccggtgaaacgaaccgatgtcgggaaggtttcagtcaggtagctcgaaagcgtaccgtcgttggcggtcagggtggcgcacatggcgagctcaacgatcagcaccggccagaactgtgcggtgttcagcgccatgaaggccggaacggtgagcacgatgaaggccacgcatgcaccaatcagcaccttcttgcgtccgaacatgtcggagatgtgacccatgccgaacaccaaagccacatacagtaccaggcagatggtggtgatggtggacgactgtgcggcagccatgccaaccgtgtcgctcagataggtcggcaggtaggtgagcaccgtgtagaagccgaccgcgttgagcacgcaggcaccgaagctgatgaccaaagtcttgaagtggttctggaacagctcgcgcagcggggagacgctcttagtggtggaagcgaactgctgcttgtcgtccaaagcttcggtcatggaagcatacaccggcgaatcagcgagcttggtacggatgaaatgcacgatcagaccaagcgggccggccatgaggaacggaatacgccatccccaagaggtcagtgcatcagagctcagcgaagcggtcatcacggtggcgagcgtggagcctacgagcagaccgatggcggtggatgccggaatcagcgagcagtagatgccacgcttcttggtcggcgcgtattcgccaaggaaggttgcggcgccggcatattcaccggaagcggagaagccctgcaccatgcgaagcagcagcaacagtgccggagcgaaaatgccgatcgcagcatatgacggcaggcagccaatcaggaacgatgcacccgacatgaacatgatggaaatcgcaagagcgcccttgcgtcccttcttatcgccgaagttaccccaaaacagtgcaccgatcggacgaagcacgaatgacagtgcaaacacgccgaacgtctgcagcatggcgaccgtgtgattgccggacgggaaaaacaccaaagcgatggtggtcgcgaagtaggaataggaagcgtagtcgaaccattcaatgaagttgccgaggaaagacgagacggccactttcttgaccatcttctgctcttcggactgttcagacacggaagccctgttggcggttgcgattgttgcactggcactcatcatgtcacctgctttcttctgctgaatctgtctgtacgttcgcgttttcttcatacccggcgaacgttgtgactctgactatcgcccgaagtatttgcgccaaagtgaactgattgttaaaccgcaaccgtttgtttttgacgttttgccaagttccccttgcttacagcgccgaagtggaagatatggtgtgattatgttgcgatttcgccattttcgcacctaaaagcagcattgaccagctgattttatcggtaggcgctatgcccacgatctgtgtcactttgtccaatcggttgtacaacgtctgccgttggatacctaattgctcgcatgcgccggtcttgttgtcgagattgtcgaaacaggcgcacaacgtgtcgatcagcatggcgttatgcataagctcatgcccaactgtctgcgtgatcaccatgcgcacggcctcatcggtacgttccattcccaacatgcgttccagcaacgaggaatccacacattcgagggttccatacgggcattccgcatcgtttgaaatgcatgttcgaatcacactgcgcaacgcaccgaacgcgtccatcaatgaaatcgtgtccaacgctgcgcgtccatgcacggtatatacgtattcgtttgcagcgacttgcgtcaacgcatgcaaacaccgatctgaaaataccgacacatcgccgccgctgtcttgcgccgcgagaaaaccgatcattaaatcgccttccaacaaacagatcgattcgcaaccgccgttggattcgaaatcgtcgatcatcgacacgattgccggcatggcgttggccaccgacttgagtttcatggcaaatggcatatacacgcccgaagcggcgaatcccaacgcatcaagcatggcatggccctcacgcgcttccatcggcgaaacatgcacgccatcttccggccccgcaatcagatgcgccaccatgccgacgcgcgctcccccatcgagatacagtgtcaaaaccggagcggcaatctgttcgatccttctgcacatcgcttcatcgaacaccgtattgcgctggctgatctccaaagcgcccaaaggccgtttctgttcctccagtgcaagtacaatgccgcaatctgtagcggtattgatgttctgtccggctcgggcgacttcaagaccgtccacgtcgaatatgaccacatcctcgccgaacaggttcgcaatgccatcggcaacggctttgggattggacgcttgagcaagctcagaacgcaacgaagttgacataacgtccacttgcatctgcatacgcatctgatcacgcacaatcatggtattgacgctctggcagatatcgacgaaaggaatgcgacggcgcaatccaataatcgtaagtccttcatgcttggctgccttcaccaacattttcggcagttgggtgacttcttcaaccaattcgaccatcaatgccgcaatatcagcattcacgaggcttttcacatattcgtccgcacgtttttcacgaccgtccgcaactaaagatcgcccctccaccaccagaagctcgcctcctgccagaaatgaggcgacgtcctcgcgttcgttggtgaacacccaacgcaccggattatccaagctatcgccagcaacttcaacctgtggttccgccgtcgcaaccaaggcatcatcgagcacttccctcaccgtaacagccatacaaaccgtccaatccgaagtaatacacatgtcacatcaagtaacgtgaccgcaaagcaatacgccgacaataaccatcaacgattacgtcaaaggttcccttccgtaacccaatggacatatgacaaaacgtctgccggaacccgaaaactcgcatgaaaactcgtattggaaggagtgattatgagcacgcaactgttcatcaacgcacacatcgccaccggcatgccgggcagcaccgcagccgaaacagcggcaatccaagatattctcgtcgaagacggcaagttcatcagcattgcacccaatctcaaagcaacactcgaagcacaaggcaaagatatggcgagcgtggaagtcgtcgatttgggcggaaagctggtctgtccaccattctgcgacacccatctgcatcttgattacgtctttaccgcacgcaagcccggcgcggtgaacgagtcaggcaccctgttcgaaggcattcagcgttggagtgaaaccaaggcagatctcactgtcgacgagatcaaggaacgcgcgaaaatcggcatcgccaaggaaatgcgtcatggcgtgcagttcattcgttcgcacgccgatgtgaccgacccgaatcttacctcgctcaaagctctgctggagcttaaggaggaactgaaagatactgtcacgctgcagatcgtctccttcccgcaggagggcatgtactcctatgaaggtcctcatggcgaatccggcgcggatttggttgaggaaggcctgaaaatgggtgctgattgcgtcggtggcattccgcatttcgagcagtgccgtgagttcggcgaacgttccatgcacaccgtggtcgaactggcttcgaagtacgacaagctcatcgacgtgcattgcgacgaaaccgacgatccaaactcacgttatcttgaactgctgtccgcactcgcctatcgcgccggtatcggttcgaagaccacggcaagccacacttgctccttgggatcggccgacaatgcctatttcttccatctgaccaagctgttgaaggccgcacatatcaatttcgcctgcgcacctacggaaaatctgtatctgcaggggcgtcaagacacgttcccgaagcgtcgtggcatcacgcgagtcaaggagctcaccgaagctggggtgaatgtgtcgcttggtcaggattccatgcaagatccctggtatccggtcggtaacggcaatatgatgctgattctcgattatgtgctgcatttggcgcagatgatgagttttgaagagatcgatgatgcgttgaagttcctgacagtcaacggcgcaaccacgctcggcatgcgcgattcgtatggtcttaaggcaggcaagcccgcaaacttcattgtgcttgatgcttccagcgtgttcgacgccgtatacgagcgttgcgaagtgcttcgctcggtacgagagggtcgcacactgttcacccgtaacacgtcaatcactgccgatctcgatctgctgacactgtaattcgtcaagtttcgaaatactttcggcatacgaaaggccttgaaatcattacatacgatttcaaggcctttcgtgtgtcgcgttacttacgcaccgattgcttattcaacagattctgcggattccgtaagttctgtcgattccgtcgattcggcaggtgcctcggtttcagctgcgacttcaccttcagcaggctccgtatttggctcttcgaacgcctcaccggtaaaggtgaactcgcccaggatgccttcgccttccgcatcgaccttcacgcgctggccatcttcgagttcgcccatcaggatcttctccgaaatggcgtcttcgacgtcgcgctgaatcacgcgacgcaacggacgcgcgcccagcagcgggtcgaagcccttctgcgcgagcagatccttggcagcgtcggtaagctcgagggacatgtggcgatcgaacaagcgatcattgagctgcttgacgtcaagatcgacgatctgacgcacttgcggctcggtgagctgcttgaacacgatgatgtcgtccagacggttcaggaattccggacggaactgctgcttcagctccgcggaaacctgatccttcatgcgctggtagctcgactcggtgttggcacccaagttgaagccggtgttggcggccttggcgatgtctcgcgtaccaagattggtggtcagaatgatgatggtgttcttgaagtccaccttgcggccctggccatcagtcagatgaccgtcatcaagcacctgcagcagcgtgttgaagatatccggatgggccttttcgatctcatcgaacagcaccacggagaacggcttgcgacgaaccttctcggtgagttcgccgccctcttcgtaaccgacgtatcccggaggagcaccaaacaggcgcgaagccgcatatttctcggagaattcagacatgtcgacacgaatcagtgcgtcctcgtcgtcaaacaggaattcggcgagcgtcttggccagctcggtcttgccaacaccggtggggccagcgaagataaacgaaccggacggacgcttcggatccttcaaaccaacacgagcacgacggatggagcggctcaacgcggacacggcctcgtcctggccgatgatgcgcttgtgcagctcgctttccatggtcatgagcttcttggactcggcctgggtgagcttgaacaccggaatgccggtggtctgggaaatcacttcggcgatgacatcctcatccacaaccatcttcacatcagattcgccctcacgccacgaagattccttctgcttgcgttcggcttccagcttctcctgcttatcacgcagctcagcggccttttcgaagtcctggcccttgatggcctggtccttctcttcggcaagcttggcgatcttcgtgtcaagttccttaagctccggcggagcggtcagacgacggatgcgcagacgcgcaccggcctcatcgatcagatcgatggccttgtctggcagatgacggtcctgaatgtaacggctcgacagatcggccgcggcctgcaacgcaccatcggtgatcgtcacatggtgatggttctcgtaacgcgaacgcaagcccttaaggatctcgatggtttcggcaatgctcggctcatgcacctggatgggctggaaacgacgttccaaagcggcatccttctcgatgtacttacggtactcgtcggtggtggtggcgccaatggtctgcagctcacctcgcgcgagcattggcttcaacatgtcggaagcgccaagagcgccatccgcggaaccagcgcccacaatggtatggatctcatcgatgaacagcacgatgtcgccgcgggtcttgatctccttgagcaccttcttcagacgctcctcgaaatcgccacgataccgcgagccagccaccatggatcccagatccaacgaatagacctgcttgcccttcagcgtctccggaacgtcgccggcattgatcttctgcgccaagccttcgaccacggccgtcttgccgacacccggctcgccgatcagcaccggattgttcttggtacggcggctcagcaccaccatcacacgctcgatctcactcgaacgcccaatcaccggatcaagcttgccggcggcagcttcagcggtcagattgcggccgaactggtcaagaatcgcggaaccggtctggttgcgacgatcctgcacgccaccggcattggccaaatcgcccttgccatcacccttgccatcaccggaattgccacggatcaggtcgatggtggcgctgcgcagctcgccaagattgacgtccatcttgatcagcacctgggtgccgacgccttcgccttcatgaatcagaccgagcaggatatgctcggtgccgatatagctgtgccccagctgcaacgcctcacgcagcgacagctccaacacctgcctggcatgcggggtgaagggaatgtggccgttcggcgtggcattccccttaccgatcatctcttcgacctgtttgcgggtgtcatccaaggtcacaccctttgaggccagcgccttggctgcgacgccgtcaccctcacgaatcaggccaagcagcagatgctcggtaccgatgtagttgtgctggagggtacgagcctcttcctgcgccagcacgatcacgcgccgcgcacggtcggtaaaccgttcgaacatgcttgtccttccactcttgttagtccatcaacactctaccgattcgcgatgacgtttgttttcatccgcgcgtaaattgcgctctcgacgcaacgcaacggatatgcttgacatatagcaacgaccaaggaggtcaccaagatgagcgacaccaccctaaatgcaaccgaatccgggatgctcgcagatatccgcttgcacgacatcgtcgtcggcgtcgacggttccgacgaatccttcgccgcattacgctgggcgctgaacgaggcatcgcttaccggccagcaggtcaatgcggtgttcgcatggtcccattcctgggatatgggctcggaaccggaagatgaagagcagtgggccgaagtccgccatgagatcgcgcaacggcttcgcgactgggtttccaaagcttcgcagggcatgaccatcaatgaggatcatgtcaaactcacgtcggtcaaggccacaggaacgtccgcattgctggagatcggcaaggatgcgcagcagatcgtagtcggacgccgttcactcggcagagtggcacgctggttcctcggctcgctttcggaatcgcttgccgaagccgcacaggttcccgttaccatagttcgcattctcgacgacgaggaatccagcgtgcaggatgccatcgccaacgcgcttacgccttcggagaacacggtgacgtacgatttgcccggctcccctctgcctaagaaccagcggccgatcgtggttggcgtcgatggttcggaaacctcgcgacacgccttgcgattcgctatcgacctggcggctttgcatcacgctcccctgcaggtgatgttctgctggcagctcaaggatcttggcgtcatcgagggatatgagaacgccatagcgccgattgccgtcggtcaggaacgggcggaacgcattcttgacgagctgctcgattcggttgagattcccactgccggcattcccgacgatttccagatcaaatcgcacgccttccatatttccgctgcgaaggggctgatcgcggcatcccgttacgcacgccatctagtggtcggttcccgtggattgtccggcttggacgcgcatttccttggttccgtctccaagcaaatcgtcaatttcgccgactgcaccgtcactgtcgtgcactaaacctttgaggatatgaaagaagtccgcttccttacatagggaacggacttctttcatatcctcgataagacaggattactcagcttccggagcgttttcctctgcagtgtccgtttcctcggcttcggtgggttccgcatccgtcgcttcatcctcttcggattcgacgataaccggctcttcgtcatcgctcaaatcaacggtggattccacctccggctcatcctgctgggccgtatgttcgagcacttcctcctgattcgcatcatcatccacggtattggcttcgatatcggcttcggaggcttcttcctcatcgttcggattgccgtcttcattcgccgacagctgctcgatcagttcgacggaaccgcgttcatcacgcggcgcctgcgcgatgatatcgatatgcaggtcgtcaaatgcaggtttcgactgcacccacaagtgagacggttccggcggctcgatttcggaatgttcgccacagccatggtcgatggatacaacacgaccgtcatcaggactccacttgttagcgcacacgccgaacagaagattcagttcgcctttcagaggaatgaagaatccgcacgtcgagcatggattgccatccgatgttttggtggacaacgatttcggtccgcgcggtccctcataccagcgtttcgcggtctgggaacggcccaaaggcgtgagcacgtgcctgcgggacagatcgaattcctcaaccgcctcgtcgatgtcctcttcggaggtcaccgatgctccggcattctcgtcttgcgaaccgtcaaccacgtcagcgtccgctccggcattgtcgccgccgtccgccgcttcgacggtctgcacatcgtcggaaacgctttcggcagactcaacgggctcagttctgcggaacccctcttccatacgtggatcatcgggatcggtgccgatcgaatcggtcaccgccaaatcggtcggttcaagacgatccttccatggaatccattccggtgggcgcaacgccttgtcggtaggcaccagcgatgactcattgaccgtccaatggtccaactcagcatcgcgatacaacgtcaccgaccactgccatccctcatacccacgtatgcaggtttcaaaacgaaaatcagtaacgttgtctcccaagtcgatggcttcgacgaagtcaccgacttggccatcctcatcggcgacttcgatggccaccgcctgggcgatcgccttgggatccattgtggtatcggacatgaattattcctgtacgtcgaagttatcggccacggcacgcatcagcgtggccagtttcttgctttcagccggagatggataatggtggcggcgcaactggttccccgcggaatccagcagcttgataagatcctccacaatggcggccatatcatccggcttcggtcgagttgctttgaccagagacggcgcggatgccacaagggtgaggcccattgcctgcggaccacggcggccctccaccacggaatactcgacttttgcacccttacgcaacgtcttcacgccctccggcagggcggctgcaggcaggaacacatcggcaccctgctcgttctgaataaaaccatagcctttgttcgcatcgaaccaacgaacgcgtccgctaggcattgtcacctcactcttacgtaatccacataccttcaggcgaacgaaagaacaatcgtccgccgattacaaatcaaagatacagtttagcgcaagaggtgggatatgtaaccatctcttgcgccaacaatcgtcagatcatgcctttttgcatgtttgcatcattgttttttcggcctgcgcccacgcttgtcgaccttgcgttcgtcactggtctgcgtcaacggacgtggttccacaggagccaccggaagcactaccgtcagtgtcaatccagtcccgtcactgccggaagcgcagatgaaaccatggtgtgccttgaccacggactgggcgatcgccatgccgagacccgtaccgcccttctgtcgtgctctggacagatccgccgtgtagaaccgttcgaagatcttcgagcgtgcatctgcgggaacgccgggaccatgatcgctgaatcgcacaattgcgtaattcatgccgacttgcatggattgccccacctcgatggcctcgataaagtgatgcaacgactgctcgttggatggcatgcgagacaatgattccgggctgatggacgccggaagcacgcccatggacacttcaaccggggaatcggccggcgtgtaccgatggatgttgcctacaatgttcgtgaccacctgacgcaagcgtgatgcatcgccggtcaacgtgatgtccggcatggttcccggctggaaggcgagacgcgaaggatgttccatatccgatcccgcctgcaataccacctggccgcaggtgatgccacgatccgggtcgagcgcgtgcagatcatcagccgcatcattgaccacggaagtcagcttcacctgctgggtgatatcgatgccacgtccttcatccaaccgcgccaatgacagcaaatcctcgacaagcaccgtcatacgcgcactggacgcttctatatgttcaatggactcatcggcacgttccaatgctccgggcatgtcacgctgcattttgtacaactccgcatatccgtgaatcgcggcaagcggagtacgcagctcatggctggcatcggaaacgaaccgtttcatcttctcggtcgtttcttcctgcgcgtggaagctttcctcaatacgcgtcagcatggtgttcagcgacatggacagcgatccgacttccgtattttccggcaaatcgggaacacgttggctcaaatcccctgccgcaatcttcgcagcggtcttctcgatacgtttcagcggagcaagcgtgctttgcacgacgatggtgccaagaatggcgccgatcaacaccaccgcgatgccgaccatggcacagaaccgcgtcaacgtgttggacgtgtcgatctggtcactcagcgacaatccgatgaacacgacgccgctgtctttgacctgccccgttttggttttctcgctccaaggcagcgccacaacacgccacggcgactgtgcggcctgcatgatggcatgatccggcaccctgctggtggtaacgtgcaccaccgcctgtgtggtgaacggctctccgagcgtgaccccgtcgatactgccgtcggaaggcagactcggctcggacaccacgccctcacggagcataggcaccgacccagcgccggtacgcttgtattcgctgtcccgcacctcgacataatacgtgttcaccaagctccggccatcctcgctcgtggtgctgtccagcgaatccatgctattgaaaatcatctgcgcctgattcaccaactgcgtgtcggttttctgtagcagataattgcccacaagcgcgcgaatggaaaaggaaatgccgatagtgccaatggtcaacaacacaatgatgcaagtgaccagcttggtgcttaacggaatggcctgcaccttcctgccgatccgccgatgccaaggcacacgttgcggacgcggctggccgccgttcttctgcgtgttctgcgggtcagccgacggctgacgggtatcctgactcatcgcgggaccgtttagttcttcggcgcacgaatcatgtagccgatgccacgcttcgtttcgataagcggagccaccttgcgcttctcgccgttctcatcctccaccgtaagtccgtcgaccttcttgcgcagatatgaaatgtacgattcaacaatcgcggcgtccccgccccaatcgtactgccacacatgatccaaaatctgcgccttcgagagcacacgcccctcgttatccatcaaataacgcagcaacttgtattcggtggggctcaaatcgatcggctgtccggcacgggacacatcatgcgaatcttcattgatctccagatccgcgacgcggataatcggatcatcctcaacctgctcctgggtacggcgcagaatggcacggattcgcgcaacgacctcctcaagactgaacggcttggtcacatagtcgtcaccccccacggtcaaacccatgaccttgtcttgagtatcatcgcgagccgtcaaatacagcaccggcgtagtgatgccttcctgacggatacgacgggtcaccgtgaaaccgtcgatatccggaagcatcacatcaagcacaatcaaatcaggctgtattttctcgatgacttcgatggcttcagatcccgaagccgcggtattcacttcaaaacccgcaaaatgcaaggatgccaccaacagctcacggatggacggttcgtcgtcaacaacgacaatggatgcttcaataggcttgctcatgctttaagcatcactctgttcactggatgtttcctgaacggattctgagtcttcctttgacgtctgccctccatcatgcgcttcaacggacagctcaccatcgacactccacgccttcaccggctcggaacgcacagtaatcgcggcatgccttcccgcatgcttgcgcaccttgcgcttgatgatgccacgcttgcgcagaatatggaacaccaccataatcacaatcagcagcaccagcacggctatcatgccgccaacacccaacagcacggtctgcgacgacgtcgaggtcttcttctgcaccgcaatctgatccatcatatcggttgcggatttcgaccaatccggagtgctttccatcaaaggtttctgcgcagcatcggaaagcgcatcgaccgtcgacttcttcttcaaccattcgtcggaattcgacgaaacggcaaccacgagattgccatcgttcgaagcgaccgccagcaaaaccgtattcggtttcggatcaagcgattccaacagcgcgctcgcccattttgcaggtttttcttcggtgttgaaacttgccaggtacagcaaatgcacggtgacgcccgtttcctgctttgtcgcgctgatggcatccgtgatctcggcgacgtttgatccgagcagattctcagtgtcggtgatattttccgtggccgtgattccggtgcccgtattgtcttccgcgctgccgacgggagttatccacaacatcatcgcacaacacaacagcatagaaagaagcatgcaagccgctacattccaacgatttctgaagttttgccgttgtcgcgacacaccgattgggcacattttcgcacatcctccgaccacaaccctggttttttcattcatcgcgttcactgttgccatacagtccacattaccgttcagatacgtcaagtgcgagcgaacggtaccaaccgagcacacaaaagtacctggcaacgaaaggatcatcatggcacagtttcaggtggacagcgagcagattcaatcctcgagcgcggcggtaaacgcctccatccaagcgatacgtcagtcggtgcagggcatgtacgccaatctcaacaatctgcagagcgtctggaggggcggagcggccacacagttcaatgcggtggcggaacaatggcgtgccgcccaacagcagatggagcagtcgctcgaatcgattcagcatgcgctgacgcaggcatccgcactgtatgcggaaaccgaaatgcaggcatcgcgtctgtttgcgcagtagcggcaggtacttccgacgcaatcaaagcaatagctggcgcaaacaaaaagtggagcccgcgtccactatgggaaacggactccacttatagctttttgcttatgccgttaggctttgccaaaccgttggatcagtagcccatgtcagcgccagcggccggagcggctgccggcggttccggcttgttggccacaacagcctcggtggtcaggaacagaccagcgatggaagctgcgttctgcagtgcggaacgggtgaccttgaccgggtcggtgacgccggcggccagcaggtcctcatactcattggtggctgcgttcaggccctggccgtcaggcagggaacgaaccttgtcgatcaccacgtcgccggacagtccagcgttttcggcgatctgcttgatcggggcttcgatggcgcggaacacgatcgcggcaccggttgcctcgtcgccttcgagcttgacatcgctctcggccttggctgcagcctggaccagagcgacaccgccgcccggcagcaggccttcttcgatggcggccttggcgttgcgcacggcatcttcgatgcggtgcttgcgttccttggcctcgacttcggtggcagcgccaaccttgatgacggcaacgccgccagccagcttggccagacgctcctgcagcttctcacgatcgtagtctgaatcggtgttggcgatttcggcacggatctgagccacgcgggcagccacgtcttccttggagccgccgccggccacgatggtggtctcgtccttggagacgatgaccttcttggcggtgccgagcacggacatgtcgacggagtcgagcttgaggccgagttcgtcggacacaacctgggcgccggtcaggatggccatatcctgcagcatggccttacggcgatcgccgaagcccggagccttgacggcgcaggacttgaaggtgccgcggatgttgttcagaatcaaggtcggcagagcctcgccatcaacgtcttcagcgatgatcagcagcggcttgccggtcttcatgaccagctcggcgatgtgcacgacgtcctgctgagagctcaccttgccggaggtcagcaggatgtacggctcttcgagcactgcggtctgatcttcggcgttggtcacgaagtacggagcgatatagcccttgtcgaaacgcatgccttcggtgaagtccagatccaggccgaagcggttgttgtcctcaacggtcacgacgccgtcctggccaaccttgtcaagagcttcggcgatcttctcgccgacttccggatcggcggcggaaatcgttgcggtagcagcgatctgatccttggtctcaacgtccttggcagctgcgataagctccttgacgatggcttcggaagccttctcgataccacgacgcaaagcgatcgggttggagccggcggtgacgttcttcaggccttcgtgcaccagggactgggcgagcacggttgcggtggtggtgccgtcgccagcgacgtcatcggtcttcttggcgacttccttgaccagttcggcgccgatgcgctcgtacgggtcgtccaggtcgatttccttggcgatggagacaccatcgttggtgatggtcggagcgccgtaggtcttgtcgaggaccacgttgcggcccttcggaccgagggtgaccttgacggtatcagcgagcttgtcgaggcccgcgagcattccctgacgagcttcgtcgtcgtatgcaatgatctttgccattgttcctccacatatggctacacggtattattcccaccttcgaagcgaagaacgcaccagccgtcagctgccagttatcactctcgctcctcgagtgctaattggcagattagcactctcaggccgagagtgccaaactccatgtcgccagttgcgctgtaagcaagaagaattgttcgtctaaataagccatcaacgttggaattccaaggaaaacaaaaaagccttgttctttgggaaaagaacaaggcttttttgtttcgctcacggcgtttttcagtcaagcaacaccacaacgattggcgtgacgagtccatcgctttgctgcacattcgaaattcccagcgtctgtgcgacgttttcggcggtcgccttatcggtctcgttctgataccagaccacggtctgcgaaggaacgtttcccgtcggattgctggcagaaacactggtatacccggcttgggtcagcacgtcggccttgctttgcgcataaccggtgatattcgtcgcgttcacgacgcgaacctcagtacccgtgttcacagcctgctgcgcagtggcgttatccgtctgctcggcattctggccggcattctggtcggcgttctgatcattttgctgcgagtcggtcggcgaatcggcattggatgcgtccgtcttattgccggaagcggagtcggattgggacttggacttgctctcgccgctcttgctcttttcggcacttgaagtagtcgaactctcctgcgacgaccacggcatcttcagattgttgatctcacctgaataaatgctccagaacagcaaaccagcaagcagcgccacaatgatgacaatgacgtacggcatggcccgggacgccgcggaacgcgcgccacggtgaacacccataggtcccgccggaggattgtcgtacacatccttctcgtaggaatcgtaggtctccttgtcctgcttagccatattgcaaacctcgtttctcacacacttatctgccaagtgtaccgaccacctcagtcagaacacaatcgagccgcattcccacccctattccgaacgttcgtgaaaccatcccgtgaaaaccaaaccacccctgtcatcaggaccgcaacacgtcgtacagtaagatgcatgacacaatcgaacatcaagccgttgaaagatctcgtggagcccggatgggcgaatgccctcgccgaggtcgagccacaggtgcaccgcatgggcgatttccttcgaggcgaaatcgcagccggacgccggtatcttcccgccagcgcgaacattctgcgcgccttcaccatcccattcgacagcatcaaggtgcttatcgtgggccaagacccctacccaacccccggtcatccggtgggactgagcttctgcgtggcgcccgatgtccagcccattcctcgtagtctgaccaatatatacaaggagctgacggatgacctcggcgtacccatgcccacgaacggcgatctgacgccttggacgaatcaaggcgttatgctgctcaacagatgcctgaccgtcgaagcgggcaagcccggcagccatcaggacaaggggtgggagatcgttaccgacgcggcgatcaaagcgcttaacaaccgccgcaatcccgatggcagcatcaaacccttggtcgccatcctgtgggggcgcaaggcgcagacgctgggaccgctgctcaccaacgcatatattatcgcctcacctcatccgagtcctatgtccgcgcgatacggattcttcggttcaaaaccgttctcccgcgccaaccaagcgctcatcgccgcaggcgagaagcctgtggactggtccctcccgtcagcttgacccgttacagtagcaactatggctttattccctccgaagaatccggtaccgacaccaacccccgttccaatgccggccgtcaccaaaccgagcacgttgcccccagaggacatcaaccgggcgaaacagctcggcacgtgcatccgcgcacgcttcgcgcagaccctagttggacaggacaacctgcgtgaatcgctgatcaccacgctggtggcaggcggacatattctcatcgaatccgtaccgggtctggccaagaccacggccgcgcagacgctggcgacttccgtgtccggatcgttcaagcgagtgcaatgcacgcctgatctgatgccatccgatctggtgggcacccaggtcttcgatttcgcgacgcagaagttctccacgcagatcggcccgatccacgccaacttcgtgctgctcgacgaaatcaaccgttcaaacgcaaaaacccaatcggccatgcttgaagccatggccgaaggagccaccaccatcggcggccagtgcatcgcactgccgaaaccgttcatggtcatcgctacacagaatccaatcgaggaggaaggcacgttcaaccttcctgaggcgcaaatggaccgtttcatgatgaaagccgtcatgacgtatccgaccgcgcaggaggaacagcgcatgctcaccatgctcacccaccgcggctccgacacttttgattcacgaacgctcactggtgacgtcgtgtccatcaacgatgtcgaattcctgcgcgccgcggcccgtcgcgtgcatgtgtccgacgcaatcatgaaatacgcggtcgatatcactgccacatcccgaggagccggcaccaagccggtgcagggattgtccacactagtgcgtctcggagcctcgccacgcgcgtccatcgcgctgactcgcatcggacaggccaacgcgttgatgcaaggccgcgactatgtgattccggaagacgtcaaagccttcacacatgaagtgcttcgccaccgcatcctgctcacgttcgaggcccttgccgacggcgtcaccagcgatcaggtcgtggactcgatcgttcaggcggttcccgttccatgatcgacgcaattcgttccgaagatccgatccgcagtaagatcgaagccctcggaaccacgttgagcctgccgactgttcgcaaggcgctcggtattcttgagggtgcgcacgcatcagacaagcgtttcggcgccgacgatgtcatggatatccgcatctatgagcctggagacgaggcaaaacggattgattggaagaccagcgcccgtgtgggccgccccatggtggtgcagcgcgaacgcccatccacttcacgcgcctggcttttgctcgatgtcggacaggaaatgaccggtacctgcgtttccggcgaacaggttcatcaggtcgcagccaacgccctatgcatgttcgcggcgctcagcctgcgtcgtggtgacgaagtgtccatagtattcggcgattcaggctcgatcacccgtgtgccattcaatggcggacttacgcaattcgaacagacgttggacaatgcgctgcagcgtgattggaacaaacctcgcaatatcgacgctttgctggagtacgcccgtcgcattcgcgacagggatgcgttggtggtgatcgccaccgatgagcacgcacttaaggaacgtcatgtggagtccattcgcaggatcgcaaggacccatccgatggtgctcatcgatgtcgcaaccattaatccgttcgacaatagccatgcgcgcgacgtattcgacgcgggcagcgaccgccgcattccggcattcctgcgcaccggcaaaacggcgcaggaggttcgcacgcatcgcgaatatctgtccgcgtccatcagacatgagctgaatcgttgcggttccacagtgatccgtgccgattcaagcgaacgtatgttccgggaattcgtacggatggtatccgcatccctatctcgctccacacgcaatcagctcaaagcaccgtcctcactcaccttgggaggcaaagcatgaatcacatcgccttgtctcgcaacgatttcaacacactggacccgattcatatcgaaacggggctgggcatcgttgtcgcggtatgcctcatccttgccgtggcacttgtcgtcttggtggtatggctgtcgaaaccaactctcaatccaacgaagaaaaccaatcgcggacgtcacgacgcatcgacgggcacgtcgatatggcatgaacgcatcaacgatgtggtggaccgtcatgccaacggcgatctcggaagagaggaagcgttcgccctgctcgcatcgatcgccagagatttcgtctccacggccaccggcagcgacgtgcgcaatcagacgctcaccgatattgaagcgacacctcgcacgaccggcaaccagcatgggctcaccctgctcaggcagaccatcgaggcattgtatccgccggaattcgcggatgccgaacgcaatcacacggccagagaggccacggttgaacaggctggagagtgggttgccaatcttgtggaaaggtggcgatgaatggaattgtcatggcactggccgtgggtaggccttgcaggcctgattgcgtcattggccgtcatcgccatcatggtattggcgtccgcaaaacgcaggcataacgactcaggatccgtgcggacgttcagtttggatgacgatctcaacaccgaaaccgcatcgagattatttcggcagtggcgcaccatgtcacgtgccgccgtcgttctgttggtgatggcactggtgctggcgatagcgctggtggcacgccccagcaccgtggatgagggagaggagcgtgcgagcagccgcgatatcgtgctgtgcttggacgtatctggttcgacgttgccatacgaccgcgaagtgatcgatacctaccgcacattggtggacaatttcaagggcgagcgcatcggattgagcattttcaattccacgtcacgtaccgtgtttccgttgaccgacgattacgaattggtgtccgaacagctcgacaagaccagcacgatactgaaaggcgtcgaatcgcaggatgatatcgacaagatgaaagacagcgattaccaagcgatttccgactggctggaaggtacgcagaatcgtaaagaggccacttccctgatcggcgacggcgtggtgagttgcgcagccatgctgccaggtttcgcctacggcagttccaacgccgagaccgcatcccgtcaacgtgccgcttccattgtgctcgccaccgacaatgtcgtttccggagatccgacatacacgcttcaggaggctcttgacctgaccaaacaggcggaaatcaccgtggacggactgttctccggaccgcagcaaagcgaatcggaacagacgaccaaacagttcgaatccgaaatcgaatcgcatggcggcgtgtttctcacgcaatcgaacggcgcttccgtggctgagctggtcaagcaaatcgaatcgcggcgcaaccatgacagcgcggcaagcagcaaggccgcaatatcggacgcaccgggatggtggacgctggcattggcagtggcgatagtgatttggctgctcttggcttggaggttgaggcgatgaccaatctgacgctctcccctgctttgggatggcctttaggcacggcgatctgcgtgatcatgctggtttgcgcagtcgcgcagattgtgcttcatatccgtagacgcagccaaagcgatgaaaccgtctgggcttgcgcaagacgatcgatgatttgtgcgctggtggccatcatggcattgacgccaagcatcgtctcgtccacgaacagccgtgcgattaacaccaccgatgtggtggtggcggtggatgtgaccggttccatggcggtcgcggacgcgcagtatggttccgacgaacagctcagccgcttggatgttgccaagcaggcggtgaaggatattgccgccatgtatccgaattccagtttcgcggcattgcgattcggcgcttcgggaacgttggatgttccgttgacgcctgattcgaaggcgatcgataattgggcggacacgcttgcaccggaatcgacttccatttcggccggttcgaccttggatgtgccgattgaccagttgttgctcacatgcaagtcgattcacgatcagcatcccgatgatgcgatcgtgctgtacctgatttcggatggcgagcagacctcgtcgaaaacacgccgaacgttctcatcgttgcgacgctacctttccgatgcgttcaccgtcgccgtgggcagcgagcagggaggcaatatccccgtgaccggcgatggcgtggaggaaggcgacacgcaatgggttaccgatccggaaaccggcgagcctggcgtgtcccgtatgaatgccgacgaaatgaacgccatcgccgacgagctcagtggaaccgccatccagctcaatgccacgacgaccatgagtggcggggattccaaagagacatccagcaaatggcgtgtcacgcagacatccaagcaacgcacaagaaccgtcgccatggtctggccgttcgccattgccgtagcgctgctgctgacgttcgaggccggggcatggatcacgcaatcaaggaggctgctgtgagcacaaccgttacagcgcgtgcatcgctgcccgttcgcatcgccatcgccgtcatcgcagccatatcggttattgtgggcgtgcttggcatagtgaatctcgcatccgtcagcaactacaaccaggccacggacagtctgaatgcgaatatcaaagccagccaacagcaagacgccgatttcgacaaattgcagacccaacagcagcagaccgacgcgcaattccgtgaagctggcgcggccggcatgttgctgctgccaaacgtacgcacatccatcgagcataatgccgaagtttcggcaaaactgaccgaatccatacgcaagaaaatcggagagatgcagcatgccgacggcaccgaggccgacacagtcatcgaaggtgggcaatccgtcaccgatggaggccaaggcaacggaggaaccttgactgacgagcagcgtcagaaggtggaggagcttctggcccagaacgcacagtccgcccaatccgattccgatgattccggttcggcggccaagcaggattccaaccaaacatcttcgcccgcaaaaccctggtaagggggcttatttcaggaagttatccacaggcatgtcggcgtgtttttgttgatttttcaacgatgacacgccgacatcgtgcttttcgcccgtcctccgaccacaagccttgttcgccggcttgggcaaccgcccgatgtgctccaatatagctatgaacgcatcaatcacctatccgtttattcccggactggggttcaacctcatcaacaccttggcctcaacgccaggcatgccatgccattgccgtgctggcgtgcgaaccacccaactgctcgtcaatgccaagctcacgtccatatcgaaacatcttgacgatcttgacgccacgctcgcatccagttcattgcccgattggacaggaaccgccgccgaatcataccgcgcgcggcttgatgagttacgcaagcaatccctgacgctacgggattcgatcaacgccaccttgcgtctcctatgggcagtaggtgcggcatgagctgggaagtgaccgccaaagtcagcggcggatgcaaatactccacggaggaaaccgaggcatatatgcgcgcggcaaaagccctcagccatcaagccgacgctctgaaccgcgcccatgattcagtccgggcattgagccttcagctttcctcctacccctatgcgtcgtcggccatcgcctcgctgtccggatcaagcccctattgcaatgccacggatcacatcgaactgccatacgaccagctcgtcgaacaatgtgacgcccatgcaagcgcgctgggagccatggcggcaagattgtcggagctatcggcgctgatcattcgcgcgcaatcgttatattcccaggtcgacgacgctggcagaagaacactgaacgaactgctgcaagtggcgatcacatcgttcccgaaggaatcgatactcgccggcgcagccatgtccgccttgggatatgtgatgggatccaccaatgagggcaaatccaatcccatatatctgctggactcgttggattgggcgcaggaaggcatcatgagcgcggccggcgccgcggtcagcggatacggcaaggtcaaaggcctgctgcgtaccgatgaggtcaaccatgcagccggcaccatctccaaggcatcgtcgcgcggttacaacttgatccagggcaacaatcttaccgtcacccaagtccatccgaaaaccgaagtggtgcgtgaatcgcataatgtcggagaggccatggaggatcttcgacgtcttgccgaggaacgtctcggcaagaccgatctcgacagcggacttgactacggcaccatcgccatctccaaataccgtaaatccgacggaaccaactcatggctcgtcaccattccaggcacagacggcaagcacgattctccatttgggtggccgcaaaacgtcgaactcatgagttcggacagcaagcaacgcatggaagcggacagtgcgcgaatggtgcaggaagccatgaaacaggccggcatcaaatccaatgagcccgtcgcattgatcggacattcgcaaggtggcatcgttgccgccaccatcgcctcggacctgaaagacgattatgacatcgaacatgtggttaccgccgggtcgcccgtcgccaatcatccgattccggaaaaaacatgggtgaccagcgtggaaatggacgacgagctcgtggcggccctcgatggcgccgccaaccccagttccgaccattggctgaccgtacgcggcaccgcaagcaaatccagcagcaaccaggaatcaacgttcgcaggcactcccgtcacagacgctccagacaacaaggaaatcacgcattggctcaaatatcaccaagccgcataccagaacgcaacggacatgggatccaccgcagtgaacacccacgaacggcatttcgatgagatcatcgacggcgatctgcaggaagtcatgtatttcgaagggcgcatgagcaaatgagaaaacactgcagccacggcgcaacaagaacggtatcacggcatacatcatgaaagccatccaccgagcggacagatacgcaactttcgtttacggctgaacgtatgctgtagtctatgaagcttactgatatctcccctgcaatcgcattgacccctcttgacggccgctaccatcagcagaccgctccgcttgtcgaatatttgagcgaacctgcgttgaaccgcgagcgcatgcgcgtcgaagtcgaatggatgattctgctggccaacggtttcgagggcaacggcaaccagaccatcgttcccggcgtcaagccgctcaccgatgaggaacaggcgttcctgcgcgccattcctgaggagttcggcgccgagggtatcgcgcaacacgccgcccatgaggcaaagacccatcatgatgtgaaggccgtggaatactacatcgacgaccagctcgacaaggccgccgacgtgcttggccacgacacccagctgaccggcctgaagactttggtacatttcgcatgcacgtccgaagacatcaacaacctgtccatcgcccgctgcgtgaaaaacggcatcgagaatgtgtggctgccgggcgctcaggccatcgtcgaccatttggctcagaaggctgaggaataccgtgacaaggccatgctgtcgttaacgcacggccagcctgctacaccgaccacgcttggcaaggaactcgcagtgtacgtgtaccgtctgaaccgccagctgaacaaggtcagggctcaggaatatctcggcaagatcaatggcgctaccggcacgttcggcgcgcatttggccgcatgcccggatgtcgattgggtggccgtctcccgcgaattcgtcaccaaccgcatgggtctgacgtggaatccgctcaccactcagatcgaatcgcatgattggcaggccgaactgtatggcaccatcagccacaccaaccgcattctgcacaacctgtgcgtggatgtgtggatgtacatctcccgtggcgtgttcgcccaggttccagtcaagggtgctaccggatcctccaccatgccgcacaaggtcaatccgattcgtttcgaaaacgcggaagccaatctggagatctcctgctcgctgctcgacacgctgtccgcaacgctggtcgaatcccgttggcagcgcgatctgaccgattccaccacgcaacgcaacatcggctccgcgttgggctactccgtgctcgcgctcaacaatctgatgggcggtctgaactccatccatccgaacgacatcgccatcgaagccgagctggactccaactgggaggtgcttggcgagccgatccagaccgccatgcgcgcctgcgaacttgccggcctgccgggcatggacaagccgtacgagaaggtcaaggagcttatgcgcggccatgagatctccaaggaagccgtcgagcagttcatcgatcagcaggcgttcgatgacgctaccacggctcgtctgaaggcgctgactccggcaacatataccggcgtcgccagcaaactggtagatttcgaccgctgaaccgaagctgtcaaataagtaccaaaaccatacgccctgagggtgaccgcgtatttcgtagccaccctcagggcgtattatcgaatgcagtggggcgatatgacccacctgaagccaatctcacgtatggagcaagtcaacagtgtctcactcccctgcagtcaataagcccgccccgcatatcgacgatgtgccgccgaagcgcagtcgtgattttgccgatctgacgcacgcattcttcgccttggtgctcggcataggcgtgattctgttctccgtgtacttgcatggcaccgcgtccggcgtggaatccgacgttcattccgccggccgcgtggtcagctggctgatggatgttccctcggcattattgcagcagcttgccatcgtatgcatcaccgtcagcgtgctcatccagctgcttacttccaaagagtggctgcaaagcgtgatttccgtggtttccctcatattcggattctttgcggtgtggggcatatccgcgctgatcagcaactccggcaataccatgctgatcattccactgcaatccaacagcacatccgtaggcactggactgctccccgatttttatgccgccatggcatcgttcctcaccgtctccggccctcggcgtatccgctcatgcaccaaatggggctggaacgtgctgtatgcagtggcagtgctgatggtcgtgctttcatggaattcactggctggcgtcatcgcatcctacgccataggccgtgttatcggcatgctgatccgtttcgccataggcacgcagaacaatggcgcgtggggatcacaaatcgcgcaatcattgcgttccatcggtattgacacatcattgctcacccgccgagtcgccccctacgtcgattcgggagtattgaaggccacgctggatgacgatctgaccgaaaattcccgtatttacgatgttgtcgactatgacggcaagcaatacaccgtttccgtactcgacaatcaagtgcatgcggccggatatctcaaccaagtatggcagtggcttcgcctgaccggtgtttccatgcgtcgcgaccgttcctcggttgacgccatgcaccatcattacgccatgattctcggcctgtccaatgccggtttggaaactccgcgcgtgtatggtgtggccgattatggagaatcctccattctggtgttccaccgcaaccgcatgccattggaatgcaaccaaaacaccatgtccgaccatgatatggaagcgttcatggaatatctcaccacagcacaccatcatggcttcacccatcgtcgcatcactccggaaaccctgtcccgcatggaaaacgggcatccggtaatcgcaggttggcataatggcgattatggcagttccgctccgaacttcgcactcgacaaagtacagttgctggttcttcttgccacactcaatggcaatgatcgtgcgatcgcctgcgctcgcaggacttggggagacgagcagctgatcgatttggcacccttcatacagaaggctgccattcccgcttccacgcgcgcattgcctggctgggacaagcatgtgcttaccgatttacgtacgcgtatttcggcgctcgctccgcaggatgtcgcggattccatggaaaaagtcacgctttcccggttcagtcttcgctcgttcattgcgattgcgctgctggtggtcgccgtatatgtggtgttcacccagattcagccggccgaaatgatcaaggccgtcagagacgccaatctcgccatggcgttggtttgcgtcgcgcttggctttgtggcgtggcttggttccgctatcaccttgggtgtgttcatggattccgataaacgcaacacgatcggcttgtattgctctcagatggcgtccggtttcactgcggtgtccatgccggccggcgtcggtccagcattcgtcaacctgcagttccttcgtaaaagcggctatcgcagtacggctgcgaccgcggttatgagcgcggtctgggccgtacagggaggcactaccatcgtgttgttgctgacgattggcctattcaccggccgcaacacattgtccggcatgattccgaccaatacgctgatcatggtgatcgccatcgtcgcgttggttgtgtcggccgccatggcgattcctccagtgcgtcatttggtgaccgagaaataccttccagtggtcaaagcatacgcgcgcaacctggtcaatgtgcttgcacggccaaaggaactggcccttggcattgccggcgcactggtgcttaaccttgcgaccggactgggattctgggcagcattgatggcgtttggataccacacgaatcctgcggaaaccaccttcattttcctgcttgccaacactttgggctccgcggttcccactcctggcggtctgggtgccgtggaggccgtgctgtcggtggcgttcactgccgtgggcatcccctcctccatcgcggtttccgctactcttgtctaccgaatcgccttctactggttgcgtattccggtcggtgcgttggccatgaaatggcttgacatgcataatttgatctgacaaacacccccgtacactttgttttccccctgattttcaaaaaagcgaccaaaacccttgtaaaatgccattttcctcataagagtgcgctaatatcatagagaacgtggatgttcgtaatcagaatgtcccctgacccaagaaggatgctttatggcatacaacaagtctgatctcgtctcgaagatcgctcagaagtccaacctgaccaaggcacaggctgaggcagctgtgaacgctttccaggacgtgttcgtcgaggcgatgcagtccggcgaaggcctgaagctgaccggcctgttctccgctgagcgcgtcaagcgcgccgcccgcaccggacgcaacccgcgcaccggcgagaccatcgagattccggcaacctacggcgttcgcatctccgccggctccctgctgaagaaggctgtcaccaagtaagtcatgtactgatatgttgcttacacgacgaaagccccgaccatgacggtcggggctttcgtcgttcatgacacttgtacaagcgtcattctgcgctacactatgcatatatattagacatcgtgtccatatagatggagagagacatgaccgatcaacgcaaggaagtcatcaatcaactgcatgaattgaacattctgctgctgcataccaagctgaaggccacacgcacacagaccgcgctacgagccgccacacgagtatgcaacgtcgaagcggcacgtcgtggcgtgccaccgctgcaacaacttcccaaaagccatgacacggcaacgcacatgcttgactgcctcagcaccgaggatctttccaccctcagcgaacttctgcagcgcatcatcgacaacaccgacaccaggattctcgatgaagaggttgtcgagcgacgcaaagccatccatgaattccttatgctgaatcacacagatacggaggtgcaggaatgagcgacgagcaggagaccattcccgaagcaaatgcccccaaaccaatccgcatcgacaaacgatccctgttcactcccagtgaagccgtggccgtggaacagcattccacaacaccacatgtgtcacgaacccgttatggaaccgcacgcatcgaaggtcgcctctcctcccccaatgcgagagtacccgcagtcatatcgcaacattgcggcggcatcacagtcaaaggccatacgctcaaatcgttcgcttataccaccgacgctgcgatcatccgtaataccaatgccaacgccattctcgccgtctacccgttcactggagaaccggtgatcacacaggcgttgctcactgtggcacaaatgccacttttcgtaggcgtcggaggaggcaccaccaccggtccgcgtgtgaccgagctggccatggtggctgaaatgcaaggtgcggcaggcgtcgtcatcaacgcgccggcacccgcggaaaccatcgaaaccaccatgtccatggtcgacattcccgttatcgcaacagtcacggaagacgacgaaatcaccgaatgcaagattctcgccggtgcggccatcatcaacgtcgcagccggagcacgcaccgcgcaagtcgtggcaagcatacgtgcgcatcatccggaaataccgatcctggcatcgggaggcggatccgaagatcgcatcctcgccaccatcgaagcgggcgcggatgccatcacatggacgccgccaagcgcgcaacagctgcaatcgcagatgatggcgaaatatcgcggcgaagcctgattcaagccaatcaaaaacgaaagcgaccgcagcgcaatcgcaaaacaattcaggagaacataccgatatgggagtggggtgtgaccgaagcctgtcggccacaccccactcccatcgacgtttcccattgccaccatcgcttactccaaagcgccaatcatggcttggaaatcctcattctccctgcattggaacggatccagcagcaccatatccatcttccgcggcgcatgcaacgatagtctggtccaatcgcaggaatactgcgcgccatgcgatttggccgcactgacgaatctgccgcgcaatgcggcacgagtatccgccggcggcatggtacgcgccttttgcgcctcacgaccgtcaatcagcgaacgcaaggcaccacggcgaagcaacgacgcatacaacgcgccattggccacgtcatgatagtccagatccaactgttccagcttgctcagcggaagatccgcactggaacgggcacgtaacgcttcaaacaggcggtacttgcacacccagtccacgctgtctcccaaagcattcgcattgccggaacggaacgcttccaacgtattgcgccactggcgaagcacatcatgcacatcggtgcgaggcaacgacgaagccacttccggatgctcgcccacaaactgttccacagcctgcagatagcgttcctgcatggctacggcaccaccctgcaacgtcgatccatcggccatggcaaacgaagcattcacgccgctcatatcgcgactgaccgcacggtttgcggcaccagcgtccgcgaacgcgaaccgcgagaatcccgactcacgtccttcacgccccgcctgttcgataacgcacagcaccagatgcgtggtggccagcttcatcatcgtggcccattgagaacggtttgaatcgccgatgatcacatgcagccttcggaaggcgtcgggatcggcatgcggctcatccctcgtgttgaccattggacgcgatcttgtggtcgccgatgaaacagcctcatccagaaaatcggcacgctgcgtgatctggaaacccgattccgtcaccctgcctgcgccagtgaacagctgcctggtaatcaggaacggcagcaattcgtgttcgatgacgtccaacggcacaaaacgacgtaccagatagttttcatggcagccgaaggaatgccctgcggaatccacattgtttttgaacacatgcactgtggcacgtggcccatgcgtggctcgaagcctttgctgggcgtccaacgcaagatcgcgcatcaccagttcgccggccgcatccacggcaagggcgtccatgggatcgcaggcctcggacgtggcatattcaggatgcgatccgacatcaagatacagtcgcgacccgttttcaatatacgtattggtcgatcgcgcggaggcaacgatcggctggaacatcatcattgccgtctggctggcgtcgcatggcacatccgcaccggtcacactgacgccgtattccgtttcaatgccgaaaatacgagcgaaagaatgaacctcacgcaacgttcccgcatcaagcggtgacgaggaatgattgccgctgtctcgcagctgcggcatcactcgccgcctttttgcacgaaactaccgacatattcctcagcattggactcgagcaccgattcgatatcgtcaagcacggcatccaacgcatcagcggttccgtcgacttgtacgccggcggattcgacaatgtcacccacctcttggcctgcggatgcggattgagcctgttcaaattcctgaggcatgacattcctccctgtaacttccggttgcaaacctgcaaaaaaacgctgcgccacaccttatatcaggtgtggcgcagcatgcaacactatgccaaatactggctcagatcattggtgatcagaccattggtggccatcacatcgttctcctggcgccagtgaacgctttcgccattccactgggtcagatggccttgcgcctcccaaatcaccacagcaccagcagacacggcaggtacgtcccactcatgcaagtgcggttcgaaatacgcatcgtacgtaccgtcggccaccttgcacaaatcaagggacgccgggccgacacgtttaatatcggcaggacgtccggcaatcttcgccaccacatcgagcgcacgctgcgattcggacgataccggagacatgccgaaactcaccaccgaaccatcgagggacgacgtggtggaaggaatgattttctcgcgtttgtctcccaacggagtcttgcgaatacgaatcgcgccggatccacgcaccgcaagatacgtcaatcccagcgccggagcgtgcacaatcgaaaggatcggctgtgcggagcactggtcgttgaattcgaacaatgtcacggtgatggcccattccggcatgcttcgcgcgaaattgatcacgccgtcgatgccacccacacaccagtatcgctggccgggatagcactgttcagggcgaagctgccagaagccgtcgaacacgttgacataggtcaggcggttgctgatgaactgctgcaggcgcttgtcggtgtctgaagtgaagtggaagcagtcttcggacacttccagttttctcatgtcgtgcggattcatctggtcgttcaacgcatgcttgcctgcgtcctgcaggatgcgtgcgacttcgagggcgatttgcctcagttccatagatatgccttttcgtttcctctgtacagtcccggcacgtcctctcctcaaaataccgggatgatgttacctgttgtcaatggtcgttcttcgcgaccaattgatggcaatgttacccgcacagattgcatttcaccgtaacatttccaaaatcgacgccgcatcttggacacgctcacaatagcgggaacattgagatttgctatatttcagagggtctgacatatccaatgagaccatcggattctccacggtattatcaccaatcgttcgatggcgcaccgtaagatgcgaccacgatgcggccacaacctgttctggaaaacgacgaatcatttcggcacgcaaccaagcacgggtatcggaaggcgcttccaccgaagcctgcaccaactgcccgtccgtaaacagccgctccgtttgggcacgcaaccgatcgaaaatcgagtcagcgggatcaatcgcagcccactttaaatcgacggccgcaatacgcgcatcatcccaaccggagccaattttacgacgcagcttctccaacaactgccatttcaatagccattcaatgcggccagcttgctcgcgcatcgtcaaacgcgcatcatcatcggcatgcctgatggcagccacatcggcgagcgcctgcccccacatcgccatgatgttacgggtcgaacggtcagaccatgccggttcaccggacgtgtcggttccatagatcacggcagcggcagcatacaccaggccacgcagggtgacctcaatctgccatgccgaggtctcgccgccatattccagcggcaacatggcacctaatgtcaaatcatgagacacctcgtgcatggcgctcaccggatcggcgagcatgattggctccaacgcttcgtctatgttcaatcccgcctcttcggcatgctcaagcagccacagcagcatgctggtggtgccgagtttcagcgcctgcggcacatccatacgattggcgtccccgacaatcacatgcaatcgacggtatgcatccgtgctgtgcgattcgtctcgagtattgatgatcggcctgtcgaatgtggtctgcaaaccgactttcatatgaaaatagtcggcgcgctggctgagctggtatccggcggtttcacttcgttcgccgataccgacgcgacctgatccggtaaaaatctgtctcgctacaaaatgtgccgtcatgagtttcgcaacttggtcaaacggcaccgaacgcagcatcatataattttcgtgggtgccccagcttgcacctttgccgtcgacattattacggtgcagcgcgattgcgataccggtctgttcgctggctttgcgcgcgcactcacgcatgatgagatcgccggcatggtcgtagagcacggcatcgaagggatcatcggtttcgggcgcggaatattcaggatgcgcatgatccacatacacacggccgccattgactgcaatcacattggtgatgttgagctgcggcgcgtccgtcaacagatcaggatgcgcggatgcacgttccagcctggtgccacgggcgtcgttgaccggatcctcctgccgatagtcccagcgaatatgcttggtttgttcgttcgccgcggcaccgaccacatcgaacgatagcttcaccggattgtaatgctccattccgagagcggaaaccgcgtattccgtttccgtgcccatgattcgacgaacgctcattgatacgacttcccttcgtctgatttcgcgttgcctgccagcattattcgactggtcgtatacgggtgatgcgccctgcttccaaaccattgatacggctccactgttccggattggcgtccaacaccgcatcgcgggtttcaagaaactcctcgtcgacggccttcgccaacagatcgacgccaatcgccgccggctgtccgctttcgatggagattttcacagcacgggttttggcacgatccacaatgtttttcagcaccgcacccgacaccacatccgccagatagatcggatgccattgcccatgctcatcgcacacgtcgcacagataccggtgctcgtccgtcgaatagatatcgctgaccagcaccccaatcaaagccttcgcatccacccctggcaccaacggcaaatcgtcggtcagataatggcggatgatctgcgccgcctgagccgctttcggacgctccacacgaatcttcacatccaaacgaccaggacgcaacaccgccggatcaatcatgtcaatacggttcgaagcgccgatgaccataacattgccaagcgtttccacgccatcaagttcagccaaaaactgcggcacaatagtggtttccacatccgacgacacgccggatccacgagtgcgcagcagcgagtccatctcgtcaatgaacacgatcaccggtttgccatccgccgcacgctcacgcgcgcgcttgaaaatcatgcggatcaggcgttccgactcgcccacgaacttgttgagcagttccggccccttcaccgacaggaacacgccacgaccgccggcagcgccttcggcgagcgcattggccacagccttggcgatcagcgtctttccattgcctggaggcccatacagcagcacgcctttcggcggcttcaaatcataacgttcgaacagttcgcgatgcaggaacggcatttgcacggcatcgcgaatacgttcgatctgctcatccaaaccgccgatatcagcgaacgtgacatccggcacttcctcaagcaccaagtcggcatcatcctgcgcgggaaccaacgcaagcgcgaatctcatggacgaatcgaccgtaacacggtcggacacattgatcgaagttttcgacagcgctcccgaacggcggaccaacgcaacgtttccaccgccatccgcgaccagcaatcgcccatcatcaatgacctgcttcaccgtgcgcactgcgcccacagcatcagtgccggcttgcgaaaccaccaccatattctcgttgagcagcaccgtgcgcccagcctcaagcctggatgcctgcacattcgccgcaaccggcacgatcatgcgacggcttccggaaatcacctcggcgctggcatgctgtaccccctgttcgtccgtgcgagaggaatgcacgcgaaccatggtggcgaaggtcatgggcggtcccgccaactggttcagctgggccttggccttggtgagctcctgggtggcacggctcaacgccttggccaacgcatgattcttggccatcaactggtcgttggcctcacccaacgacgccaacgtctcatcacgttgatccatttcatcagcctcgctttccaccgaatgcgtttcgagccgttccgtcatttcgtcatgtcatggcgcattcgcattcaacatgctcaacccttaagaatacccattgtcctcatgatttccgacaatcaaaaccatgcttgaacaagaatcgccgaacattgcgcccactcccaccctttcccagcctggactgctggtgatggatgtggattccacgctgatcgatgaggaagtcatcgatcagctgggcgccgccgctggaattggcgaacagatcgcgtcgattaccgcacgtgcgatgaatggcgaacttgattttcgcgaggcgttgcaggctcgtgttgcgctgcttaaggatctgccgacttcggtgttcgatgatgtgtatcgtcgcgtgcatttcacacagggggcgcttgatttgattgacgctttgcatgcgcatggttggaaggtcggcgtggtttccggcggtttccatgaagtcgtggaccgtcttgccgccgacgcgcatcttgatttttggattgcgaatcgtttggaagccgctgatggttgtttaaccggccatgtgcttggcgatatcgttacgaaagatgtgaaattgcagtcactgcgtgattgggcttcacgcatgggcatcagcatgggtcagactgttgcggttggcgatggagccaatgatctgccgatgattcatgccgccgggcttggcgtggcgttctgcgccaagcctgcggttcaggcggatgctccgcatcgtgtgaacgaacgtgatttgacccggattcttgattttcttcgttgattcgcattcttcgatgatgcgaatcccgatagatccgagtcgcgatatagcaaaatccgatattgcaggataacgatattgccgtgtgaaatgatgatgttcacacggcaatatcgttatgatccgtttattcgacactacttgcagtaggctccgtcgagatgcgcgccacgcgcccaatcggcggcacgcatggcttttttgccttgggctttgacttccagcaattccaaaggatctgaggaagtacccacccacacgttcttttttccggccacgatccgccctggttctagcgaaacgggtgtgttgggattgctcatatcggcgccctgcgcacgcaacacatgcaacgtggccggttctgcttcggcattggcgtgcagttcgcaccatgcgcccggattgggcgtgcaggctcgaatctgacgatccaccgcgaatacaggaatgtcgaaacgaatatgcgcgtcttcaaccgtgatcttctgagccacctcatatgcgccggcaggctgttccacaggcgcgatctgatcgtcggccatggcctgcagcgaggcggcaagcaaacgggaaccatcctcggcaagacggttcagcagctcacccgccgtttcatgcgctccgatttccacagtggactgcgccagaatcggaccggcatccatggctcgcacgatgcggaacaccgtggctccggtcaccttctcgcccgcccaaatggaacgctgcacgggagccgcgccacgccactgcggaagcagcgagaagtgcaggttgtaccatcccatcggcagcgcgtcgagcacatcctgcttcaggattttgccatatgccaccactgccgcggcctgggcaccggtcgcagcaagttcggaaatgaacgtttcctcgctcggatcggattcaatcaccggcaaaccaagatcaagagcggcctgcttcacgggattcggtaccagtttgcgtccacgcccggtaggagcatccggtcgggtgagcactgcgaccacttcgaaacgctcggtatcttcagccagcattttcaacgacggcaccgcaacatccggagtaccggcaaacagcactttcagcacgaaaagtcctccttatcaaatcctcatcacatcgttatcatcgtgggaatcattccggccgcatcaacagcatgtaaggcagcggaacgcaacacactatgcctgatgcaccgcgggaatcttcacacccgcatcaatcagcagcgcacgcaacgcacgtgaatccttgaatcgaacgccacgaatgcccgcattgttcgcacctacgatattcatggccttatcgtccacgaacaccgcgccggaagcgtcaatgccgaactgttgcaacgcgaactcgtaaatatccttattcggcttacgcagggagacatatccggaaaccacacgatcgtcgaggctgcgcagaatatcgaaattgtcgagcgcgatcgggaacagatccttctgccagttgctcaatccccacacatgcacgccggccgctttcaaatcgttgatgagcacgcgggcgcccggcaccacgccggtcaacgagtcgacgaaattgtcgagatagtactgcagcatgtcggcccatttgtctccataacgttcacgcatcagggcgacgccgtcatcattcgacatgccgcagtccagttcatcgttgatgtcgtagaagccggaaatatcgttgtcaaggaactgttcaacaagctcgtcgctatagcggggcgtcatcacggccaccggatcccagtagacgagcacgttgccgaaatcgaaaatcacatcggtgatcggcttgcccgcattcaccgcagcttcgccgtcagccatgagcacgtcgtactccatatcaggctctccaggccaacccttcatatgatcctccattcactgctgtgcggcctcatgccgaactgccaacctgtctagtttttcacggcgaggggacgtgcgtcagattcgctccttcggatcaagctgaaaacgcagttctcccggttcacgcgcggccacatggcgggcactggcggaacgcaaacgcaacgccaactcacctcggcgactttgcggcacacgcaccaccgccttgacacgatccgcagtgccttccaattcgcgcgaatcaatggttcgaggctgcggaataggtaccggccccaatacggacggcagcatgccttcggtggtttcgatggcggacaggtcacccccacccaacgcgccgatacgttccagcgtgaccttcaccgcgtcacgacgtccccatacgcatgcggcggcaaacacaggcggcaatgcggtttgttcacgttcccgcaattcggtttgcgccagcaacgttgaattccaaagcatcaacgattgagcgagcgtgggatcggtttcgccgatcaacagggcctgacctcccctgattcgcggcgcgcacagcgaaaccgcgcgcatccacgacgtcaacgtgtctacgcccgcgtcaatgccgaaggcgtacaagctggtccatgcgtcgagaatggccacggcccggtattcgcattccgaggggttcctcccacgcacacggggttctgcgccgggagtggcgatgaccaactgcggcgcaaacccgatatcgggaacaatgccgcgtggctggctcggcgttgaaagcacaatgggcacgccacgaaacagtcggctcagctcctgcgcagttccggcggcacccacacgaaccacgcgcatacgttcgttatggcatgccgggcaagcccattgcacagtggcgacaccgcaccaacgacaacgcaccgacccatcccgtaaccgttccaatggacccgtgcagtacgagcagcgagcctgacggtggcatttcgcgcagctcaatgcttcaccgatgccatcctgcggaatgctcaacagcaccggaccgctttccaacgccttcgacagcactcgcaccgcagtgtgcggcacacgcgctccgatggtcgaatccgcaagtcttgccaattcgtcacggttcagccaacgaatccaaggactcgcttccttggttacggcagggaatgcgtgaatcggcgtactgaaaccgctgacctgggtggcaccgacatgcgccgcatcggtttcccactggctttgcacactgcgcgcattggccatcgcgacgaacacgccattatgcgcttttgcacgtaaccgcaacactccgcgggcgttggcgtaaggcatcatgccatcggcatcctgatagcacacgtcatcgagaatgaggaacaacgcattgccatccaccggcgcatacatcgccgcccgtgtgccgatcacgcaccgcacctgccctccactgatggccagatacgcacgataccgttcagcaggcgccatctgcgcgttcagaatggcgaaatcgccgccgtacgcaccattggatgattgggttggcgcgaaacagcgcaagccgatcgactgcaacgtttcggccatgtcctcaatctcacgcatggtcggcaacaccagtaccgccggtttgccctgcaataaggccgcggccaccatccaggccacgcactgcctccaatgatgggatcccggcaatgggtcaagcacgaacgcttggaaacgttgcccttccaatgccgtacgaagcaggtcgatattaccgtattgccgctgcagctgctcgtacgattcccgctcgatcttggcaagcgattcgatacgtccgtttttttcaatacccgttcgattgccgatacgttgttcctgttcgacgcgagccacgcgcggaggcaccgccaaacgcaggatattggctcgcgttccgccgaatgcgtccgcgataagtgtggcatcgttgcgcatggattccgacacaagcacacgatcgatgaccacccgttcgatgaaccgcaatgacgattcaggggtttcgctggtatcggtccgtttccaaatgatgccgttgacccgttgcccgccgaagcggacacgcaccattacgccgggctgggcggcttcggaatacttctcctcaacgtaatagtcgaaggtttgccccaaatggatggcctgaatatccagcaccacttgggctatgggatgctccgcagccggcgttttaaccgcgggcgcacgcttgcgccgcttgcgcggggcgagcccgtcaagcgccagctgctcggcatcctcagtactcatgattcaagggtaactcagccttcgatggcggctttcagctcgtcgaccttattggtggtctcccaggtaaaatcagcatcgttgcgtccgaaatgaccgtaagcagcggtcttggaatagatcggacgcttcagatcaagctcgtcgataatggcggccggtcgaaggtcgaacaccttgcgcacagcctgctggatctgctcgcgagtcacaccattttcggtgccgtacgtttccacattgatggacaccggatcggccacgccgatggcatacgccacctgcacctcaaccttgtgggccagacctgccgccacaatgttcttggccacccaacgcgccgcataggcagcggaacgatccaccttgctcggatccttgccggagaacgcgccaccgccatgatgagccgcaccgccatacgtgtcgacgatgatcttgcgaccggtcagaccggcatcggcagccggaccgcccaacacaaacgaaccggtcggattgacaagcacgcgatattcatcatgcgccacacgatcggcaagcacatcatcaagcacaggacgaatcacatgttccgtcaactgctccttaagccacgcctgatcgacttgaggatcatgctgcgtggacaccaacaccgtgtcaagacgaacgggagcatcatgcccatcatattcaatggtcacctgggttttgccatcgggacgcagatgaggcacttcgccattcttacgaacctcagtaagacggtaagccaagcgatgagccaaataaatcggcaatggcatcagcacatcggtctcgtcgcacgcatagccgaacatcacgccctgatcgccggcgccctgagcctcataacgctgctcgcgagatgccttcgactccgcttcgccactcaaacgagccacaccctggttaatctcagagctctgctcggtcaacgaaacggtcacgccgcatgaatccgcatcaagaccaacgcgagaactggtatagccgatattgcgcaccacagaacgcacaatgctctgaatatcggaatagccttcactcgtcacttcgccgaacacgaagaactggccaaccgtggcgcatgtctccacggccacgtgggactgcggatcctgagcaagcatatcgtcaagaatcgcgtcggaaatctgatcgcagaccttgtccggatgcccctccgtcactgactcagcggaaatcaacttcaattcagccatctggctgctcctttcacgaacgccccacacgttcgcccttctgattgctacgaaaaaaacgccccgtccttcgcatacgcaatcaatagcttcactatggactattcaaagcgcaccgctcaggtatcggggcgaatgaaaacttggaatccggttcttatcgcaagaaccgttacatcagttgccttcggtcagatcgtcttcgccgagggtctcttcaagcagaccatcattgatctcacggaaagcgatggatagcggcttttcctgattctgatactccaccagcggaccgacgttctgcagcaggccctcgttgagctgggtgaaataggaattgatctggcgagcacgcttggctgcgaaaatagcaagagcgtacttggagtccgcatgctccatcaagtcatcgatcggcggttccgcaagaccggtcggggttggctgagtgccgaatgccatattgattatctcccaatcatcagataagccaaaagcttcttttccaaagtcttaagtatagggccgccactggacctgattcaagccctttctctcatgttttcggcaagcgcaagcatcttcggcaatgctcgcgaatataacgcttctgggaattccacatagtgactcttgacaaaaccgtgtcccgcttaaccaccacaatagagaacatggaaatgcgatctgcaaaactgatgaatggacgagtattcgcgggcgcacgcgccctctaccgtgccgctggcgtggacggtaaggatttcggcaagccgatcatcgccattgccaattccttcgatgagttcctgcccggccacgtgcacctgaacaaggttggtcgactgatctccgaggccatcaaggaagctggcggcattccgcgtgagttcaacacgatggccgttgacgacggcatcgccatgggacacaccggcatgctgtactccctgccgagccgtgacatcatcgccgacaccgtggaatatcaggtgaacgcgcactgtgccgacgccctgatctgcatcccgaactgtgacaaggtcgtgccgggcatgctgatggccgctctgcgtctgaacatcccgaccgtcttcgtctccggcggtccgatggaggccggcaccacggtacttcccgacggaaccgtgaagaagaacaccgatctgatcgacgtgatgtatgcctccgccgacgacaatctgaacgaagaggatctgctcgcctatgagaagaccgtctgcccgacctgtggttcctgcgccggcatgttcaccgcgaattcgatgaactgcttgaccgaggccatcggcctggccctgccaggcaatggcaccattctggcttcgcactcctaccgcaaggatttgttcaagcgcgccgccgagcagatcgtcaagatcgccaagcagtattacgacgatgatgacgagactgtgctcccgcgttccatcgccaccaaggaagcgttcgagaacgccatgaccatggatgtggccatgggtggctccaccaatacagtgctgcatatcctcgccatggcgcagtccgccgacgtggacttcacgcttgacgacatcgagcgcatctcccacaccgtgccctgcatctgcaaggcttcgccgtccggcgaatgggagatctccgacgtgcatcgcgccggtggcatcactggcattctcggcgagctcgaccgtgccggcaagctgcaccgcgacgtgcattccatcgattacaagacgcttgaggacaaactcaacgactgggacatcatgcgtgatacctgcaccgaggaagccaagcagatgtatctggcggccccgggtcacatcgtgtcccctgatccgtggacgcataccacgctgttcgactccctcgaccgcgaccgtgtgaacggcgcgattcacgacatcgatcatccggccgtcaccgaaggcggtctggccgtgctgcgtggcaacctcgcccctgacggctgcgtggtgaagaccgccggtgtgccgaaggagatttggaccttccgtggaccggcactggtcgtcgaatcccaggaacaggccatcgaggtcatcctcaacgacactctgaagcccggtatggcgctggtcatccgttacgagggcccgaagggcggccctggcatgcaggagatgctgtacccaacgtcgttcgtcaagggcaagggtatcggcaagcaggtcgccatgctgaccgacggccgctattccggcggctcctccggtctggccatcggccatatcgctcccgaggcggcaaacaagggcccgattgccctgatcaagaacggcgacatcattaacattgatatcccgaaccgtacggtgaacgtcgagctttccgacgaagagctggcccagcgccgcaccgaactcgaagccggcgacggctatgtggcgcaccgcgaccgcaaggtctcccaggcgctgaaggcctacgcggcgttcgcccgttccgcagacaagggtgccacgcgcgatccggagctgatcaacaagctttccggtctcgcctgatcctagcgaatattaaataacatgatgaggattgtgcagttaatatgctgcgcaatcctcatttttatttcatacttggcttcttttatataaaaatatgcgcccgatatgttcgagcgcatattgcaatccttgtaattattatgattacaaatcgaattccgttgcgataaggttccacagttcatctgctgcctcatccacaacattattgacgatgactttgtcgaattccgattccgcggcaagctcgatttttgcggtttccaatcgtttcgcctgctgttccggagtttcagtgccgcgcccgatcaagcgtcgttccagttcttcaaatgacggcggcgcgatgaacacggtcattacctcgatacccaactcccccgcacgctgcttgacactgcgagcaccttgaatatcgatttccagaatgactggaatatttcgctcaagatgttccacgacaggtttcacgggagtgccgtaatgtgcgagaccaaacacgtcggcggtttccaagaactcaccggcagcttccttgtcgagaaactcctgttcgggcatgaagaaatagttcacgccatccacttcacctggacgaggctgtcgtgtggttgcggataccgacagccagacttccggatgctgctcgcgcacgcgcccgagaacagtgcctttgcctacacctgccggtccgcaaaggacgattaaacggccatgctgggagtcggtcattgcttcctcactctgtattagttgctgaagatatttacaagaaggaattattgttgacaaatcgatgatgatttactcgtcttcttcatcatccaaaatctcatcatcgacttcgttctgggcctcgatgagcgcttgacgaatatcgagcgccacggattccgtagccgcggccaaactggaaatatccggaccatgcgtggcgatgaagcgagacacggtgacgagcacattgcccttggtgcctttgaacaccgtcttgaggtcgcgggtttcagcaccctgccatccgtagcccggagacagaataggaccagtgaacttggctggatcgacaccggaatcattgatccactgaccgatggtggcaccgatgatcaagcctacggaacccataccgtcattgcccttattgaacttctgagccgtgctggcaatgccgtacgccactgttctgcccttgtactcgcctgcctgacgaatggcggtctgcaggctggcgccctcttggttcgaggtcagcgatgcaatgaatacgcctcgaccgttgttcagggcatcgttaatgacaccgcccaacgagcgtgcgccataatatggcagcaaagtgatggcgtcggcaagcaacggagacctcggcttgaaatagacatcggcgaatgcggacaccgtagtcggcaagcctccatgcaggcagtcaacgatggtgatgatacccatttgacgggctgcgtacagtacccgctcgagcgctgcgatacctttcgaaccgtagcgctcgaacatggagaactggaatttgacagctgccgctcgcccattggctgcctgcagcatacgcatggagtatagttcggcacccaatgcgtctacgttgtagccccagtcagtaagaagctgcctgtgtggatcgattcccacgcatagcggaccatattgggccatggaattgctcagtcgcagaccgaagtccgaacgctgggcactcatttcttcactgctgaggctgctcatcattactcacggctttccaactcgaatagctgctgggaatgatcctgaatgctcatgatctgataatcattattacgcacggcctcgatggccatcaatacggcggagaattccgtcatggtggtgaactgaggcaaatccgcggcaatagcggccgaacggatggcgtaaccgtcggaacgggagccacgagaattcggcgtgttgagaatcagatcaatggcaccctcttcgatcagctgaacgacgttcttgccgacgctgccctccgcatggtaggtggtgatcggatcgtccggattggaatccatacgcacgctgatcttgtcgacgatcttggactcgatgccgtaacgacgaagcacggatgcggtgccttcggtggcccagatgttgaatccaagctccaccagtcgcgcagcgaacaacggcagctgacgcttgtcggtatcgttcacggagatgaacacgttgccgctggtcggcagaccgccatcgtaggcggccagctggctcttggcgaacgcatgcgggaagtcacggtcgaagcccatgacttcgccggtggaacgcatttccggtccgagcagcacgtctacggtcttgccgagcggcgtacggaagcgcttgaacggaagcacggattccttgacggcaacctgctggccgcggcgaatgtcaccaccgtctccatgaggcagcagcaagccgttatcgcgctgctgctggatggtttcgccggccataatgcgggccgcggccttggccagtgccacaccggtcgccttggatgcgaacggcacggtacgggaggcacgcgggttcgcctcgataacgtacagggtgttggccatgaaggcgtactgcacgttgatcaggccttgcacgccacagcccttggcgatggcataggtgccttcgcgcagacggcggatctggtcatcggaaagggtgctcggcggcagagtgcatgcggcgtcaccggaatgcacgccagcttcctcaacatgttccataatgccgccgatatacagctcttcgccatcgaacaaggcgtcgacgtcgatttccacggcatcctgcaggaacttgtcgatcagcaacggagaaggcagacggccagaaaccacggtatcggcctgagcttccttcaatgcgcgatccacatacttgcacagctgggcgtcgtcgtacacgatttccatgccgcgaccgccaagcacgtagctcgggcgcaccagcaccggataaccgatgttatgagccgcctcacgggcttcgtcaaggctcagagcggtgccatagcgaggcgcgttcatctcggccttcttcagcacttcgccgaagagctcacggttttcagccagatcgatggattcaggcgtggtaccgagaatcggaacaccggcagccttcagacgagccgccagagacagcggggtctggccaccgagctgaacgataacgcccttgaccggacccatcttcttttcggcctcgtagatttcgagtacgtcttcgaaggtaagcggctcgaagtacagacgatcggacatgtcgtaatcggtggacacggtttccgggttgcagttgaccatgatggtgtcatagtccttgcccagctcctgcacggcatgtacgcaggtgtagtcgaactcgatgccctggccgatacggttcggaccggagccgagaatgatcacggcttcacgctcacgcggacgcagttcactttcgtccgcatagcaggagtaatagtacggcgtgaccgcgtcgaattcggcagcgcaggtatcgaccgtcttgaaaaccggacgaagatcatacgaccaacgcagttcgcggatcgtgttttcgccttcgtcgcccaagtggcgcaggtgtgcgatctgaaggtcggaaagacctgccagcttcgccttctttagcagcttgcggctcagcttgctcgcttccttgatttcaagggcggtctcgttgatgagtacaaactggcggatgaaccacgggtcgatcttggtggcatcgaagatctgctgttcggtggcgcctccccacagggcgcgctggatctgcagataacgatgctcggtcggcaccttgatggcttccaacagctgctcgacttcctgtacgtcaggcttgtcgccgtcccagttgaagcccatatgacgcttgtcaatggaacgcatggccttgccgagggattcctggaagttgcctgccagagccatggcctcgcccacggacttcatggaagtggtcagcgtcggatcggcacccgggaacttttcgaaggcgaaacgcgggaccttggtgaccacgtagtcgatggtcggctcgaagctggccggagtggactgcgtgatatcgttctggatttcgtcgagcgtgtagccaagagccagcttggtggcgatcttcgcaatcgggaagccggtcgccttggatgccagagcggaggaacgggacacacgcgggttcatttcgatgacgatgatgcgtccggtgttcgggttgatggcgaactggatgttgcagccgccggtatcgacgcccacgccacgaatgatggcgatgccgatgtcacgaagcttctgatactcgcgatcggtcagagtgaacacaggcgccacggtaatggaatcgccggtgtgcacgccgacaggatccacgttctcaatcgggcagacgaccacgacattgtctttcttgtcgcgcatcagctcgagttcgtattccttccagccttcgatgccttcttcgatcagcacctcgtcggttggggaataatggatgcctgcgcctgcgatgcggtgcagttcctcttcgtcgtgcgcgatgccggaaccaaggccacccatggtgaagcttgggcgcacgaccagcggataaccgaacttttcggcgatcttgtcgacttcttcaatggagtgtgcgatgtcggaacgtgcggattctgcaccagcttcctcaacgacctttttgaagagctcacgatcctcgccgcgatcgatggcttccagagaagcaccgatcagctcgacgttgtacttcttgagcacaccggcctcacccaacgccatggccgcgttcagcgcggtctggccacccaaggtcggcagcagcgcgtcaggacgttccttggcgatgatctgctcgagaatcggcgtggaaatcggctcgatgtaggtggcatccgccatttccggatcggtcatgatggtggccgggttggagttgacgagaatgactcggatgccttcctcacgcaacacgcggcaggcctgagtgcccgagtaatcgaattctgcggcctggccgatcacaatcggaccggagccgatgaccatcacggacttgatgtctgtgcgcttaggcattgtgggttccctccttggcggaacgcatgagatccacgaaacgatcgaacaggtatgcggcatcgtgcgggccggctgcggcctccggatggtattgcacggagaatgccggaatatcaacgcactgcaggccttcaaccacgttgtcattcagatcgatgtggctgacgaacaccttgccgtacttgccgttttcaaacggcgcgtcaacggtttcgccgatcggcgcgtcaacggcaaagccgtggttgtgcgcggtgatttcgattttgccggtggtcatgtctttgaccggctgattgatgccgcggtgaccgaacttcagcttatatgtgccgaagccgagcgcacggccgagcagctggttgccgaagcagatgccgaagaacggatgacctgcgtcaagtacctggcgaagcaggttcacttcaggatcggcctgttccggatctcccggaccgttggagaagaagacaccgtcaggattgagggcttcaagctcatcgaacgtgatggtggatggcaccacatgtacacggcagccacgctcggccatacgatgcggagtcatggccttgatgccgagatcgaccgcggcgacggtgaacagcggttccttgccttcgaattcaccacacggctcgatggtataggcttctttggtgctgacttcgtcgtagaggctcatccccttcatctgcggagtggacttgacctcgtcaagcatggattcgatggtacgcagcttgccattggcgtcaagcagagcatcaccggagaaaatacctgcacgcatcacgcctgcggaacgcaggtggcgtacaagcttgcgagtgtcgattcggctgatgccaacgatgtgattggattccaaatcgtcatcgaggctgccggtggcacgccaattgctcacattcgggctgggatcgcgcacaacataaccggcaacccagattcgtgaggattctggatcctccccattgattcccgtgtccccaatgtgtgggaacgtctgcaccacgatctgacgatcgtagctggggtccgtaagcgtttcctgatatccggtcataccggttgcgaaaacgatctccccgctggtcgtgccgatcgcgccgtaaggttcacccacatacacctgcccgtcttcgagaacgagaacggcatcttgagggtcaaacatcacggcttcggaatcatactggttcaccaaaacccccttatagtcaaggtattcgtaccaaggatagcggccggttaggactcgcgacccggccgaatcgcttaactttcagctttattcagctgaaggttcggtcggttgctcatccacttgagcggcatccgcatcagcgcttaccgcgctgagcagaccgtggatgaatgccggtgattcgtcatcacacaacgtcttggcaaggccaagcgcctcgtcgatggccaccatattgggaacatcatcattgaacatgatctcccatgcggcgatacgcagaatattgcgatcgacaacgcccatacgcttgaccttccaaccggtggaatgctcgtcaagcgtggaatcgatggctgcgatatgttccgcaacgccacgaacgatttcgatggcgtattcaggcagcggagtctgggcgccgggctgctcaatgcgctcagcaagaagggacaggatgtcctgtcccttctcatccgcttcatacaacgtattcagagccctcttacgagcggtggaacgtgccatgaaacttctttcgtccttactctcagttctcgcggccgaggtaggagccgtcggtggtgttcaccttgaccttctcaccttcgccgatgaacagcggaacctgaatctcggcaccggtctcaacggtggccggcttggtaccggcgttggaacggttgccctgcagacccggttcggtatgggtaacggtcaggatcacggaagccggcagttcgacggacagcggggtgccgtcgtggaaggacacgacgcagtcggttccttccagcaggaacttggcctgatcgccgacgagagtcttcggaatgtagatctgatcgtaggtggtcatatccatgaacacgaagttgtcgccgtcctcgtaggagtactggaggttgcggttgtcgacggtttcgaattccatcttcatgccggcattgaaggtcttgtcaacgatcttgcccgagaggacgttcttgatggtggtgcgcacgaaagcggggcccttgcccggcttgacgtgctggaacttgatgacggcccacagctggccatcgaggttcaggacggaaccgttcttgatgtcattggtagtctgtgccaaattaactcacctatttcttcgtctaacagggaaagcttaaaagagccttgctcattatgccacggtgtgcatactttgtcggtaagccttccatatataggaaaacctccctcggcgaacatgcctcgggaggttttcctaaaaaacgctagttcaagcgtgccttgatatcaagcagaaactactcgatgatcttggtgacacggcccgagccgacggtgtggccgccttcgcgcactgcgaaggtcaggccctcctccatagcgatcggctggatcagctcaacgccgaaggtagcgtgatcgcccggctgcaccatctcaacgccttccggcagggtgataacgccggtgacgtcggtggtacggaagtagaactgcggacggtagttggagaagaacggcgagtgacggccgccttcgtccttggtcagcacgtagacttcgccctcgaacttggtgtgcggggtcacggagcccggagcagccagaacctggccacgctcgacctggtcacggttgatgccgcggagcagcagaccggtgttgtcgccagcctcgcactcatccatctgcttgtggaaggtctcgatggaggtgacggtggtggtctgggtcggacggataccaacgatctcgacgttggagttgaccgggagcttaccacgctcgacacggccggtaaccacggtgccacggccggagatggtgaagacatcttcgatcggcatcaggaacggcttgtccagatcgtgagtcggggtcgggatgtactcgtcgacagccttcatgagttccttgacggactcaacccacttctcgtgatccggagcgtcgtcgtgcagcgcgccgtaagcggaggtgtggatgaccgggcaatcgcgatcgaagccgttttcgtcgaggaggtcacggacctcttcctcaacgagctcgatgagctcttcgtcgtcgaccatatcgcacttgttcagagcgacgaggatacgcggcacgcccacctgacgagcgagcagcacgtgctcgcgggtctgagccatcgggccgtcggtggcggccacaacgaggatagcgccatccatctgggcagcgccagtgatcatgttcttcacgaagtcggcgtggcccgggcagtcgacgtgagcgtagtgacgctcagcggtctggtactcgatgtgggcgatgttgatggtgataccacgctgctgctcttccggagcggcgtcgatctggttgaagtcgtaagccgggttgatgtccgggtactcttcgtgcaggaccttggagatggctgcggtcagggtagtcttaccgtgatcgacgtggccgatggtaccaatgttaacgtgcggcttagtacgctcgtacttttcctttgccatgtgttttgtcctcctggacgtctcgtagtaagccttgaactcacttcaaggcactcgctacattttactgggtttgacgggtttgtgccactttggagcccgaacccagtcagcgctacaaaatactagcgctgactggagacagtttccacttaagcggcagcgcgtgtcactcgccgcgctgggccttgatgatctcctcggagacgttcttcggaacctcagcgtaggagtccatctgcatggtgaacattgcgcggccctgggtcttggagcgaaggtcgccgatgtagccgaacatttcggacagcggaaccttggcgtcgatgaccttgacaccggtggagtcggtcatggactggatggaaccacgacgggcgttgatatcgcccatcacgtcgcccatgtactcttccggagtacgcacttccacggccatgatcggctcgaggatgaccggcttggccttcggagcagcttccttgaagcacatggaacctgcgatcttgaaggccatttcggaggaatcgacgtcgtggacctggccgtccgtgacggtagccttgacgccaaccaccgggaagccggcgagcacgccggattccatggcttcctgcacaccagcatcgatggaaggaatgaattccttggtgatgtggccaccggtgacctcgttgacgaactcgtaggtctcgccctcttcggtgttgagcggctcgaagttcatcaagacctttgcgaactggccggaaccaccggtctgcttcttgtgcgtgtattcctggttcatgacggccttgcggatcgtctcacggtatgcaacctgcgggttacccacgttgcactccaccttgaattcacgacgcatacggtcgacgatgatgtcgagctgcagctcgcccatgccggagatcagggtctggccggactcttcgtcggtcttcacctggaaggtcggatcttcgtcggacagcttcgccagagcgatgctcatcttctcctgatcggccttggtcttcggctccacggccacctcgatcaccggatccgggaaggtcatggattcgagggagataggcgccttttcgtcgcacagggtgtcaccggtggtgatgttcttcaggcccacgaaggtgtagatgttgccggcttcggcggcatcgaccgggttctccttgtcggcgtgcatctggaagatcttgccgacgcgttccttcttgcccttggtggagtcaagcacggtgtcgcccggggtgacggcgccggagtagacgcgcacgaacacgagcttgccgtagaacgggtgggtagagatcttgaagaccagggcagagaacggatcatcggtggtcggcttgcgatcgatctcgatggattcgtccttaggatcgaaaccgacgatggacggaacgtcctccgggctcggcaggtagtcgacgacggcgtccagcatcggctgaacacccttgtccttgaaggcggagccgcagagcaccggataggcttcacggttaatggtgagcttacggatgccgctacggatctcgtcctcagtcagttcgccggactcgagatacttctcaagcagctcttcgtcggattctgcgacctggtcgagcagctctgcacgatactgctcggccttgtcctgcaggtcggccgggatgtcggtagtgtcgtagtgagcgcccatgtcgccggaaacgtcgttccagacgtaagccttcatacgaatcagatcgacaacgccagcgaagtcgttctcagcgccgatcggcagctgcacgacaagcggggtcgcgcccagcttggttttgatggtgtcgacggagtagtagaagtcagcgccgagcttatccatcttgttgatgaagcagatacgcggaacgccgtacttgtcagcctgacgccacacggtctcggactgcggctccacaccttccttgccgtcgaacacggcaacggcaccatcgagcacgcgcagggagcgctccacctcggccgtgaagtccacgtggcctggggtatcgatgatgttgatctggaacttctgcttctcgtcatgggtctgacggttccagaagcaagtggttgcagcggactggatggtgatgccgcgttcctgctcctgagccatgaagtccatcgtcgaggcaccgtcatgggtctcgccgatcttgtagttcttgccggtgtagtacaggatacgttcggtggtagtggtcttaccggcatcgatgtgagccatgatgccgatgttacggatctggttgagatcattgagcacgtctagtgccatgagtgttccttaactctcgttctcgactaattaccagcggtaatgagcgaaggccttgttggcctctgccatcttatgagtatcctcgcgacgcttgacagaagcaccaaggccattggaggcatcgaggatttcgttggccagacgctcagccatggtcttctcacgacgggcgcgggagaagtcggtcagccagcgcagggacagagtgttcgcacgagccggcttcacttcgaccggaacctggtaggtagcgccaccgacgcggcgggagcgaacctcgagggatggacggatgttgtcaagagcgcgcttaagcactgccaccggctcctgatcagtcttttccttgaccatatcgagagcggagtagacgatgtcttcggcgatcgacttcttgccgtcgagcagaatcttgttgatgagctgtgccacaacagtggaaccgtaaatcggatccggcagcagctgatgcttcttggaaggtcctttacgtgacatatctcttacttcgccttctttgctccgtacagggaacgaccctgcttgcgatccttcacaccctgggtatcgagggcgccacgaacgatgtggtaacgaacacccggcagatccttgacacggccgccgcgcacgagcacaatggagtgctcctgcaggttgtggccttcgcccgggatgtaagcggtgacttccacaccggagctcaggcgcacacgagcgaccttacgcagtgccgagttcggcttcttcggggtggtggtgtaaacacgggtgcacacgccgcggcgcagcgggcttcccttcagtgccaaagtcttggacttcttcggctttgcctgacgtcccttacggacgagctgttcaatagtaggcaacttgaattctccgattcagtggtttctcttgcttttgtgtgaccgccgcactgcacccacactccacgcatctgaatcgtgaagatagccacagtccaccggcccgatggcccatccctctctcaccgtcgcattgctgcgcgtgatgcaatcgagttccgggatatcccaacccgcacgcctgtcacataaggcatgccgttggcacacacgaattatcagtatacggattcccaagacattccaacatgccgtgtcgcaaatcgcaaaaggaatggccccggatcctttcgaatccggggccatccactcgggaaggaggttcccacttctttgctacgcgctaccttacgcgcactcttcagtctcgttgtctgttttgcatttgcggcccggcgcctgcgccgtactaccccattgccgctgtttcgaatcgctattgttcagttatatcttaaaggcgttgcgcatgaacctcacggccatcggcgcttcgttgcgacctgacgaattctcgactgatccacaactccggccttcagttacagtataccccaaaacgaacaaaaaacacgggtgaagacacccttaaatcccaataatttcaatcattttgcctacatcagcgcaaagcaacaaaacatcacaatgacacgtttgcaccactcaaaacaaaacattccctgaatcgttttgaaagattcagggaatgcgcaatatgacgacggaatctactgacgaatgtcagctgttagctgtttcggcagcgtcttcgcgggccttcgcagccgagcccttctcgccattgtcggaatcaggatggatctgatgcctgtcatcatgctcacgccaccagctggacagcacggaaccggaaatgttgtgccaaacgctgaagaacgtggacggcaccgcggccaacggattggaagcgaacgacgtcagcgccaaagtcgctcccaaagcggaatcctgcatgccgacctcgaaggtgatggctttctgctgtgcataacggaagcccttcggatataccttgtacataagtttggagaaaccgaagcccaacgcgtatccgcacaggttgtgcagaatgaccaccgggatggcaagcagcgaggaagccacgaacagcttcggaccgttggctgcgacgaccacgccgatgataagcaggatggccacctgggacacgatcggcagagcgaccgtaatcttctcgatcttctcgccgaaaatagcatggcagatcacgccaagagcgatcgggaacagcaccaccttgaccgcattgaggaacagggattccaccgggaccgacacatactgggaagccagccactgcatcaacagcggaatcatgaacggcgcgcacaacgtggacaaaataccgatggacacgtccagcgccacatcgccacggctcagatagctcatcacgttggacgaggttccggacgggcagcagccgaccagaatcacaccgacggcgagcgcaccatcaagacggaaaatccagcacagcagcacagctaccaacggcatgatgacgaagtgggccacggtaccgacgatgaccatcagaggctgggtgagaatgcgcctgaaatcgtcaagggtcaaggtaagacccatgccgaacagcacgatacctaggaaataaccggtataggatttgccccacaagcttgcctgcggcacgaaatagttgaacacggcccacacaatcacaatcgcggtgaaccacttggtgagccaatcaccaaacgctttgaccttctgcatgaatctctcttccttcacatttcacagcttttcggccgatgatccgcatacgccgtaaacactccgagacggcccacaccgccattacagcacacccttacgcatgcagcgactacaaggtacgcgtgagtttcggatttgtgtaatatgccgttcacataatgaacaatccacagcgcaagccgacgacagacacgcgcaacacgccgatgtagacatagctggaaaatcgtgtatagttttcatctgttgcgcttctgtatgaagcgaaaacatggtggctatagctcagttggtagagcatctgattgtggttcagaaggtcgcgcgttcgagccgcgttagccaccccggtagagacctcggaagaaattccgaggttttttgctatccggacggcttgaatacagcaaacagccggtcgcaagtcatcagcataggtcagatacaaggagcgcatcatgctgtcttttgaaaacgactattcctgcacggcaacaccggaaatcatcgaacgcatcagcgaaatcgcacaaaaccaatatccgggttacggcaacgacagcatctgcgaaagcgcgaaagccaaaatccgcgaagcatgcgcctgccctgacgcgcagattttcttcctggtaggtggcacgcagaccaaccagaccatcatcgactccatcacaccgcagtatgccggcgtaatcgcggcaagcacaggccatgtgaacgtgcatgaggcgggcgccatcgaattcaccggacacaaggtgctgacgctcccccaccatgacggcaaaatcgatgcgaccgaactcgacgagtactgcgccacgttctacgcggacggcaactacacgcacatggtgttccccggatgcgtctacatttcgcaggccaccgaatacggcacgctctacacgctcgccgaacttgaggcgatccgcaaggtctgcacgaagtacgacatgccgttgttcatcgacggcgcacgacttggctacgcgctgaccgcaaccggcaacgacgtgacgcttgaagacatcgcgcgtatcgcggacgtattctatatcggcggcaccaaggtcggagccatgttcggtgaagccgtggtgttcacgcacggcaatatgccgaaaaacttcgtgacgctcgtcaagcaacatggcgcgctgctcgccaagggatggttgctgggcgtgcagttcgacacgctgttcaccgacgatctgtattgcaggatcgcccgccacgccaacgatgcggccgaccgtattcgcgaagtgctggtggaacgtggctatacgctcaccttcgacgcgccgaccaatcagatcttcatcacgctcgacaacgcgacatccgagcgtttgcagcgcaatgtgcgcctcggcttcatggaaaaggccgacgacacgcacacggtgatgcgcatctgcaccagctgggccaccaccgatgagcaggtggagcagctgatcgcattgctgtagcgcgcatcgtcgctgtcaatcggaaaaataatcattacgacaaacaacaaaaaggcgcaggaattacatcccgcgcctttttgcttacgttacgatcatttatcacgcatgtggttccatttatgctgattgttacgcattgatttgcttattggcattatcggcgatcgcctcgcgttccatagccacgaatttacgcacggaagcagccaccgaataatgctctttagtgtgttcggcatagatttcgccccattccgacagttcatcggggtgatcgacccaccaatcgatgcgccttgccaacgcttccacatcgtcgacagggaatagcgattcgtcacgtaacgcgaactggcctgcggcgctcaacggagacgatgcgatgaccggcaccaaaccggcggccataccttcaatgacgctcaccgattcgagatcggcaatcgaaggatgcaccagcaaatcgccggaacgcagcaacgcgggcatttcggtgttcttatgaaatccgatcgatgccggtcgggaaagcaaacgtgcggcgagtcgctgcaatttctttttcaaaggaccggtgccggcaatcgtcagttcaatatcttgcgcatgcctgcaacgggcgatcgcatgaattaatgcgacatgattcttttcgttcgtcaatcgtccggaagcgacaatgtggaacggaaccggagcagacttccccgcatcgcgctgcgttttcgcagtgaatcgtgattcatatccgttggaaatcacatgcagtttcgatttgtacccgtgagaacgcagcaaacttgcgccaagctcggtcggcacatgcacatggtcgattttgcggtacagccacaaattgaacagccagtagatgaacttgtcgatgcccggaatatatttcagcggacctgccgaatacgtgatgttctccggctgcacatgatagcccgcagtaaccgcgattcccatctgtttggcgactttgcacgcatgctggccaaaacggaacggcgtgtagatgtgcaccacgtccacgcctcggaacgcggttctgaacagcgtgtcgctcggttcggcgaactgcatctgctgctttttcgccacccaactgaccagaggcacatggttgactcgtgccgggtattcaggcgcaccaatgcccacaagcctgaccgtatggccttgccgcttcaattcctccgcccactgcaacgccgaattcgacgtgccgttacctcggtttcccgacgtgtcgaccaccatggcgatggtcaggggtcgctgtgtttcttcctgttccgtctcagacatgcactccatcctacgccgatggcacaatggaaggcatgactgaagagaatcgtgccttgggcactccgcttggtaagcatccgactcgtgttctgtttcttggctccggcgagctgggcaaggaagtcgctctcgaactgatgaggcttggcgcatgggtatgcgcggccgattcctatgagggcgctccggcacaacaggtggcgcacgaataccgtgtgctcgacatggccaatgccgaacagttgcgcgtattgtttgacgaaattcagccggatattatcgtgccggaagtcgaagcgatcgccaccagcgaattggctgccgcggccgagcgtggcgcacaggtggtgccaagtgccgaaatcgcatccatttgcatggatcgtgaacgtttgcgcgtacttgcgcatgaggaattgggattgccgaccacgccgtaccgcttcgcaggctcgctggaagagcttcgcgttggggcaaaaacggttggctacccgtgcgtggtcaagccgattatgagttcttccggtcacggccagtccgtggtgcgttccgccgatgcgattgatgcggcttgggttgaggcacaggaaggtcgtcgcgcgcacgacgagggagacgtttcccgagtgattgtagaagcgttggctccgcttgattacgagctgacggtgttgaccgtcagctccagcgccggcatcgtgacctgtgctccaatcggacagcgtcaggaaagcggcgactatcgcgaatcctggcaaccggcctccttcacacaggatgtgcttatgcaggcgcaacgcatagcgtgcaccgcagtggaaggtctggtggcgaaggccaaggcttccggcgagaagggttggggtgtgtttggcgtggaattgttcgtgctgaccgacggttccgtgctgttcaatgagatctccccacgtccgcatgacactggcatggtcacgatggcgtcgcaacggttaagcgaattcgcgttgcatgcgcgtgcgattctcggtttgccgattacgcaagaacatgtcgccttgtcgatcccggacggtgccgtcgcggcaagccatgcgatcgtcattcagggcgatggtgaagccgaattccgcaacgtcgccaccgctttgtctcagccgggcaccgatctgcgtattttcgcgaagccggaagtgcacggccatcgtcgcatggcagtcgcgctggccatcggaacagatgaggccgacgcgcgtgctaaagccgagaatgtggccgaatcgctcgaaatcgacatcgcctgacgcactattgccggatactgacggaagactgccggaacgcgcccaaaaaccattcgattgtagcctcccgttggtatcttgttaaccgtcaagttcaccaaactatctacctcccaaacaccaggaaaggcgagtaatggagaagttggaaaagctctacgagggcaaagccaagcaactgtacgcaactgacgatccggaggtgctctgggtcgaatacaagaactccgctaccgcaggtgacggcgagaagaaggaagacttcgccggcaagggcaggctgaataatctcatcaccacgctgatcttcgatctgctcaagaagcgcggtatcgacagccatctggtggctcgcgtgggcgaaacctcccagctggtcaagaaggtcaccatgttcccactcgagatcgtgctgcgtaacaccgctgccggccacttctgctctcgcttgggcgtggaagagggcatcgagctcaaggagccggtgctggagtacttcctgaagaacgatgatctgcacgatccgttcgtgaacgacgacgatctggttgcattgggcgtctgcacccgtgaggatctggctgagatcgcacctctcgcacgccgcatcaacgaagccctgatcgagatcttcgccaagatcggcatcaagcttgttgatttcaaaatcgaaatgggtcgcacttccgatggcacgctgctgctggccgatgagattacgcctgattcctgccgtctgtgggatcagcgtgacggctccggcaaggttgagcatctcgacaaggatctgttccgccgcgatctgggcgacatcattccggcttacgaagaggtcgaaagccgcttggctgaactcgccaagtccgaaggcattgaagtagccgaataatacttgcgatagcccgcatctgcagtacaaactcggatgcgggcttcatcgtttttaaaaatcttatttttatcaatctcaccaagcccctctttcaaggagtcaaccatggtttttcgcgtgtacgtggaaaagaagcagggttttgatgtcgaggccaagcagctcgccaacgagctgaagaccattcttggcatcgcatcgctgaagaatgtgcgtctcgtcaatcgttatgatgtggaaggcattagcgaggaactgttcgcacaggccacccctaccgtgttcagtgagccgcaggtcgataatgtttccgccgatttgcctgatttcggttctgataatgtgtttgctgtggagtatctgcccggtcagttcgaccagcgtgcggattccgccagcgaatgcattcagctgatctcccagggcgagcgcccgactgttcgttccgccaaggtgtatgcacttgaaggcgagctgggcgacgccgacatcgccgccatcaagcattatgtgatcaacccggtcgaggctcgcgaagcttcgctggataccaagaccacgttgaagacgcaggtgccggtaccgggcaaggtggaggtcatcgaaggtttccgcaccatgagcgacgccgatcttgagcagttcatcgccgaccgtggcctggccatggatttggctgatctgcagttctgccgtgctcatttcaccgaggaacagcgtgatccgacaatcacggaaatcaaggtgatcgacacgtattggtccgatcattgccgtcacaccacgttcggcacgcaacttgatgatgtgcagattgacgacgcgaccgtgcaggccgcgttcgataagtatcttgagatgcgtcacgagcttggccgcgacgaaaagcccgtatgccttatggatatgggcaccatcggcgcgaagtggctcaagaagaacggtattctgaagaatcttgacgaatccgaagaaatcaacgcctgcactgtcaaggtgaaggttgatgtgaatggccatgatgaggattggctgttcctgttcaagaacgaaacccacaaccacccgacggaaatcgaaccgttcggtggtgcggcaacctgcatcggcggctgcatccgcgacccgctttccggccgttcctacgtgtatcaggccatgcgcgtgaccggtgccgccgatccgaccgtgccggtgtccgagacgcttgaaggcaagctccctcagcgcaagctcgtcaccaccgccgccgccggttattcctcctacggcaaccagatcggcctggccaccggtcaggtggacgaaatctaccaccccggatatgtggccaagcgcatggaggtcggtgcggttgtggccgcgactccggccgatcatgtacgccgcgaaaccccggctccgggcgacaaggtcatcctgctcggcgggcgtaccggccgtgacggcatcggcggcgccaccggcgcgtccaaggcgcataacgtcgaatccctggagcttgacggcgccgaggtgcagaagggcaatgctcccgtcgaacgtaagctgcagcgtctgttccgccgcggtgacgtatgccgtctgatcaagcgctgcaacgatttcggcgccggcggcgtatccgtggcggtcggcgagctggctgacggcctgtatgttgatctcaacaaggtttcgaagaagtacgagggcctggacggcaccgaacttgcgatttccgaatcccaggagcgcatggccgtggacgtggccgccgaggatgtggacgagttcctgggctacgccaaggaagagaatctcgaggccgaagtcatcgcgacagtgaccgaagagccgcgcatgacgatggtatggaacggcgacacgatcgtggatctgtcccgcgagttcctcgcctccaacggcgctccgaagcatcaggtggtgcatgtcgaggcgcagcacggctacgccaccccgtggaagaccggcacgctcgccgaacgcatgcacaccatgctcaccgatctgaacgtggcttccaacaagggtctttccgagcgtttcgactccaccatcggcgcaggcaccgtgctcatgccgttcggcggcaggaagcagctgaccccgaacatggccatggtcgccaagctgccggtgttcggcgagaccaccaccgcctccgcgatggcttggggcttcaacccgtacatcatggagcagaaccagttcacaggcgcttatctgtctgtggtcgagtcgctctcgaagctggtggccgccggtttcgaacatgagaaagcgtatctgagcttccaggaatacttcgagaagctacgcgacgagccggagcgttggggcaagccgatggccgccgtactgggcgctctgatggcgcaggtcgatctaggcgctggcgcaatcggcggtaaggactccatgtccggcacgttcgaacagctggacgttccgccgaccctgatctccttcgccgtggctgtgggcaacatgaagcgtgccacttccccagagttcaagggcgctggtcaccgtgtgatccgcatcgcgccgcgttaccaggccgacggcctcacaccggacaaggattcgctgctggaggtgttctccgcagtcgaggagctcaccgatttcggcgatgctttggccgtgtccacgcctggctacggtgccaccgccgaggcaatcttcaagatgacggtcggcaaccagatcggcgtgaagctggccgatggcatcagcgtggacgacctgttcgccccggcctatggttccttcatcatcgaacttgccgacaccgcgaaggttccggccgtatccaacctggttgaggtcagtgaggtcggcgagaccaccgaggcctaccagttcgtggcagccggtgagacgctggatctggccgaactgcaggacgcttgggagggcggcatcgaatccgtgttcccgtaccgatccaagggcgacgaaaagggcaagaccgttgagaccgtgtccttcaatgcgccgaagaagaccgtatacaccggcgccggcgtcgccaagccgcatgtgatcatccccgtgttccccggcaacaactgcgaatacgattccgcagccgccttcgagcgcgcgggtgccgacgtgagcacgctcatcgtgaacaacctcacccctgctgctgtggctgagtccaccgcagctttggttgaggaaatcaagaagagccagatcatcatgattcctggcggcttctccggcggcgatgagccggatggttccgccaagttcatcaccgcgttcttccgtgctcctgccgttaccgaagcggtgcgtgacctgttgaacaaccgtgatggtctgatgctcggtatctgcaatggtttccaggcgctgatcaaactcggcctggtgccgtacggcgacatcgtgccgatgaccgccgaatgcccgacgctgacgttcaacaccatcggccgccaccagagccgtctggtgcgcacccgcgtggcgtcgaatctctccccgtggctggcaaagaccgaggtgggcgacatgcacaccatcgccatctcccacggcgaaggccgtttcgtggcttccgacgatatgctcgcccagctcaaggccaatggccagatcgccacgcagtacgtggacgaggccggcgtgccgggcatggacctgagcgtgaacccgaacggttcactgctggccatcgaaggcatcaccagcccggacggccgcgtgttcggcaagatgggccactccgagcgttacagcaacggtacgttcaagaacgtgcccggcgagaaggatcagccgctgttcgcagccggcgtggagtacttcgccgcctgatccacgaccgcatccataaaagcgttctgacgtagattcgaacatacagaggctgtttggtttgatcgggattcctccctagtcaaaccagacagcctcttttttggtctccgacgcatgttaggcggagaggtagccttcggcgagattgacgggggtgttggcgcgttccactgcttcgttggaatgggtggcggtttgtttgatgatgtcgtcgtagccggtgagagcggcgaaaggcatgaattgcgcggcacggttgtgcatactcatgtgcgggcgcgtgcacgagcgatgatgaggcaagttgatgatgtcatcgtaacggtcggtttgctgcaaactcacgctgcatgacctccaatctgtcggttgcgctgttgacctgtggcatcagcgaacatgtccattcctttgatgacggcgtttttgccgaacttgcgtttgatgtcaagaatcgtctgttgcacatgctgttcggaaatctcatcgacaacctgcatatcgtcagtataggaagaccgcgcgttgttatcgacgttatcactgcaatcgttgctatcgcttccatttgagacttcttgcatatccgaaaacagatcgggctgaacgtaattcgccgcagcattccgctcagccagctgttcgaccgtttgcaaatcagaagcaaccacattcaatcgacgtaccaacagccgatgatcgacgattctgcagaacaattcgtcaaccgcatcgcatatgcgcgtggtggatgacgtatggtcgcccagaccaatcgaccctatagccggcttgggcacacgccgaccatacctatcaagagttacgggaccgctatattcggcaatggctcgctcagccatcgccttcaattccggagtgccacactcccctagccgctttggatcaagactggcggtatcgtaaccgaccatcaaccccatatggccggccttcacacctttggcaaccaaatccaaagacaaggtgtccgccatttctctcacaatcagccgcgccgagtcaaaaccgaccgcgcccgtaagcacctgccccgaactcatactatgaccagctggcttatacgctttgatgtcggcgatcgtgcaaggttcccaaccccacgcatggtcgataagcagctcggcgttcacaccgaacatcttgtacagcaggccctcgttgtaatactcgtcggcacggcctatggaacatcgggctatatcgcccattgtcattagaccttgggcttcgagcttcttcgcataccctcgtcccacacgccagaaatcagtcaacggcctgtgcgcccataacagccgacgatacgacatctcatccaattgcgcgatacgcacgccatccttatccgcgggaatatgcttggcgaccacgtccatagccactttcgccaaatacatattcgtaccgataccggccgttgcggtgatacccgtctcccgaagaatctgctggatcatttcacgggccatatcatgcgcgcttttgccgtaagcccgcaaatacccggtaacatccatgaatacttcatctatcgaatagacatgaatgtcagcttcggatacgtatcttaaatatatgctgtagattttcgcactgatgttgagataatgcgacattcgaggcttcgctatatacacgccagcagccagattcggatcggctgcgagcgcgttcgcatcatacgattcgcctctcagcgcaccgcccggcgctgccgccagccgtgccgcattgacttctttaagcttcgccttgacctcaaaaagccttgccctaccaggcaatccatacgctttgagcgatggcgacacggcaagacagatggttttgtcggtgcgcgattggtcggccactaccagatgcgtggaaagtgggtcgaatccgagttccgcacattccgaagacgcatagaaggatttcagatcgattgcaatataagtacgttcagccatcgccagtctccttccatgattgacatcactctgaagcggcaaacaaccacttcagctttcctgcgctcattttccacattcagcatatcagagagttcgaacaattgttcgacacacccgacatgccaagtgcccctaaggactccacgaaaaccgccaattgtagcctccggttggtagggttgaacggtagcgaaccccttgtctccatggttttggaaggagctttggcttgtcagctgaactcgaagacatccacgaggaatgcggtatttttggcgtttggggtcacccggacgccgcccgactcacctacttcggcctgcacgcgctgcagcatcgtggtcaggaaggcgccggcattgtctcgaacgataacggtcatctcatcggtcatcgcggaacgggtctgttgacccaagtgttcggcgacgaacgcgaaatcgaacgcctgaagggagacaaggcgatcggccatgtgcgttacgccactgccggttcaggcggcaccgacaacatccagccattcatcttccgcttccatgacggcgatatggccttgtgccacaatggcaatctgacgaactgcccgactctgaggcgtcagttggaagacgaaggcgcaatcttccactccaattccgacaccgaagtgttgatgcacctgttgcgccgctccacacagcgtacgttcatggacaagctcaaggaagcgctcaacaccgtgcatggcggtttcgcctacctgatcatgaccgaagacgccatgatcggcgcgcttgatccgaacggtttccgcccgctttccctcggcaagatgaaaaacggcgcttatgtgctcgcttccgaaacctgcgcgcttgacgttgtcggcgccgaattggtgcgcaatattcgcccgggcgaaatcgtggttatcgacgatcacggctacaagatcgtgcagtacaccaatcagacccagttggccatctgctcgatggaattcatctacttcgcacgccccgattccgacatttacggcgtaaacgtgcattccgcccgcaagcgtatgggtgcgcgtctggcccaagaatcgccggtcgatgccgatatggtcattggcgtgccgaattcctcgctgtccgcggcctccggctatgcggaagaagctggtctgccaaacgagatgggcctgatcaagaaccagtatgtggctcgaaccttcatccagccgacgcaggaactgcgcgagcagggcgtgcgcatgaagctgtccgccgtgcgcggcgtggtcaaaggcaagcgcgtgatcgttatcgacgattccatcgtgcgcggtaccacgtccaagcgcatcgtgcagctgctgaaggaagctggcgccgccgaagtgcacatgcgtatcagctcgccgccgctgaagtacccgtgcttctacggcatcgacatctccaccaccaaggagctcatcgccgcaaagaagtccgttgaagaaattcgcgatttcattggcgccgattccttggcgttcctgtcactcgacggattggtcgaatctatcggcctgggtgcggacgccccgtacggcggtctgtgcgtggcctacttcaatggcgactacccgaccgcactcgacgattatgaaagtgattttttgaagtcccttactcctgaagatcgcgtgcgtctgcctgaattcgccttgtataagagcaagtacgagggcaacgaatacaccactacttcatcccaagaagaacactgaacccgagaaaggtttgatatgccaaaagcatatgaggaagccggcgtaagcgtcgaagccggttacgaagtcgtcaagcgcatcaagtcccatgtggcgcgcaccaaccgtccgggcgtggtcggcggtatcggcggcttcggcggcctgttcgatctggcttccctcggatacaaggagccggtactgatttccggcactgacggcgtcggcaccaagctggtcgttgccaagatggccaacaagcacaacaccatcggcatcgactgcgtggccatgtgcgtcaacgatattgccgctcagggtgcggaaccgttgttcttcctggattacatcgcctgcggcaagaacgatccagcactgctcgagcaggttgtggctggcgttgccgacggctgcgtacaggctggttccggtctgatcggtggcgaaaccgctgaaatgccgggtatgtatgacgaagacgagtacgatttggccggtttcgcggtcggtgttgccgagaagtccgcaatcgtggacggctccaccatcgctgagggcgatgtgctcattggtctgccgtccaccggcgtacattccaacggcttctctctggtgcgcaaggccctgttcgagaaggctggctataccgtcgataccgtgcttgacgagctcgacggcgaaaagctcggcgacgtgctcctcaccccgacgaagatttatgtgaaggccctctccccgctgttcaaggccggcgtggtcaagggtgtcgcccacatcaccggcggcggcttcatcgaaaacgttccgcgtatgattccggacggtctggccgcacacatcaacctcggctcctggccggtactgccgattttcgacgtgctcgaaaaggccggcgaagtcgaccatatggaaatgttcaacatcttcaacatgggtattggtatggtgctggccgtcaacgccgaagatgccgataagaccatggaattgctcaagtccaatgacgaagccggttacgtactcggcaatatcgtcaagaagaccgatagcgacgtcgaactgcagtaaatacatatacgggggtgagccataacggccacccccttttatttccgaagactttcctgaacataggattttcccaaaagggacacaacaggaggaaacatgaaggttctggtcattggttccggtgcacgcgagcatgccatcgcccatgcacttatgcgcggcggcagcgtcagcgaagtcacggtggctccgggcaatccaggcatggagcttgacggcatccgcaccacgcagatcaacccgtccaatcatgccgcgctgattgatttcgtgaagaacaacggctacgactgggtgttcgtcggtccggaagtgccgcttatcgagggcatcgtcgacgatttcgcgggagctggcatcaaggcgtttggtccgagcaaggccgccgcgcaaatcgagggttccaaggatttcgccaagcagttgatggaacgtcacaacattccgactgcgaagtatcagacgttcgacgatttggagcgttccaccgcttatgtgcgtgaacatggcgctccgattgtgatcaaggctgatggtctggccgctggcaagggcgtgaccgttgccatggatgaggaaaccgccatcgccgctcttgacgacattttcgtcgatcatcgtttcggcaacgccggtgcgaaggttgtcatcgaggacttcttggagggtcaggagttctcgctgatgagttttgtgaatggcaccgatttctggccgatgccgatttctcaggatcataagcgcgcttatgatggcgataagggtccgaacaccggtggcatgggtgcgtacagtcccgttccgcagatcggtcaggatgtggttgacaccgctatcgaaaccattgtgaagccgaccgtgcaggctatgtccgatgagggtacgccgttcacgggcattctgtacgctggcttgatcgccaccgcggatggtccgaaggttatcgagttcaatgctcgtttcggcgatccggaaacggaagtcgtgctaccgaagctcacgtctgatctcggcgccggcatcagcgctctgctcaatggcgagactccggagttcacttgggataatgacaacgccacgcttggtgtggtgctcgccgccgacggctaccctgtcgatgtgatcaagggcgctgcgattcctgagattccagtcgatgaggattcccacgtctattacgctggcgtggctcgtagcgaagaaggtctggtcgccaattccggccgcgtgctgttggtggaaacctccgcagccgacatcaaggccgctcaagacaaggtgtatgcgattatcgaccagctcgacaccaagggcatgttctaccgtcacgacatcggcgccaaggcactgaacatctgaatgcacccagcgattgcataccatcagaaatgtctgtaaccatgcaatcgcaatcatatatataaaaaggacggcggttttgtggtcggacagagaggagtccgactgcaaaaccgccgttttttaatcacacaacacaggcaagcttatattgattacttctgctctcccggcttcggaatgagcagggatgcgcagaacgcgaggccgagcagaatcacaccgccaaccatggctgcgatgtagccgctggtcgcaccgccggatgcggtgaacgcgttctgagcagcgtacagcactgcataactcagaccggcacccaggttgaatgcaccggagttcagaccaggcaggtagcccggattgtcttccggagagagcacgatgcccagaccgttcagcatgatgttggcagtacctgcgtaggaaacacccaaagccaaagacatgaccacaagtgcccagatgctcggaacgttgcacacgaagatgccgagcagcacgcccacaacagagacgatcaagccagtacgcagcaccgcacggtagccgaacttcgaagcgagcacgcctgcgaccgggccgaatgcgagaccgatcaacgcatacggagtcagggtggcgaacgataccacgctggcgctcatgccggcgccgacttcggtatcctgagcgagagcaggcacgataccgttcatgatggcgaacacgccggtcatggtaagcagggtggtcagcagcagaccccaagtacgacgctgcttgaggtaatgcgtggtgaccatcggagccttctgacgcttctcaacattccagaacaccacgaacagcacggctgcaataatgatttcgacagcgaccagcgcccaattggcggagcccagcttctgaatctcgttgatggccagatatgcggccaagaatgcggcggcaagggaaaccacgccaacccaatccatcttcggagtctcggaagcggtggattcttccgcatacacgaacacaagcacaatggcaagcaccgcaacgccaaccatgacccagaacacggaacggaaaccgaacgtgccagcaagccagccgccaagaatagcgtcgacaccgccgatgccaccattaacggaagtcagaatagccatgagcttggcgtacttcttatcttcagtaaccttggcgtgcagcatgatcagcgtcatcggcacaatcggaccggcaacaccctgaatcacacgaccgatcatcagcatcggcacgttgaccgcgagcgcggaaaccacgcagcccaaagcggtaagcacaagaatgccaagcagcactttcttgcgaccgatcaaatcgccgagtcgcggcaggaacagcgagaacactgcacacgaggtgaagaacaccgtctgggtcaagccaatctgcgcatcggtggtgttgagttcaacacgcatggtcgtcaatgcaggcgaaagcatggacgcgttgagctggaacgcgaagatggctgccatcaatgctgccatcaatgcgacgacggacttgccgccttcgtcgagcattttgctgtttttggtctctgtcattagagcacccctttacttatctttctcttctttcagccgatggtcttgattgcgtcggttaccaaatcccagaatttgttgaaatcaagcttgactgcaacctgggtgtggcattcttcggcgctcggctctggacctcgcaggtcggcgacggtcatgccaagtgtgagatctccatggatttcgacatcaaccgggcaacgacgggtggtcatgacgctcggatcaatgaggtatgccaccgtgcacggatcatggaccggaggatcgatgaaatcttgattgtcttgataggtcttgcggaagaagtccatcagaccagacacgaacttggcgagatcagtgccaacgccttcgatacgctgctgcacttcgggcgtgcacaatgcctgatgcgtcagatccaatccgaccatggtgatcggccaggcttcattgaacacgatgtgagcggcttccggatcgaccttgatgttgaactcggccacggcactccagttgcccacatggtatccgccgcccataagcacgacttccttgacacgttcaacaatgcgcggctccatgcgggcagccatggcaatgttggtcagcggtccagtcggcaccagagtgatggtgcctggctcgttgctcataatggtgtcgataatccagttgacggcatgtccggcttccagcggacggctgggttcaggcagttcaacgccgtcaagaccggtttcgccgtgaatggaagctgccacttcctgcttgcgcaccagcggacggtcacatccggcatgcaccggcacgtcggtggcatgcgccttttccagcactgcacgggcgttgtaggtcaccttgtcaaggctctgattgccacctaccgtggtgacgcccagcagatcgatattgggattgcccacggcaagcaggatggcgacggcgtcatcatgtcccggatcgcaatcaaggatgattttcttggacattatggttcctccttatgtactccaactttgaaccgataatgaggtggtcgacgattgactgactccggctcatcggtcacacaacttgttgcaaggccggcaatggcctttgatatcagcgacttccgaaaccttcgagcagttgttcggctgcctgaagatcgatgtcacgaggtgtgtttcctgcaaaacgctcgtcaactacggcctgcgcattggaaacgagttcttcaacgctgatgccgtaatcctcaacagcatgcagaccgagcatgcggtcgcggaaatccttgaacgctctgcttgcgataatcgcaacctgctcgtccggcgcattttccgggtaaaccgcacctagaatctgaccgatctcacgaaccttatgcgcacgtacgggagcaacgaactccataaccgccggcaacgcgtagccaacggcttcaccgtgcacgatgtggtatttcgctccgagcacgtgtgcgatggaatgccccgcaatggttcccgcattgttcagcatccatcctgcaagcgtcgacgcgaccatcacacgttccctggcttcacgatcctgaccgtttgccacagcacgcggcagatagttgtacagcaggaacatcgctttttcgcaaatggcatccgtgaccggacttgccattcgggaaaggtatccttccgcggcgtggcagaatgcgtcaagtccgcaagcgatggtcatttttgcgggcagtgtcagcatgagatccgcgttcagcacggcatattcgctgactgccggatcggcaagcaccgcgagtttacgaccggtggatccttcggtgaccaccagcgcgttggacatttcgctgccggtgccggcggtggtcggaactgcgatcataccgttgcatggtgcgatcggcttggctggatcggtgtattcgatgatggatccgccgttgacacgcacgatgttgatgcctcgggcaacatccatggaactgccaccgccgatggcgatgatgctgtcagccttatgcgcttcgaatgcttcgacgccggattccacggtttcgcaaagcgggtcgggcttgacctggtcgaataccgccacatcgacaccgacctgttcaagcttggtacgtgcggcaacgaccagcggcatgcttccgacgaaggaatccgtgaccatcagcggacgagaatagcccgcggtctgcatgatatcgaccagagtctcccctaaatcgtcagtgcagaccactttgacgggttgcagcagtttgacttccatagccatcggtcactgtccgatctttgcggccgcagcgtcggcattgatgcagaattgacgaaccttgtcgatgtctttctccatgtagccgccgtcgtatttgatgctggtcttcgtcagggagtccacgccatacggcttgcactgttcgatggcttcggcaacattgtctggtccaagaccgccagccatgatgaccggcttgccgcattcggccacaatacgggcgtcaatgctccagtcgtgggtcagaccgctggcaccaatgccggtgtcgggggccagaccggagtccgtgaggatgagatcgcagtattgtgcgtacttcttggcacggtcgacggcggattcatcgtcaacgagcacggcctgcatgagtttggtgttcggagcggcttccttaagtcgggccgcgaatgcttcatctgcggcgtacccatcgcctgcgatatgcagaatgtcaggccgcacctctctggcaagctcgatcatctcgtcgggatcgttggtcagcatgatggccacggaggtgacgccacgacgcttgcattcgtcgaaaatgcggtgcacgcgttcgattggcacacgatgtgccggaacgccaccattctgcatcggcaccagtccaatgttgtcggcaccagcctccatggttttgacggcctcatcgtattcgatcagagaatagatctgcttgactaccattgtcggttctccttgtgtttgtatgggttgatggacgtgtgatgtagcaaaattcaggcggtacgcacttcgtcgagcaacggctcgatctcgccggacatcttcttacgtatgcgttccacggtgatatcgggcactgcttttgtgcattcgagcgcgatgctggatgctgcctgcgcaattttgccgacttcttcaagatctcgatcggggttatcgaagaagctccaggtgatggctgccatgccggcatctccggcaccatttgccgtggcgatttcggtacggtatggcggcacatgcttgaagctgtattcgtcgttttcgtgtctcgcgcacaggattccgttggcacccaatgaaatgaatacgttcttcacgcccctgtcgagcaaggtcttcgctgcggcacctgccgaatactggtcggcgataccgatgccggtgagtacggatgcttccaaatcattcggcttgagcacggtcatcttgttgaggatcgtgtcgaaacggtgcgctttgactgtggaaacggtgtctccgaacagtggcgcggtgacgtgttcgccaatccatgccatggtttccggttcaagattggcgtcaagcaggcagatggcggcaccgttgatgaagtcgaggcgagattcgaggaatgccggattgatttccttgcagatttccatgtcgttgacggccaccagcagatcgcccgtatcgtcggtgatgaacatgtaggtggaagaacggcgtccttccagctgtgcggcatagtcaagattgatgttgttggccgcgcacgaacgttccagggtcttgccgttttcatcgtcgccgtagacggtgatcaggtatgtcggcatgctcagatgagccatgttctgtgcgatgttctgcccgacaccacctgcggacatgctgacgacgcccggattcgagtctcggtccactacggtgctcgtcggtctaccacagatgtccatgttcatgccaccgatgaccacaacgtaacggtcaggaacagtatttcctgaagtcatatccgccatggatattgcctcctacattttcggggatatatctgccttgatacacccttgatgaaacgttttatcttcaatttagagtacaacaaaagtttaagccagtcaacttttgcttatatttcatcgatgtaacatatggaaaaatcgcgtgtctcgcgattacgaaagaaacaaatgtaagaccgccatacctgcgttactgcagcaaatcagctttgcgccgcacagcttcttcagaaaaatcagcgcaaatcgactgcacctgagacatattcatcgcagccgccgcagacgcatatctagcgcattcccgctgtgttttatgctcacgacgcgcccacaccagcgcactcaacgccgccgacgcaccaccattggtatatcgacgttcctccgcccttcccggcaaagaccagaaaaagctttcatgttcgcagcagtacagcatgtccgaatcatccacaaaaagaaacacattacgcacaccggaccgcagcaaatgttcggcgcaatctctggcactggcctcgtcatgcacctcaatccccgacacgaatttggcttcggcggaattaagcaccatagtgtcgatacgatcgagcaccggcgtgattcgcgccgctttattaacggaaaccacgcgcacgaaaatcggtcgacttgttttttcgcaaacccatgctatggcatcagacggcaagctcgaatcaatcgccaccatttccgcattgacgatggtctgctctcgttgcgctagaaattccggggtgatttccgcactgatctgcatatcatcaagacccacaatctgacgcccctgcgcggaaacaaccgacaagaaggtggaagtaggcatatgggaaatctgcttggcatgcgtgatgtcaatgccgttggcatacgcgtcctgcttgacgcgttcaccgttctcatcatcaccatagacggaaatcaaataattcggcacgccaagccggttcagattgtaggcgatattgtaaccaatgccgcccacggatgacacaatgcgccccatgttggaactttccccaaccacatcctgcatggcgacaccgtaatggtctatattgatggcgccaacaacagccacatagctgggcggagtgacgatataccctttgccttggatgtacccttttttcatcaggttggagatgtgcgcggccacccctgaacgggtgatgccgcacagttccgcaagctcgttttggctgatcaaaggattctgcttaatccacgccaaaatctgctgttcgcgatcggttgcggccatctcttcccccttgcctctagggaagatccatgaaatcggtgtctttcaggtagttcttccctgtggtgatatcgtactgaatcagctggtagtcggcaagcaactgctgggtttccgcgtcgaagtcgctttcggccatgggattgccgtcagcgtcgagatagatgttctgaccttcagggatacggtcccatccctggatattgttgacgacaggtggctccatggcggagattttctcatgcatttgcgtgaggaacgccagatacggggacaccttggcattcatatgctcggcggcctgcgccacgaagaagttcggcgacgaatagtcggcgttgtcgatctcgttgccttgcgagctggacgccttgttggaccagatgaaataatccgtcagatgcaaggcaagcgaattgttgtcgtcttcggaagcggacgaataaatgcccggcagatgatcgccgtagaacaccacggtgatcggcttgtcgatggcgtcgagcttgtcaaggaagtcggcggtcgcctcatcggtcagagccgcacccttctgataggtttcgatggactccttctcatcgtcctccaaaggagtgtccgtagtggattcggccttgaaatcgttgttcttataccaatcgtggtatggcatgtggttctgcatggtgatgacctgcaggaactggttgccatcggttttcttgacttcttcgatggtgctctcgtacgtcgcttcgtcagacacgtacggcgaatcgtcgatcttgtcttgatgcgagatgacgtccggaccggtcaacgtgtagaaatgcgagaatccgaacttcttatagttggtcgcacgcgagtacatagacgattcgtacgggtgcagtccgatggaattcttcgacgccccccacagctggttgatggtcggcgtccaatgctcgctcggcacaagctgctgatacgggctggtgagcgacgaatcgaaattcgacatgctcaaacccgtcaatcccatgtattcgaggtttgcggtaccaccgccatatccggaagaaagcatcaaaccggaggtcgtattctctttgatggaacgaatgttgggcatggaatccttgttgaccttaagccccggcacgcgagacgggtcggagaaggattcggacagcacatagatcaccgtactgtcggtcatgttctcggtacgagatgcgttgatcttcttcgcttctttttcgtatcgtgccgcgacttccttcatggtttcttcggaatagtcgtcaggcttcaccatgactttcggattcagctgcctggtgaaggcgaccatcggtccgttgcgctgcgcatcgtagacggaatcccacatggacggcatgtcccccattgccgaagagaaggttttcgcccaagatccgacagtgctcacctgcatggaatacagcgtgaagaacgttcccggcacgatgatcagcagtagtcgcacgatggcattcagcgagcgcgactgcttgtcgtcgccacggaaaagcttgccgtgacggccgtcacgatgattcaggaatacgaaaagcgcaatgaaagcaacgaatatgacgacggcgagcagaatggtccactgtgcgcctgccggcatgaagctcataagattgcccgcatcggctttgaggaagttcagatcgctgggaagaatcgcctcatatcggatggatactttgaaatgttcgatcaccgcgataatgaatgtcaccgccagaaatattggcgtggcgatccagaagcggttgatgagcatgagcagtatcacatacagcacgccccacaaaatcaggttgagcaccgccacaaagttgaggttggtgaacattttggtgacgaagccccaaccggtcagccacatgttgttcgaaagcttgacgcgtgtagcggattgactgacgccaatctgtagcgctgccacgccgatggcgtcgaacaccacaaacagtatgccgtacaaccaccctgggaattccttacgttccttggcgggtgcgtttggatcaatcgtcgagatcctcagttcctcaatcgtctctgtattcacggattcgttcgtcaagtgtttatctccactcgtaacgtgtcagttcgcttcgtttcccgccttacggcgacgccaaggcactattttcgcgaccatatctgacaaaaagctgtaatgatcgatttcatccacagtttcttctgattttcttacgcatatgccgatgaaatcgcaaaagaacgatgagggggtatagacagttcggatggcagtatctagttgtcgtcaaggattccgccgtccacataaccgttgttgctgaaatcggcgaaattgttgagatcgacggaattaccgtcgtgcctcattccggcagtcggggcatagtccgaacacctcaagcgtatgccgttcgatggtgaatccgtatttctcgctgatgccacgcagccaagtttcggatggcgattcgatttccacggttttgccgcaattcgtgcatacgagatgatggtgatgcccgtcatcaccacacagacggaacagctgctggccttccaaacgcacggtatcagcctcgcctgcctcagccaaggcattcaattgacgatatacagtggcaaggccgaccttcacgccttcgtcttccagcttgcgatgcaaatcctgtgcggaaatgaattcatcgtttgccttcaacgcatcatgaatcagttctttttgtttggtgttgcgctccacgcgtccgtccgtcaatctatgtccgttcttgatggcttcgcgcgccgccctcccctcagggaaaggctgacgcgcgaaacatgccgtcatcggttttatttcaaatcatcccagcagccggtccgttcaagatccgccacagtttgcctggtgtcgtcggtcagcacggtgatatgccccatcttgcgatcatgacgcacttcagccttgcaatagtcgtgcatattccattcgggatgctcggcgatcagcgcgcgggtcggtgccacatgctgcccgagcacattgaccataacagccggcttgagcagttcgggctgttcgagcggccacccggcgatgcctcgaatatgcgcgtcgaactggtcgaacgagcacgcttcgatggtgtaatgaccggagttatgcgggcgaggggcaagctcgttgacgataacccgctcatccttggtaacgaagagttcgatagcgaggatgccggccagttcgaagccttgcgccaaacgcaaagcgagttcgtgcgcttccttcgccacgtcttcgctgacttcggccggagcgatggtcatgtgcagaatattgttacgatgctcgttgcgcacgatcgggaaggtcacataatccttgccgttaccggcaacgagaatgctcgcttcgaatgcgaaatcgacgaatccttcgagaatgctcggcgggaatccgccaccgcgatcggcacgggctcgtaccttttcgagatcggcaccggatttcagcacggtctggccgtggccgtcgtacccgccggaacgggttttcagcacggccgggtaatggatttcaccgagcgccgcatcaagctcctcaacgctgttgacggccttccatggtgcggtcggcgtgccatgatcgttgatgaactgcttctcgttgacgcgatcctgcgtgacacgcagcaaatcggtgccttgcggggctgcagacaaggaacgcacttcgtcgatggcgtcggcgttcacgttttcgaactcgtacgtgagcacgtcggacttttcagccagttctcggatcgcggtgatgtcgtcgtattcggcagtgacttggaagtcggccacctgtgcggtcgggcaatccggagtcgggtcgagcacgccgatgcggaagcccatgtagcgggcggacaacgccatcatgcggccaagctgaccgccaccgataatgccgatggtggcccctggcatcagacgttcaacacggccattggtttcctcagacaagctgggcattggattcagccaccttttccttcagagagtcacgatattcctgcaaagcattggccaaacgctcatcggtggtgctcagaatgctcacagccaaaagacctgcgtttgtggcaccggagttgccgactgcggtggtggcgaccgggatgccgcctggcatctgcacgatggacagcagcgaatcccaaccggacagcgcatgggaacgcaccggcacgccgatgaccggcagggtggtctgggccgcgaccatgcccggcagatgtgccgcgccgccggctccggcgatgatgaccttcagaccgttggcacgggcactatgcgcgaactcgcccatcaattccggggtgcggtgcgcggaaatcacctgcttcatgtacggcacttcgaactggtcaagcatctcgcaggcatgcttcatggtttcccaatcgctcgccgaccccataatcactgcgacttcaggcttgttgtctgccatcaaggacctccgaaagaatccaaaagaacatgttcttgaacaccgtttactttacgcaatcggctagatgtgcagcacgatttttccgaaaacgtcgccattcacgatcttggagaacgcaagatgcgcgtcgtcgatcgcatatgcggaatcgatgaccggatgcagatcggcatgttccacgaatttcagcaaacgtgcgaaatcctcacgggagcccatggtattgccctgcactcgaatatcctggaagaagattctcgtaagctctgcacccggctggtcgccagtagtcgcgccgcaaatggcgatagttcctcccggacgtacggatttgacggaatgactccatgtggccgcgccgacggattcaatgacggcatccgccttgcgtggcagtcgcgcacccgtttcaaaagccgcatcggcaccgagctgcaacactcgcgcacgcttgtcttcgcttcgtgacgtgacgaacacttccaatccggccgcgtgagcaagctgaatcgccgcggtcgacacgccgcctccggcgccttgaataagcaccgtgtctcccggcttcacattcgccgatgcgaacagcagggaatatgcggtaagccagctggtacccaatgcggcagcctcatcaagattcagattcgcgggcttggcgaacacgttggcgctgggcacctgtgtgtattcggccatggttcccgcataccgttcggacaggatcgagcgtctctcccccggcatcacaccggcgccatcggtaccaacgaaggtatacaagaccacttcggaaccggccttaagtccctttcgtacgggaatgtcttcttccaacacgccagccgcgtccgtgccgaggatcatcggcgtctgctcgtcggaaagccccacaccttgcagactccacacgtcatgatggttcacgctcgccgagttcacacgaatggtggaccagaatggcttggtttcaggctcaggcatagtgcccacttcaagcacggacagcggatcatcataattcgttccggtggcatatacggctttcatgttcacgctcctttgcgaataacggcttttcacgattgcaaacacctctattgtgcctcaagttgagaagactttgcgctcctttgcccgcaaacaccctcgtcggggcatacagtgggatatgatttcgcacttggttgcactgatcgtagggaagggtgattgcgcacgatgaccgctggcattttgagttcgattcacactccggcggacgtacatgccctttcagcccagcaattacgcgatctatgcctcgaaatccgcgccacgctgctcgactacggcaaacaacatggcgggcatatcggctcgaatcttggcgtggtggagctcactgtggcattgcaccgcgtgttcgactcgccccgcgaccgtttcattttcgacgtgtcgcaccaaagctacgtgcacaaaatgcttaccggacgcgccgaagcatacttggaccaatctcgttttgatgaggtgaccggtttcacgaatccgctggaaagcgaacatgattcctttgtgctcggccataccggcacttcgatttctctggcctgcggtcttgccaaaacccgcgatatgcagcgcggcgccgccggcgaaagcactatcggcaatgttatcgccattatcggcgatggatccctgagttcggccattgcgttcgaggggctgaacaatgcggccgaacagggcggtaatctcatcatcatcgtcaacgacaacgaaatgtcgatcgctgaggatttcggcggtatgtacgggcagcttgccaagttgcgtacgtcgaatggcatggccgaactgaatctgttcaaggcattcggcttggactaccgctatgtggagcagggtaatgacgttgacgcgctggtggaagtactgaacgaggtcaaagacattgaccacccgatcgtagtgcatatccacaccaccaaaggcttgggcttcaatgacgaaacggaagccgacaatggttcggatggctgcaatcagaccaatcctcaacctcatgcgggccaatgcgaggccaaccattggcaggatccggaggcctcgctcggcaaaccgctcgacgcacgcaaatattatggcgaaatggccatggcatcgctggaacgtcgtttcgacaatgagccgggattggtggtcatctcccccgcaacccccggatcgaatggcatcacccgagattttcgtgaacgtgccggcgcccactacgtcgataccggtatcacggaagaacatgccgccgcattcgccgcgggtatcgccagggctggcggacgcccggtgcttgcgacttccgccacgttcttccaacgcacgttcgaccagctgcagcaagagttggcattgaatcatgttcccgccacgctgctgattttcggcgcgggaatttccggcgcggacaatacgcattcgggcacattcgatatgacgatgttcgccaatgttcccgacgtgacctgtttggctcccgcgagcggcgaacagatgcttgacatgttggcttgggctaccggcccgtccggacatggcgtagtggcgattcgtatgcccggcgagcagattctcgcacttgaacgtgccgccgatatggcgttcgacccgttgcagcgtgccgaagagcatgatccagccgtcaatattgccggagcatgcccgttcgcccgctatcagatcgttcagcccggcagggatgtggcgattcttggactcggcaataccatgccgttggctgccgaaattacgtcggcactgaccgaaaatgatgaagaacatgctgcgattaccgcaacgcttgttgacgcattgcaatattccacgatggatgccgaattactggcgatgcttgccgatgggcatcgtttggttgttacgttggaagatggccagctagaaggcggatggggtgagaaagtcaccgcattttatgccaattccagtaataccaaggcttctcacgttcgtgtgctgaatttcggcgcagccaaagagttcaccgaccgagtgcctcttggcgagcttaacgaacgttacggattgacttcagaaaccatcgtctctcgaatccgcggtattctcagcgaataatcgatacataagcgaattggcgggaatgatcggtatatctgtggaccattccccgccaatctataaatcagcgatctgtaatcagcaatcactgatcattcttgatggcatccaaagcgggaatcttcacagccttattggccgggccgaaacctgctaccacaccaacggcgatcgaaaacagcatggccaccacaaaaagccaccacggaatcaccgaaatgcgagtcacatcgtcgccgcccataatcgctttgccgatattctcaatgctgaatccacccaaagacgccatattgatgcctatcgaaccaatcgcggaaatcaagcaagcgatcacaccgccgacaaggccgatcgcaccagcctcgcacaggaacatcatgcgaatatcgcgcacatagcagccaagagccttcataatgccgatttcgcgcgtacgttccgacaccgacataatcatggtgttggcaataccaatcgcggcaacgaagaacgacaccgcgccgatgccgcccaaagccaactggatgccccgcgactgcttttcgatctccttacgcgtttgctcaaacgaggaagtctgataaccggcgcccttgatttgcgcttcaacgtcggcaacgtctttgatgtcttgggtgtgcaccagtacctgatcgtaaacgaccttgctcgacgtgttggccttggtgtcccccgatattttggcgttcaacgttttcatatcgtcgatgctcatcacaatgccggaagtgaacgcatcatagttgttggcggaggaatcaatgacacccaccaccgtgtatggcatggtaatggtgggactctcaccactgccggaatcggatggcgccacggatccgccgcccaccttgtggtagtcgtcgggactttgatagttggctccggtaatcaacgtgattttggagttcagcatatcgaagaacgggtcttcgccttcggattgggcgcaaccgtgctcatcgcagtaataaccgcccgcttctatacgatgattgctcggatctgacgcatacttgtcgtagaacgaatacacgaaggatttgcccgccaacacttcgccggcacgcatcggaagacgtccgctggccaatttatagccggattcttccaattgcgtggcgtcgactcccaccacgttgacatattgcgacacgtaccgggagccagctccttgcgtggcatccacactgtatgacatcgttttctgaggaagcactccggccacaccggcaatgctgcggaaattctgcacggcgtcatcgtcgagtttcgcctgttcgccgtcggcaccgctcacgctggatgacgttgccgtggaatgtgaacctccgccgtccgcatatacggtgatgtcgttcaggttgcccatgtttttgagcatctgctcgttctgttcgttgatgccttggccaatggaaatcatgagcacgatcgaacagcagccgacgatcacgccaagtaccgtaagaatcgtacgcgatttgcgacgcagcagattctgcgtgcatgaacgtgcaatatccgaaaatcgcatgctcactccttggcggagggcacggaatcaatcacctgggtcggcgcgtcaatggcaccagccgtattagccgcaccatcatcagcacctgcatgcgaatcggagggatcccaatcccaatcgtcatcctcggcagccttcttcgccttcttgcggcgacgcacaaccaccacaaccacaatggcgatcacggcaacgacagccacggcaacgacaatccacacccaagtcggaatgccttgattttcctgcgggtcaacatccataccgggatcggcgggagccggagcctcagacaccgtaatcttcaccggcgattccttggtctgctgctggccgtcggcatcctcgtacgtcaccttcagtttggcatcatattcgccggccgcatccgcagtgaaagcgaatccgatggaaccagaagcgccggacgccacattgccgatatactgcgtggcttgcgtggcggtgatgccgtcaccctcgatggacgcttcgacattggatacatcccccttgcccttgttcacgtattccatggaaatggtggattcctcgcccgcattgatggcgtctggaagcacgggatcgcccagttcgaaacggtcgggctgcgaaacaggtacggaaatcttgatatccgaagtgttggaattgcgggtgccgccatcgacatactcgtatttgaagttgatatcgatgccctgcgcgccgttcttcgcactcgacagcacctgcatgggcacggtctgggtcagggaatagcccgcccacagcgaatcgtaatagaacgtgttcgtaccgccggaaatagcgaaattctcgccgccgtcaacggtcacgaccatattgctgaccgcgaccttgcccatattctggaaggtgaagccaagatcgaaattcgtgccgaccgccacggaaccgtcgccataagtgaagttggtgatgatgatgttcggcaccggaccggccggctgcacggtggagccgccgttgttgtcgtcagtgccatcaccgtcttcggcgagcgccgtcggcacaatgcaggtcagcgcgatggcgatggacgccatcaatgcgatgagcatgttgatgaattttgcggaatggttgctgttactcatggaatttccttctcttctctgccgtcacgcgttgttcatcagacggtcatcgatgatgcgtccgtcaagtagcgttacgatacggtcggcatattgcgccatattgtcatcgtgggtgacgagcacgatggtttggtcgaggtcgcgagcgaacgcgcagatcatgttcatcacgtcggttttggttttggagtcgaggttgccggtcggttcgtcggcgaatacgacttgcggtctggctgcgaacgctcgcgcgatgccgacacgctgttgctgtccgcccgacatttgcgtcgggtagtggttcatgcgtttgccgagccctactcgtttcagcattttcttggcgattgcctcacgcttgtttttcggcatgccttggaacatcagcggcattgccacgttttccacggcagtcagattgggaagcaggttgtatgactggaatacgaaaccaagatgtttttgccgaaattccgccaattgccgttcattcaaccgagaaatgggcactcccccgatgagcacgccgcctttggtcggtttttccatacctgctagctggttcagcagagtggatttgccagaaccggattcgccgtagatacagcagatctgcccttgcggaatggtgagattgatgcgttccagcgccacgacggtttcatcgagcaccggatattccttacgcagattcttgacttcgatgatgggtctgcgcgtccccgccatcgactcttgcccttcatgatctgtcatagtcttcattgccctcccccacacggcgtcaatacgtctgtcccacaaccgggtttataccgttttccagttccctgcatcccttaggggaacaccccgagaagcacagacccccgtctcacatcctcctaaagcaaccctaactagggtggttttctcgtttcgtgccaaaaacacttcatttcgtgccagacggcaaaatccccgaatctcgcaaaaatagaatgaaaacaacgaggcagacattcggatgacgttgtcggaagcgtcatccgcatatcacacaaggggaaccatcatgcgtcgtcgttttactcaaaccgaggtgtattacctgaacaccctgcccgcggtggagcgagcttccatggaccgcatcacgtactcgaaggaatttcaggtgcgttgcatggcgcaatatctgcgcggcaacggtcctaccagtattttcgccagcgcaggtcttgatccgaaaatcgtgggaggcaagcgcatcgagcgcgcgatcgcccgttggaaagccgatccgaaaatcatgcttgaagcacagacgttggcaaacaaatccgattccgggcagcgcgatctgctggtgatcacccaagccatgaccatcaaatggctggaaaagaaagtcatggacctgcagaaacagcttcacctgcttgaatcacatgcgatgaactgctcactgccgaattcaaactccagggaaggtcttgtcagcatggcgtgacatacgccgaaacgtatgacatgcgtgcgcaaaacacggtcattgccgacaggccaatcacatagacgtgcgttgcggtacggcaacgcgccaaacaataatccctcctttcaccgccgcgctctccgtcacatataagcggccgtctcgaaaggagggattcttcatgcctctggaacgtcagcgaaacatcctcgccccgtatcgacactctgcatttcgtgtataaaacgcgctgtccttactctgcatttcgtgtaaatgccttaattttcaaggagtacaccatgctcttcaggcgcaaggcatatcaaacactcatggcttggaaaagcccgtcgaatggcaagcgcgccatgcttattgagggagcacgacgtgttggaaaaagcactttggcgcaagaattcgcacaacacgaatacgaaggtcatcttgtcatcgatgcagagcatcggcacggctattttgcgactatttcgcagcttcgtccgcggacatcatggcctgggtgatctggtcgcgcatctcgttgaaaccgccaggcgtcgaagccggcaacaccaccgtcttcgcattctgcgacgaggcgagattacgcatggtgtcgagatactggttgaacaacaccacattgttcacgtcgttcacgttcatgccgactgcctgcagactcttgatctggtcgacgataccattggcgatctcacgacgatagttggcctggccttcaccctgaagacgggtcttctcagcctcggctgccgcctgggtctcgatctgaatacgctgggcttcggcgcgctgacgggtggcctccttctcgcgctgggcagcgttgatggaatccatggcgttcttgacctgcggactcggatcgatggcagtgatcagcgtcttgaccacagtgaaaccgaagcgggacatttcgttgccgacggtcttctgtacgtcaaaggccacatcgtccttacgggagaaggcatcgtccaaagacaatgcaggaatggcggaacgcagcgcatcctccatgtaagaacgcagctgaccagccggatcacgcagctcatagtatgcggtggccacattgctcgggtcaacacggaactgagtggacgccaccaccgtgacgaacacattgtcaagcgtcttggtctccaactgcacattaagctgattgacgcgcatgttggttttcatggcgatacggtccacgaacgggattcgaatatgaatgccggcgaactgcaccttgttgaatttgccgaaacgctcaataatataggcctgctgctgcggcacgataaacaacgtggacaggaacaggaacgcgacgataagtgcaatgacaaggagcgtaataaggaacggcatgacattactcccttctttggttttctctcgaaagcctgttgattgacggctttccgtaggttctgcaaccattgccgaacccaagcaaaaacttaccaaagaatgcaatcacgtgcagacaatgtccgcgagttgggcaaagtccattcggaagacggacatcgaccgtccggaagccgacccacatacgtctacgagccgaacaggagacaattctccttgtccggctcgtgagatggcatacgcaatgttgaatcagatcaggccgagttccttgcatttggcttgcaactgcgtggccgaaggctccaccagccatgagccatcggcgaaccgaatcacgggaatatgctgttgtccgctgatcgcaatggccttctctgcagcaccatcctcatgctcgatatcatgaaggctgtaggcgaccccgaaacggtctaatgctgccttggctcgatggcagtcgccgcaccagtcggctccatagaaatcaattgccgcattgtcaatcataaaatcactccttacgaggcattaatctcatcaaatttaggcgatgcctcaagcaacatcttcgtatacgcatctttagggtgtcgtaacacggaaccgacagctccatattcgacaagatggccgtctttcattaccgtcacctcatccgcaactttctgaacaatgtccaaatctcatactcatgccccgacaatcccggataatgcacggattttaccagcggatgcagcaacagatagctggagatcgcacgcgcgttctcctgctggcggtccatgcgcagggcgagcgtctgaataccacgacgcaccgaatcgcattcgttcggcgcaagcacgccacccaaatgattctgcgcgaagtagacacgtttgcccaacccgtcgtccttgaccaccacaagaccggcgttgacttcggaatggccggccagatacttggtagcggaatggatgacgatgtcggcaccttggtcgagcggcagctgcagatacggggtaacgaatgtgttgtcgacaatggaaatcgcaccatagcgatgagcgatttcagcaatcttcgtcacattgttgacctgcagcaacggattggtaagaacttcgaaatacacggccttcgccggacaaccatgcgcgggtcccttggcggagtgcccggaaacagcggcatcaagcgcttcgtagtcggcggattcacggctccggtgttgttgtcgttgaccggcagtccgtggacaaactgagtgttgaatctggtcatggtgcgcaccccctcgggttgtggctcattgccgcatgccattcacgcggtcactggtacccactaaaccgcatcctgcgtttcaacgcgcgccgcgccttatcaacgtttgttatagaacgcgcgaatcgccataacgttttcttgtaagcggctatcaaacggcggagatgcaaggcatcgcaccgcaatcgcaaaaacgtcgcctgcataaggagcgtgtgtcggtttcctaagggaaagacgtttcgatggcaattggaggatgggacgtccacaaccgatcgaaagacgatcgcaaacaatcggaggaaaataggaaaagcgattgtgcaagcacacaatcgctcatccatgcaaaaaggctacgtaggaaaaattacgctagcacagcaaccacccggcgcacagcctcacgcaactggtcctcggatttaagcaggctgaatcgtacgtaatcctcgcctactttgccgaagcatgtgcccggcagcgcggcgacggccgcacgttccaacagcgtgtcggcaaactgttcacccgtctgaccctcaggagcgtgtacccaagcgtagatgccgccgtctgaatcgaacacatccaaaccggcttcacgcaatccacctgcaacgatttcgcgacgagacgcataccgttccgcaagttcggccacacagctctgatccgacagcaacgccgcagtgcccgcgtcttgaatgctggacgtaaccatggaacccatctgatagtggtactgcttcacatgagacacgatgtcgtcgttgcctgcgatgaaaccggcacgccagccggccatcgcatacattttcgacagcgaacacacttccaccgcaacatcgaacgcacccggcagtgacagtatgctgatctgctgcgcatcgacgcccaatcccgcatatgcgaaatcctgcacgatcgcgaaatgatgctcatgagccaaatcaacggcacgctgcagaaactcgcgcggagcctgcgcacccgtcggattgttcggatagttgagcaccagcactttcacacgatcccacacctgtgcaggaaccgcgtccaaatccggcaggaacccgcgctccggtaacgatggcagcagtatctcctcggcacggctcatcaccgtcatgcaatggtacgaagggtaatatggatccgcatacgccacagcgtcgcctggggaaaccagcacggcgaacaacgcggccaaaccatcgaccgcgccctccacggcaaaaagctgggttttccaatcaacctcaacaccgtacgtattgcgataccactgttcggcagcccgcagaaaactaggcttgccatcgaatggcgaataccgggcattggccggatcgtcaaccgcttttttggctacttctcgaatgaaatcagcaggaaacgcgtctggattgcctttggccaaatcaatcacatcagccccaccggcgaccgcggcagccactttgcgatccatatcggcgaacacattcggcggaatcgactgcgccaccgtagtgaacacgacaggagaaacatacgaagtcattcatcaaccctccctatcatctcgcgactgtatatgcgcacattcacgcatatacgcaaccatcagtgcgtcaccttgcgcgcgaaccaatcgccaacccactgaatgatctgcacaatgacgatcagaataataacaatcacaacaagcacgccggtttcgtaacggttatagccgtattgaatggccatatcgccgatgccaccggctccgatggtgccgaccattgcagaatagccgatcagcgaaatgatggtgagcaccacgccgcgaataaacgacggcaaagcttgcggaaacaccgcatccacaatgatttggcgtgtggtagcgccagtggagatggcagcctcaagcaggcccggatcaacttcggagaacgcgctttccgcgattcgcgcgaagaacggcaccgcggcgatcgacagggagattgcgccaccggtcggcgtgtaagggtcacccaaaatcaattgcacaaccggaataagcaccaccatgagaatcaggaacggcagcgagcgaatcgcgtttacgatgaaccctacaataacgttcagcgcatgattcggcgtaaacaagcggttttcagtcaaatacagcagcaatgccaccagcgtgcccagtaccacgccgataatcgccgacaccacaaccatatatgccgtgtcgatcagtgcttgcccaagattgtcttgaaggatttccagagtttcttccattgttctcacgcctcctgattatccgcagcttcggcggccacaaccagctgcccacgatcaagttcccgatagctgaatacatgcgttctcaacgtgttcaacgcctgcagcagcggctccctcgcgccggaaacaagcacaatcagaatgccgatggcctgcgaaccgaaatattccacattcgcatgcagcacgtcgatgctcacaccgtaatcctgcgcaacctggctgatgagcggctcgagtgccgcatcgcccttgtatcgcagttccacgatggtgccggccggcagcgatggcaccaattgcggtggcacggcaatgccaaggtagcgttccaccaacgctttggtggtcggatgtttcggagcgctgaacacgtcgaacgtgttgccctgctccactaccacaccgttttccataacggccactcggtcgaaaatttgcttcgccacgtcaagctgatgcgtgatgaacacgatggtaatgcccagttcgcggttgatgcgctgcaagagtgtcagaatgccttctgtggtttccagatcgagtgcgctggtggcttcgtcgcacagcaggatttccggcttgttggcgagcgcacgcgcaatggacacgcgctgcttttgcccgcccgacaggcttgatgggtagctgtcgatcttgttttccaaaccgaccagtgccagcagttcgcggacacgttccggccactgcgctttcggatatccgccggctttcagcgcgaattcaatgttcttgccgaccgtaacgttggtgatcaggttgaatccttggaaaataaagccgattttcttgcgcaggtcactcaattggctgcctttgagtgcggtgatatcgttgccatcgatcactacatggccgcctgttggtcgttccagcagattgatggtgcgcaccaaagtggatttgccagctccggaaaaacccacgatgccgaaaatctcgcctttttccacgctgatgttcacatgcttgaccgcttcgacggttcgcccgccttcatgaaaagtcacagacacgtcgttgagttcaataacgctcatggttcgttcctcgcttcattcgagtacttgttcaagttcgttcaatacgttttgttcgatgaatctcgtttgcacataaggcccgtatgagttcttcgattcatacgggcctttgtgttaccgcacgctatagcgtcaccacgtggtcggcttgccgaaatccttgaattcgctcttggcgatggcgtccttgaatttctggctggcaagcagtttcttgacagccttgccgaagtcggaatcgacgtcctgggtgcggactacgaacacttcgatcacgccatcatcctgcttttccatggcgagcgcgtcggcaggcttcaaatcagcagcccaagaatagttgcccggcaccagagccacatcaacggtatccaaggaacgggccagctgtgccgcatcaatcgttttgattttgaggttcttcggattggatgcgatgtcgttgaccgtggccttggtagcatcgacctcgcccttgagcgtcaccagaccctgctgctggagcacgccgagagaacgcgccaggttagagccatcgttggcgattgcgaccgtagctccgtcttcgatgtcatcgatggacttgtacttgttggaatagatgcccaatcccaaagtcggcgtctgtccaagggaggtcaggtcgagattgttgtcggcggtgaacttcttcagataattgccatgctggaaaagattcgcctgaatggaaccggatgcaagtgccttattgggctgcacataatcgttgaacagcttggttttcagtttgaaaccgtcatctttcagcagcggcgcgataaccttgtcgaccatgtcgccgtatggtcctgcacacacgccgacggtgattgtggtggttttgcccttcgtggtgttcagactgttggacgcggatgcgctgttgccggaaccgcatgccgcaacggaaataagtgttgcagcggcgagtactgctgcggcgattcgtttgatgccgtttggcttcttgaaaatagcgatagtcatggttgttttccttctctcacttgttttgaaaaaatacggttattccgttaccggcttactggcttcgacgtcggctttggcctgtgcgacgatgcctggattgtggatggcgaaggcttgttcggcgagatgcacttcgcgggttaggaattcgtgcagcttgcattcgtagccatgctcacgtccgactttggcgatatagccgttgatgtagtcgacttccgtcggacgtcccttagtcaggtcttgatacatggacggatagtgcagcggatgcgccacgcccgcggtgtgcagaatggtttcgacttccgtttcgcgcgtgcccaacagttggtatccggctgcttcggccgcgctgtaagcttcgtcgaccagctgttcggtgagccagcgcgcgtcgggatgcgcatggaattcgccgaagcggatctggtacatggtacacagcgtgttcagcaccgagttgaatacgattttcgccatgcacatgccgatgaagttgtccacgatggtcgggttgagtgtggccgttgcgaaatcctcatacagcgcctgctcgtgtttgcgcacctcatcagtcacatcatccgcgtaggcacacaggttcatggccttggcatgtgccccgccggtgaagttgaaatcgccggggccgtacacgtaggcaccgatcaatgcggtgccgccgtaaatgcggtctttggagaagtattcgttgagcttttcgaagtgtccatagccgttcatggcggagaacacaatctgcttctcgttgaacaggtgggcgcagcgcttgagcacgccgccaagctgcatctgcttgaggaacacgatccacacatctggctggccggcgtattcctccgggtagtacacgttaatcggcacgagatggcggtcttcaccatcttgagacacgtaggcgccgccttgctcgcgaatcttctcgacgttcggcttccacgtatcgatgaaatcgacatccttgtgcgcgaattcctgcagtagcacaccgtattggatacccattccgcctgcaccgatcactgcgtacttcacgttccgtgctcctctctcgtaaaacatctcgcttgtttttcaagcagacaatcacaagatatcggaaaaacaacatggcaacatcggcgtggctatatacgctttttatggaaggcgcgaatcgtaataattgttttttatatagcgttatcagcaatcatatatttgtatgtaaatatgattatctgaatatagaaaaaccttccgcctaaagcgacggaaggttcaaaatatttagtttgattaactagttatcagtcgaccacacctttttcgaccacgatttcatcaggatcgacttcgtcgccatacaccggcttcagtgtctcctcataatccttgtggaagaagttttcatcgccaagcttgtcgatttcgtcgttgatccagtcaagcaattccttattgcccttctgcactgcggcagcgatggtgtccttatcgcccagttcggtgataccgaccttgaagcccttgttggacttggcccatgcgagcacctcggtgttgtcggtggagaaggcgtcgccacggccgtcgagcagcgcgttgtaggcatcggcgtactggtcgtacttctgcagcttgatgtcggggtagtttttctcgaagaaggtttcggcggtggtgcccttggtcacgatcagggtcttgcccttgagctggtcaacgtcggtgatttcggcgttttccggggaaacgacgcccaacgccaccttcatgtacggcttggcgaagtcgaccttctccttgcgctcgtcggtgacggtgaagttggccagcgtgatgtcgaccttgttggaggtgagcacgtcgactcgggcggcggcgtcaacggaggtgtattcaacgtctacgccaagatccttgcccaagcgctcggcgaagtagacgtcgtagccggcatagtttccgtccttgtcgacgtagccgaacggggccttgtcggagaacacggcgaccttgagcttgccggacttcttgatctcatccagagtgcgggcggtggcgctgctgctggaactggaatcgctacccgtggagccttcgtcgctcggagtggccgcggacggaccgcaagcagccacggaggctgccatgatcaacgcggccgatgcggccacgatgctcttgaatgttttgttgatgattgatgcggtcatggtttctcctctcttgcaaagatgactgctatcaaaatcttgggtttcgccgattctcgccatttgtcttgattattcggattgatcggcggacttgcggtgccggtcgaattcaaacgtatgcaggaactgcttggcacgttcggtggtcggattggtgaagaatcgttcggcatcgtcggaccgttccacaatgccgccatcttcaagcaggatcacctggtcggcgatggctcgcgcgaattgcatttcgtgcgtcacgatgagcatggtctggccggaatcggcgagttcgagcatcacgtcgagcacttcgcgcaccatttccggatcgagcgcggcggtgacttcgtcgaacagcagcacttccggatgcaggatcagcgcacggcagatggccacgcgttgacgctggccgccggaaagctcgtgcggccaggaatccttgcggtcggcaaggccgacgcgttccagaagcctgatcgcctcctgctcgacttcgcccttatctcgcttctgcaccaaggtcggcgccagtgtgatgttgccaagcacggttttgttggggaacaggtcgtagctttggaacaccatgccgacgcgggtgcgtagttcgctgctgcgcttgctgcgtccagcggactcagtgcccggcttgcccgtttcgatcacttcgccgttgagcgaaatggtgccgccctgaatcggctcaaggcctgcgatggtgcgcaacaacgtcgatttgccggaaccggaaggtccaacgatcacaaacaccttgccatgcggcacgtcgaacgaaatatcgttcagcaccggcctgtcggcattggcgtactgcttgaccagatgcgcaatcccaagacttgcttggcctgcctggtcctgcttgcccgctgcgtcagtcatgcgaccacctcttttccagtcggcgggccacgatggacagcggccagcacacgatgaagtacatgaagaaaatcaccccgtagatccacagggttccggtcgggtattggaaacggttcgcgtcgatgatctgttggcccactttgatgacctcgaccacgccgagaagcacggccaacgacgtcgttttcacgattcgtgtcgccagattcaccgaagccggcagaagcctacgcaacgcttgcggcagaatcactgtgacgaacgtctgccagccactcaacccaagcacatacgcggactcatactgggctttcggaatcgactcaagcgcgccacgcaccaaatcgcccaattccgcgccgccccacagcacgaacacgaacacgcatgcgccggtcgcatccaaattccaattccacgcacgggcgaaaccgtaaaacgcgatgaacagcaacgccaattgcggcatgatgcgaatgaaatccaaataaatcctggtcagcacacggatgacgggatttttcatcgtcatcagccagccgacgaccaatcccacaggaatggaaagacccaccgaaacaccggcgatccacaccgtaacccacaggccctgcagcaggcgcgggaacacgcccggctcgagcagaatctcagcgccgctcatagtcgaacctccgttccagccaagtgccgaacaatgagatcggcagcagaatcaccaagtacgcgacgaccagcatcagcaacgattcgtacgtgctgtagtacatgccgatcagatccttggccatgtacatcacgtcggcgagcgcgatggccgacacgacggacgattccttgatcaggaagatcacgttggccacaatgcctgggatggacgtgccgatggcctgcgggatcaccacgcggctcaaggtctgccattggctcaggcccagcacgtatgcggattcgcgctgcacgttcggaatggtttcgaggccgccacgcatcgcttcggccatgtaggagccgccgagaaagccgagtcccacgatcgcgcattgttccgcggaccagacaacgccaagcttcggcagaccgaaatacaggaaatacagttgtaccagcaacggcgtgttgcggctgagttcgatgtagacgcgcacaatctgcttcaacactgggatgcgtgcgatttcaatgcccgcgcagatgagaccgaccacaatcgaaagcacgatgccgaatacggaaatgaacaacgtcatcgccgcaccgttgacgaagaacggcgcgtagtgcgtcacgaatgtccagtcgaacacacgcgcctcccctctttctcgctaggttttcgaatgttctgcggatcgtttgaagccttctcaggctgtttccaagctttagccttgaacgcgccccatcgtaccgcgcgataatcacggaacaggccacgtcgttatcggtttttcgtataagcgtttatcaaccttcaagaaatgcttcccggtaatccttgccacagtattgcacgtcggcgctttccgccgtcagctcatatcgaaatgtgaagattgggtatgccttgcgagagagtatgcacatgctcattcgacatgcaacgatggaggatttggacgcgattgaggctgtggaggctgcctgcttcccgcctgcggaggccgcaacgaacgagagcctgaccgcacgcgtcgccacatatccggaacatttctggcttttgatcaacactgacgccgatgacgacgcctgcttccccgcttccgtggaagatggcacgttggttggtttcgtcaatggcatgacgaccaatgagaaagatttggctgatgtcatgtatgaggatgtttccatgcatgacgagcagggtgattggcagatgattttcggcgtggatgtggctcccgtctaccagcatcgcggttgcgccagctatctgctgcgtcgtgtgatccttgattcgacgattgccggacgcaaaggcattgtgctgacttgtaaggaacgtcttgttggcttttactcccgcttgggattcatggacgaaggcatgtcggcttccacacacggcaatgtggcttggcatcagatgcgtctgacgttagcccacaccaccggtgagtccaatgattccaacgcctccggcgacactgatccggatgcgatcaccatggagatccccgtcgtgccacttactgattgacgcgcgtgtcgcagcccgcccaaccaaccgcgacacgccgacgatttgcattccgccgagaatccacgtaagttagcactcgcttcgggcggttggcgcagaggtagcgcacttccctgacacggaaggggtcacaagttgaaccgctcgtgacgcatagtccaagctcctgcgagacccattcgatcccgtccaaaccctagtggattccccaatccgccttcgcagtaatacttcatgtgaccgtcgaacttatccccgaacgcgtcaatgggctaccgcctggtctcaagcccatgagacactaggaatcatgactacagttatcatgcgcaccactgaaggcgacatcaagatcaacctgttcgatgacaagaccccggaaaccgtggccaacttcctgggcctcgccaccggcgaaaaggaatgggccgacccgttcaccggtcagccgagccacaagccgttctacgatggtctgaccttccaccgcatcatcaaggatttcatgatccagggcggctgcccgctgggcaccggcactggcggcccgggctacaacttcgatgatgaaatcgttccaggactgaccttcgatcgcccatacctgctggccatggcaaacgccggcctgcgccgcggcatggacggcaagatccacggcaccaacggctcccagttcttcatcaccaccgtgccaaccgaatggctcaacggccatcacaccattttcggcgaagtcgcggatgacgagtccaaggccgtcgtcgacaagctcgactccgtggcaactgaccgttccgatgctccgctcgaaccggtcggcatcacttccatcgaagtgctgaagtaagtttcgcatcaacaagacttacggcaaaacaatgaaaagcccctcgcgtgaggggcttttcattatctccgagagaatctacagcagttcagatgagtctcacgaccgcactgatcgtgtcagattttgcgtaagcgaggttcggcggagtccttggcaccggtgatacggtacacatcgaatacaccttcaatcttgcgcactgcggcaagcaaagtattcaaatgctgggggtcggccatttcgaagctgaattggctagtggccacacgatcggttcccgtggaaatggagccggaaataatgttcacgccgtgatcggaaagcacgcgcgtcacgtcgctcagcagatgcgggcgatcgagcgcctccacctgaatcttgaccatgaacacgcccttggtactcgtccactgcacgtcaaccacacgttccggctgacgcttctgcaagtccagcatgttctggcagtccacacgatgcacggacacgccctgattgcgggtgatgaagccgatgatgttgtctcccggcaccggcatgcaacatcgggcgagcttgacccaaatgtctcccacgcccttgacggaaatgcccagcgagctggtggtcttcttggtgcgttccacctgcttgagcggcagagcctcctgctccacctcctcattcacctcgtcgctgcccgcatcacggaccagatgcgagatgacattctgcgtggaaatctgcccttcgccaatcgccacgaacacggcttcggcattggcgagattcagctcatcagcaacaccgaccaacgcctcgggagtcagcagagtcgcaatcggaagattgcgcttgcgcatggctcgtgtcagctcgtcacgaccttcttcgatggcctcggtacgacgctccttgctgaaccattggcgaattttgttgcgtgccttcgggctcttggtaaagctcaaccagtcacgagacggaccagccgattcggacttcgacgtaagcacctcgacggtgtcgccgttttcaagcttggtgtcgagcggtaccagacgtccgttcacgcgggcgcccatggtacggtggccgacttcggtatgcaccgcgtaagcgaaatcgatcggtgtcgcctcggcaggcaacgatacgatcttaccttttggagtgaacacgtagacttcggcagcacccagatcttccttcagggagccaaggaattcattggaatccggggtctcactcgtccagtcggcgagctgctgaatccacttgagattgtcagcctcgctcagctcctggttctcgccacgtttacgatcggacttatcgggcgagctcagcgcacggccagcttgaccgttctccttgtacttccaatgcgcggcgataccgaattccgcacggcgatgcatgtcccacgtacgaatttgaatctcgacaggcttgccgccaggacccaccaccgtggtatgcaggctctggtacatgttgagctttggcatggcgatgtaatccttgaaacggcccggaacggggttccaacgcgcatgcaccgcacccaacgcggcatagcaatcctgaatcgtgtcgacgatgatgcgcacacccaccaaatcgtagatattcgcaaaatcatgaccacgtacgatcatcttctgataaatcgagaaatagtccttcggacgtcccgttacgtacgccgtaatgttctgttcgtcaagatcttcgttgatctccgcgagaatctgcttcaaatacacgtctcgctggcctgcgcgacgggccaccagcaccacgatctcgttgtagattttcggatagagcactttgaagctgagctcttccaattcggttttgatcgcgttcatgccgagacgattggcaagtggcgcgtacacgtcaagcgtttcatgcgctttcttctgcgcgctcggagttttgacgtaacgccaagtacgcgcattgtgcacacggtcggcgagtttgacgaccagcacacgcacgtcgcggctcatcgcgaccaccatcttgcgaatggtttcggcttgcgcggaatcgccgtattccatcttggaaagcttggtgacgccatcgaccaaaccggtcacggtatcgccgaactcggcgcggcactcatcgagcgtatagtcggtgtcctcaaccgtgtcgtgcaacaggccggcggccacaaccaacggtcccatgccgagatcggcaagaatctgcgccacggccaacgggtggatgatgtacggctcgcccgatttgcgccgttgcgaagaatgctgcttgaccgcacgctcataagcgcgctcaagaatgcttatgtcctcatcgggatgatggtattcgcacatcttcaggatcggctcaagcggatcaagcggattcgtgctgatctcgcagcccaacattcgggcagaatgaacctcacgctcaacgtcacccatcgtccacctcctcgctcgcaatgctccctatactacccgcgcctcaccgtgcatccgaggcatccgaccgcgtgttgcacggccaaatacccccgaaaccattgagatgtcagcgtttgccgattcctctgcgactaagccagtgcgttcagctcaggaagccacgcctgtggaaccaaacccacgctcagcgcgatccgacccaggcagcgtttccgcctcgatgaacttcgcttcgacgtaacgctgaataaccagctgcgcgatacggtctcccggatggaacgtcacggtgtgttccggatcaagattgatcagcggcaccttgatctcaccacggtaccccgcgtcgatggttcccggcgcattgagcacagtcacaccctgcttgacggcaagaccggaccgtggatgcaccagagccacgtaacccgctggaagggcgatcgccactcctgtaggcaccagtgcccgctggaacggcttcagcgtgacttcctccgtagtgcgcagatcagcgccagcgtcaccggcatgggcataatacaattccgccggatggtcaggatccagcgactttaccagaacctcgacgttttccggttcgttatatgcttcgtcgaacgccatcaggcagcgcactcctgacacaccggctgaccgtcgtcagtggtgtaggcaagctggctacggtgcttcaccaggaagcattcggagcagatgaactcgtcaccctgcataggaatgacggtcaccgaggcgtcctcattgctgaggtccgcaccgggcagctcgtaatcttcggcgatggcgttctcgtcatcgtccatatcgttggaagtgttctgggagctcttgcccaaagcctggagcgactcctcgtcctcgtctttgttgcgcggggaatcataatcctgtgccatcgagattcctttcgtcatctatggtgcttatgcgccataggatacatgacttttaccccgcataggatacacgaatcgaaatactcgtaaaatccgacacgtggggcacaatggaataaacagaaattcttgaaggaaagtggtgtgttgtgcctgggaattcactcgaggaagcgcggttcgatcatgtcagcgacaccggtgaactcgtctttgtttcaggtgccggaaagttcgctgtaaagatcgacgaagcgcttgaaagagccattttggaggccaagcagattcgttccgaagtacaggaggaacagaagacacgcatcccacccaccctgccgatttcgcaaattcaatcgttgattcgcgctggcgccgatcccgcgcgtgtcgcggaaagatattcgttaagcgaagcgcttgttcggcgtttctcggcttcggtcgaaacggaaaagcaatatgcgatcgagcagtttctcgccgttccagcgccgaaggaaagccgcgtacgcacgctttccgaactgatcgaacgcacttttgcggcagcgcgggtgcgcttggaagatgtgacttggaaggccaccagacttggcttggagccttggaaaatcagcgctcagttcgtctcctccggtcacaatgtctgcgcggaatggtcgtggaacatgcacgacaatgccgtaagctgcctgaattccgcagcacgaaaactcattggagaacaggacacgtcgaaagaaggacacgccgagaaacacgccgatgaaaattttctcgtgtcactgaatcttcccggaaattccgcacggtcggcgcgtatcgagcaaacggtgtccgcatggaacacgcccgagccgtccatgcctgcggcccgtcccgcggcagcgccttccgttccgatcgcgccaatcggcggcgtgtctaatgaatccgacacgcctgacacgccgaacgcgccagccatcgcatccgacttgcctctgccgagccgaccggagaaccctgctgcaggagccaatacagccagcgcaacaaacaccgacacacgcaataccgttccatccacgccggagcctgcttcgaacatggcgaacgagaaccagacacttgacccgcatagccagaacaccaccaaatcgaagcggcgtgccggacgttccgccgtgccaagctgggacgaaatcctgtttggcgactgaagttaggccacgtcgatcaagcagggaatgtcggattcgagcatggtgagcgacccgtgcacgcttggcaggtgcatcgccttttctgcttgcgtacgtgagtccacaatagtgacggctttggcggccgatacgatcacatcgccgatcatcggttcgacgcgagcttccaccggcccatacacgccttcatccattgcctgcgagcgcgtgcgcacctgcgcacggtcctccagcacgctgcgccatcgtgtggcgatgtcttctggattctcgccttgttccgcgtagagcatgacgcaacgcggttcaccgccgacatgggcgacgccctgcatgagccgctgatcctgtgcaatgtcaatcacggattcgggatcagtggtgatcataccgtggtccgccacaatcacaatcaatgtgcctttgggcacgctacggcgaagaaggccgagttgcccgtcgacgcgctcgtacgtgccaatccatttgtcggaatcccaaccgtaattgtgcccgaccttatcggtatcacgcagatacaggtacgtcagtccgggcgtttttgccgcttgcgccgcggctgcaatccgttttcgcggatcatcgttggaaatgtagtcgctgccccgtaacgccgcctgcgtcaacgcggaaaaggcgaatttcggcagtccagaactggtcactcgaacatcctgcgcgctcagccgttcgaaaatggtcggttgttgctgcaattcaagcggaggaattgcgtttttgaaggaaatcagctggcatatttcatcggttttcggattgagctgcgtgtagccggtcataccggtcataccggggcatgttcccgtaccgaaggtagacatggctgcgacggtggtgcttggcatgcatgttgcgatgggacgttgattggcggtgtcgttcatcagcgcacgcaagtagggggcatgtcccagcctcatgttgagattccagtagccgagaccgtccacgagcgccacaaccacggaagtcgcatcgggaatgccgagcgctccctgcaaacgcttcggatcaggatggactgccgttggcatggggtatccgatggcgttggaaacagcaggaagtaccgatgacaggtgcaacgctcccccacgggttccttcagatgacacgtcatcgccgtagcatgccggttcggtcatggtgagcagctcttcgacgcttggcacttcaacactcataattcccattcaagcaccgcggcggtaccggctggtagcattgctaggttgattaccattacttttccgtgaggagattcaccgcatggtgtcgcaccgcaaaccggcaaaaccagcctttgacccgcgtacggtcaaagagaacatcgtcgaaacaccgttgaatgaggagatgagcaagtcgttcctcgaatacgcgtattcggtgatctatgcccgcgcgttgcccgatgccagagatggtctgaagccggtgcaacgccgcatcatctatcagatgggccagatgaatctcaatcctgatcgtccgtatatgaaatcggcccgtgtggtcggcgaggttatgggcaagttgcacccgcatggcgactccgccatctatgaggcgatggttcgtcttgcgcagccgtttgcgatgcgattgccgttggtggatggccatggtaacttcggttcccttgacgacggtcctgcggcctcccgttacactgaggcgcgtatggcccaggcagcgcttggcatgaatgccaatatcggtgagaataccgttgatttcacgccgaattacgataacaagctgcaggagccgactgttttgcccgctgcgattccgaatctgctggtcaatggcggttccggtattgccgtcggcatggccacgaatatggcgacgcataatctgggcgaggtggttgccgcggccaagcatctgatgcatcatcctgatgccacgttggaagagcttatgcgctatgttccaggtccggactggccaagtggcggcgtgatcgttgggcgtaacggcattcgtgaggcgtatgagaccggacgtggcgcgttgaccacgcgttcagtgacgcatatcgaaaatgtgacggcccgtaagaaagccatcgtcgtgacggaactgccgttcatggtggggcccgaacgagtgctggaacgtatttccgagggtgtgaagaatcgcaagctggaaggtatttccggggcgatcgacttgacggatcgtcataacggcactcgtcttgtcattgaaatcaaaaccggtttcgatccgaacgccgtgcttgcgcaactgctcaagcacacgccgttgcaagacaatttcactatcaacaatgtggcgttggtcaacggccgcccgcacaccatgggtttgaaggaaatgcttcaggtgtgggtggaccatcgtcgtgtggtgattcgccgtcgtagcgaattccgtaagaagaaggcgttggagcgtctgcatttggtcgaaggccttctgcttgcgatggtcgacattgacgaagtgattcaggtgattcgttcgtctgacgatgctgatgccgcgaagacgaagctgattgccgtattcgatttggatgagattcaggcacagtacattcttgacttgcgtctgcgtcgtctgacgaaaatgagccgcatcgagcttgagtcggaacgtgacgatttgaagcaacgtatcgaagagttggatcgtattctcgcttccgccgaagcgctcgacaatgtggtgatctccgaaatggatgaggccgtcgccacgtatggcacgcctcgtcgaaccgtattgctggatgaggatgccgatggtaagcttgtgcctgttgtggcgcatggtgatgatggcgtgtccgcttcggctatggccgcagcccgtgccgccgcaacggtctcttccgcagcagctgatgttgccgcagccgctaaggcagcgacgaaggccggtgaagacaatgcggccgctgtggcattgcagattgacgacgaaccatgtgcggtgatgctgtcggccacgggtttgatcgcgcgaacctccgaagatgcgttggaacgttgggagaatcgttcttctgccgacaaacgtgtgaaggacgatcagattatttcgattttccctaccaccacacgttcctcatatggtttgatcacatctgccggccgtctgattgtggcgcatgtcgtggagttgccggttgtgtctgcggatggtccgctccatgtgactggcggcgtccatgccgaagagttgatcggtatgacggaaaataccgatccgattcgtggtgaacgcgtgattgctgcgattgccatgccaactgccgatgattccggtgatcatgccgcagaacctgctcctcttgcattgggcacgcgtaatggcgtgatcaagcgttggaatcgtgagtcgcccaccacgatggattcatggagcatcatcgatttgaaggatgacgatgaagtgctggctgccgctgaagcgcgcgatgaggatcgactggtgtttgtttctaccgactcgtctttgctgacgtttgatgcgaagaacgtacgccctcagggccgtaccgcgggcggcatggcaggtatccgcttggctgaaggctgctcggttgccgcgtttgcggtgattcccgccaacaaggtggcttggaattacgaggagggagacaatggcctgttctccgcgtctggagccgtggtgttgacggttgccggcgattccgaagcactgccgggcacggagaatggttcagcgaaggtaaccccgttggagatgtacccgacaaagggtcgcggtaccggtggcgtgcgttcgcagcgtttccttaaggggcaggatacgttgatcctcgccttcgtgggcacatatccggtacatgcttccacggagggcggtgccggtgtggaattgccgaagccggatatgcgtcgtgacggttctggtacggaactttccgcgccaatcgccatcgtcggctgacccattgcaatgtgacgtgcccgcgttttacgaagtttggaatcgtttaggattccgttcgtaggacgcgggcattgttgttcctgcgttttcgtccgcgctgtcactatgcattagcgatgatgatctttttcaacagtaaagtttcatgccttgcggactatcgacgaaacctgcggcgtaaaggatttgccggtattcattgcgtgctttcaataatgttccgttcatttcgctgaagctgatgctgccgctgggttggcgctgcaatacgtaggcaagttcggcgcatgacggtcttaatattgtttcgtctgcggtgaagctgacaattttatggctttttggcacggagaacagtaccggttcgccttgtttgagcacaatgatggaaccggatctgcgtgctggtttgaggtaatcctgttctggccaggcgattgcggaaccagtgagattggcgggatcgatcacgtcgagcgcaacgcaggattgactgtgccattgcgtgtcgctgcgcagcgcgtcgacggtgtctcgttccgcgaattgtgccgcgccaaaacctttcacgaacatgcctcggaccagtgtgccatgttcttccattcgtttgagtaccggatagagcgctgaaaatcctccggcaatccgttccttgtcaaccaaaggagcggcaatcacgccgtatcggtccagtaatgagtcgatgagcgccagctcacgctcctctacacttgccgtatgcgccatgccaatgccggtatcgctgttttcgagcatgcccggctcgataacaccgtctagtggtttgtttggcataacggttcgcccgtcgccacaagatactgcggaccataatccactcagcgccaatggtgttggaggacgcatggtgacgcgtctacgcgcggcacgacggggtgcgcgaacggttttgcctccgtgcagaagcgctcgtactggtgcgaacgaactgttcgtcattttcccctgccataccagtgaccataaggcttcttcgaactgccgctcgccccatgccggaaagatgatttcgcccgtttcggggttcacctgcgcttcggcatgctcaagccagatggtttttgtcacggctgaaagcagttgaataggaaatgctccgccaccgcttaacgccgttaacacggcatccggcatggtcaacgtttcattatcgttcagcttatccaccgccgattcaggctggttgagcagcaaggaacctgctggatagaaggcgatctcaccagcttctttggcgttggatccacttgctttcgaaccgacccacaccacatccgacgatgagatgagttcgtcgagcatactaggctgatagtcacgcacacgtgccgggaataccatggactcccataccgaagcgttcaggaacacgccttccaactgctcgatgacacgcatcagaccatcaacgccttcgtagcgttcacctccaacagggccaacgccctgacgattaagcagaaacgcctgatagacgctcggatcgaccggtttgacggcctttctggccttggcaagagacaatgctcgaatacgccggaaaacatccttgtggagccattgctgaatatcgttcttttcggaagtctcacctgaatcagtgaatcttcccttgatgagttctcctcgggcatccagttcatcaagcgcatgcaccgcctgagccgcgtcaatgcccagttcggcaatcatcttgtcagcggtgaatggtccatgcgttttggcgtatcttgttacgcgcccgctgatatcttcttcagcgagatcattccagaatgttcgcccagcaagctcgccctccacttgtgtaatagcttcggcgtccaacaacgatgccatatccgtgcttcctagaagccgttcgagcacttccagatccatggacagcaactgcgtgcttcgttcggcttggggcacgtcatactggtacatcaccgatccaacgaagccgaacagcatgttctgcgcaaacggagaaggtgtttcagtagttgcctccgataaaagtattgttcccgcatgcaggcctgtcataatcgtgcgtaatgccggcaaatcatatacgtcctgcaggcattcgcgcgcagtttccaacaagagggggaagttcttgcaaatacgagccgcattcaacagttgcgcggccttcaaccgctgctgccagagaggcacacgcttaccgggacgtgtgcgcggcagaaacagtgatctggccgcacattcgcggaatcgagccatgtaaagcacgctttcgccaacttgcgtctcaacagtgcgttgcaattcgtccacgtcgaatagcaacagctcacgtgtaggcaaatcgccgtaaccgtccggcaatcgtaaaacaatgccatcgtcgaccgcgtacacttgaccgtcgaaaccaaaccgctgtttgattcgagtggtgatggctaacgcccaaggctcatgcacgcgcctaccatatggtgaatggatgatgatgcgccaatctccgccttcatcccggcaacgctccaccacgagatcacgatccgaaggaatcgtaccggtcgcttcacattgctcgtcaagcagtttggcaagattgcttatggcattatggtcgagaccatctcgctccaaacgttgcgcggtctcacggttgaactgtgcttccaatacagtctgagccgtattctgatcaccattctttgctggttcacgcctatgcaatccttggctgagctcacgcgtcaaacgcccttgcgccaatccgaaaccataatcacgcccatcctgatccccatgccaaaatggcaagcgcgcggtgcgcccgggagcaggaaccaccactaccctatctcgtgtgatctcctgaatctgccaggtggaagtccccaaagtgatgacatctcccacgcgggattcgtataccatttcctcatcaagctcgcccactcgccgaggacctggaccagagccctcttctggaagcaccaccgcgtacatgccacggtcgggtatggtgccgccactggtcaccgccaagcgttgcgctcctggacgtgcggaaatcagctttgcctcttcgttgtattgcagcggtggacggaatgcggaaaagctctcactgttgtaggcgcccgtcatcatgccgatgacagcgtcgaacatagaccggtcgagattttggaaaggtgcggaacgacgcacaagctcgtaccaatcgttcgtggaaagatcttccatggccgcggctgcgacggtctgctgtgcgagcacgtccagagggttgcggggcatatgcaatggttctataaccccttccctcatgcattccatgctggttgttacgccaataatctgttggcgggttatggggaagaacaacgcgtgcgagactccgccgacattgtggtcggcacggcccactcgctgcaatcccgatgcgatcgacaatggggcggccacctgaaccacgagatccaccgaacccatatcgatgccgagttccaggctggaagtggccaccacgcaacgtaattcgccgcgttttaactgttcttcgatctgtttacgtctatcttttgacacggacccgtgatgagccatggcaatcgcatcaatgtcttcatgcgattcaaccagcatggtggtggatcccaccaccgagtcatagtgcccggcaaattgctcgcggccctccggtgagcccaagtcacggtgctcactcagatcagttgccaccgtgccctgtttcgactccgcatacatgtcgttgagccgtgcggtgagcttctccgccagtccacgcgagttgacaaatatcaatgtggttcggtgccgcaacacctcgtcgagaatggaccgttcaatgaccggccataccgaaccgcctgtagcgctggtgtcgagcatattgcgcaatggttccacggcttttaaatccatggccggaacagcgccggggttcaccaccgttaccggttgcgaaccaccgagaaaccgtgctacttcctcaacgggattaacggttgccgaaagccctatgcgttgcactggatgcccaatcaacttatcaaggcgttcgaggctgacagcgaggtgcgcgccgcgttttgtacctgcgaccgcatgaatctcgtcgacgatcaccgtctccacgctcgtcaatatgctgttcgccttggaggtgagcagcaggaatagtgattccggcgtggtgacgagaatatccggcggatggctgacgattcttcgacgttgttcaggtgtggagtcgccgctgcgcatggccacttcgacatcggggatgggcagctccatcgcctcatactgctgggaaattccctgcaatggcagttcaaggttcttcgccacatcagcgccaagcgccttcagaggcgaaatgtatagcactttgacgccacgcttcgttttcttgcgggagcctttccctgcagctttttgttccgcatggctcttggctgccgcgatttcgccatgaacatccactcctgcggaacgcgtcccgcccgccataagccggtcaagagccgaaaggaacgcacaaagggttttacccgaccctgtgggcgccacaacgagcacgttctcgccggaatggatggccggccacacctgctgctggacttcagtgggccgactgaacgcatgtttgaaccatgccttggtcggctctgaaaacaggttcaaacattcgtacatacgttcgatgatcgcattaccgcaagacgttattcatcttcgtcggcaacccattcgagcacatctcccggttgacaacataacgtctcgcatatggtatcaagcgtggaaaaccgtatcgccttggcccgcccgttcttcaacaccgaaacattgaccggcgttatgcctatagcctccgccagctcattgacactcatcttccttttggcgagcatcacatcaaggttcacacgaatggccatatcagatcaccgccgccagttcatcacgctgttcgatggcctgcatcaacagcgagcgcatcaccaccatcaacagttcgaacgccgcgatcagtagaagcgccgccactccgaccgccagcacgacgtatggaaacatttgcccgtcaacccccatcgcagccatcagaaagcgtgaaggcgacaaccagatttgaccgaccatcacggcgagcaccagcatgccttcaatccccgcatatacgagaatgtgattcacccaacgcatggccttgccggaaaagacatcacgtttttcaaccaaggtcagcaatctccacagcggcaccaacgcgaactcgaagcaagcgacaatcagcactgcggcaaccgcatacagccaatgcatcgagtcagcgtcggcatacttggaagcaacgccagcggatgccgcaatcgcactgaactgcagtccgaggcagcatattgcaattatcacaatcagcacacgcaatacgccaatcaccatggaacgtttcgctgcggaattcggcatgatatccgtctccttcaatccaataaacctgaatatcgataataatctatcgatattcgatatgcaaatcttgtgaaagtatgttaatcgatatttttctatcgtttttcgatatgtacgatgacgtccaacatatctcagaaaggaatcattatcatgccggaaccagccaacacttccccatcgcagacttcgcaatcccaacaatcatcgccattaccagaagcacaagaaacccaagaaacaccaaaaacacaagggagccagccaacacatgaaccatccgcgcatcaggaggaacaacctttggcgaaacccaaaatcacgcgggaagaaatagcgcaacgccccctcaacaaacgcgcggtcatcaccattggcgctgcatttctcatcactttcgcattcgaccgtctgatctgcagcatacctccgacatggcttatcggatatgaactgccggttttctggatcatctgtgctcttaccgtaaccgcgctgcactggaaaaccgcacgaaaacaagttcttgtttggcttgttttgggaagcatcgtcgccattggcgtgtggaatacactcgctcagtcgacctggtgctattcgagaaatgacgagtacgcgctcaccacgcaattcgttcaaccggcgttgcttatgctgcactgtcagctggtcaacgggcgttacgatgttcgccgtccacttcaggttgcctggaattggcttaccggctggttgcagcagccgtttattcacattcgcgattttgcggaaccgttttccgtcatattcgcaagatttgcagtcgcgtcgaagcaacgttcgaaagtgcgcgaaatcggcattgcgctactgatttccactccattgcttctgacgatcgtaccattgctcatcggagccgatcaaatagttcaatatgaagtgctgaacgttttcagtgatttcaacccgatgacgatcactctgcacatcatgttcatcgtgttgccgtggcctttgctgttctcactgcttattggactcgacgatgaacccacttccacgcctccggagcaacgattctccctcagctcggtaactgcgttcgtggtattggccgtgactttgactgtgtacatgctgttttgcatcgtacagatccggttcctgttcgcaggattgttcaccgatggttcgatcgcactgccagacggattgacctatagcgaatacgcacgcggcggattctttcaactgctggcagtcacggccattaatgtgacgctatttggtttggcgatcgcactcgcgccacgtacgcgcatgctcaacgcggcactggtagcattgctggcgttaaccgccgtcattctagcttcggcggcgcttcggttaggactgtacatcaacgcatacggtttgacttggctgcggtacctttcggcgtcatttatcgccctgcttgcgatcgcgattctgctatgccttattcgcctgaaaatacgacaactgccattggctgcaaccatgaccgcactgcttatcgtatggtacgtggcgctcggcttcagcaacccgaaccatatatgcgaaatctacaatgcggctcatggtatcgcaatggcaatggcgacaacaccgtatcagtcgatggtctgaccagcgcactttttacgcaggctctcgtgcatgatcaccatcagcaccaggaaagccaacatgtacagagggaaccacagcacactgatatgctgtgcgatcaagccgaataccggcggcatgcacatcgagccgacgtatgcgcatgccatttgcatgccgacgatcgcctgcgatttgtcttcgccgaaatatgccggcgtggaatgaatgacgcacgggtagatcggtgcgcagccaagaccgacaatcatcagtcccataatggtgccgatattgcgaggcagcggcagcaacatgatgacgataccggtcagcaccagcgcctgccccaggcgaatcatggccggatcattaaacttcatggtcagaaaaccactcgccaagcgacccacggtgatgccgatgcagaacaggctggcccacatagccgccgtggtcttatcgatgcccttgccaagcgccatgtagctactagcccacagcatggccgtctgctccaatgcgcaatagcagaagaacatcaccaggatttctttggcgccacgaatggcgagcacacctcgcacaccaagcggtttgcgagtttcatcattggccgttccgtcggattcgccggaaacttcgcccgtctttacctcggaacgcttcttccacagtggcagactgaaaataagaatggcggtgagcacaacctgcagtatggagatataacggtagccccacgaccatccttggccggcgcccaaggcgaatcccatgatgtatgggccagtcaacgcgccaatgccccacatggcgtgaagccagctcatgtgacggctctcgtagtggatcgccacatagttgttgagggccgcgtcaacgccgcccgcacccaagccgtacggaatggcaagcagaatcagcacccaatagttaggagcaacggaaaagccgaacaatgccaacgccgtcaacgccacggaaaccgcagtgaccttgcccgcaccaaaacgcaaggtcatacgatcggaaagcaacgcggaaacaatggtgccagcggaaatcgtcatggaaatgccgccagcccacgaaatgggagcacccaaatcgacactcatcgtcggccatgcggcacccagtaccgcatccggcaggccaaggctgatgaacgccacataaatcaccgcaagcaaaagattaaccacgccctactccttcttgatcggtagccgcagaagacaatatccgccattattgtaagcacatatagctaccaatcggtaactacttgattgcactatctaccgtagaatcttcaacctttaccacacggaatcgcataccatcttcactaaaaaataccctccgaaacgtcttgacgtagcggaaggcgagctgacgacaacctcgatcaggtatcgatcttcgaacggtcgaaatcgtcggcattctcaacgatgaacgctttacgcggcggcacgtcatcgcccatcagcagactgaaaatctgactggcctgttcggcgtcttccatacggatacgacgcagcatacgtgtgcgtggatccatagtggtgtcggccagctggtcggcgtccatttcacccagacccttatagcgctgaatgtcctcgttatagctgatgtgcttcttatcaagatcagccaatttgccggccagctcatcgtcggaatacgtgtagatatactcccccttgtgagctccggtcaaggcgatgcggtgcagcggaggcacggccgcatacacgtgaccgtactcgatgagcggccgcatgtaacggtagaacaaggtgagcagcagaatgcggatgtgcgcgccatcgacatctgcatcggtcatcataatgaccttgttgtaacgtgcttgctcgatgtcgaagctcgctccggagccagcgccgaccacctgaatgatcgccgcgcattccttgttcgacagcatctgcgacaacgacgccttctgcacgttgagaattttacctcgaatcggcagcaacgcctggaaaccggaattacgcgcggctttggcggtgccaagtgcggaatcgccctccacgatgaacagttcggccacatcgtcattgcctggctggcaatcagacagtttcggtggcatggatgccgattcgagcgcgttcttgcgtcgcgtcacctctttggtcttacgtgcttggatgcgggcgtgcatttcgccgacgatcttttcaagcacgcggccggactgttccttatagccacgtttggagccggtgatcatctcgccgaactgcctgtcggtcattttgctgacgatcggcttgacctgcgcggtgccgagcacatccttggtctgaccttggaactgtggttcggcgatacgcacagtgacgacggcaaccagacctgccagaatatcgtcacgttcgactttcatgttggaatctttgagattcactttgagcttacgtgcattgtcttcgatggctttgcgaatctgcttggtcaggcccaacagatagccatccacatgggttccaccgcccggggtttccaccacattgacgaagctgcgcatggtggtgtcgtatccgttggtccaccgcatggcgatatcgacggcacaatttctcgtaaccttctgcgcgtgcagttcaccgccatcgccaacggcttgggtttcctcaacataggtgtcttcgccagtgatacgccaaatagcggaaaccgcttcgcctttggacaggtaatccacgaaatccttcacaccgccggtatggcagaattcctcgatacgggagtgggtatacttcgatccctgaggttgtgccgcaacatcggcttcctcgatctgctccgcagcttcctcgtgcccggcagcgtcatgttcagattcatcgctttcggcaatttcctgcggttcatcacctgcagcatttgcaatatcgtcgacttccagcatttcgtcgactgattcatcgccggtttccggaatattctcatcgataacagtgattttcaaacccggcaccaggaagctggtctgcctgacgcgatcaatcagctgctcgtagctgaattccgcggtgtcgttgaaaatctccggatcagcccaataacgaatgcgagttcccgtggtcttcggactgaccttgccaatgatttcaagctcagtcggacggtttttacgcgtgcgtttgaatggcgcatccggagatgggtgctccggatcagcatcggtatacacaccaggatgaccctgatggaatgacatatgatgcgtcttgccgtcacgatccacttccacgtcaagacgggagctcaacgcgttcaccactgacgagcccacgccatgcaaaccgcccgaggctccgtacgaagagttaccgaatttcgcgccggcatgcaatttggtcaacaccacttccacaccggtaagtttggttttcggctcgatgtcaacagggataccgcggccgttatcggccacttccacggaaccgtcgctgtgcaacgtcacaacgatatgattgcagactcccgcaagagcctcatcgacggaattatcgatgatctcccacaggcagtgcatcagaccttggctatcggtggtgccgatatacatgcccgggcgcttgcgcaccgcgtcaagaccttcaagcacggtaagactacctgcgccgtaattgtccttgtctttcgccattttcctcattctgacttgcagttttgcttcggttttcatccataagaacgtcttgtagacgtaagaagtcgagaaattcgatattcttaccgaatttctcgacttcattcacctcttgtttcaatcactgatcaaggaagtcacgcagcgtctgcgagcgagacgggtgacgcaacttcgacatggtcttcgactcgatctggcgaatacgctcacgggtaacgccatacacgcggccaatgtcgtcgagcgtcttgggctggccatcttccaagccataacgcatcttgatcacgccagcctcacgcggagacaacgtttcaagcacctgcctgaactgctcctgcaacagcgagaaggcaaccgcgtcggacggcgcgatggcgtcggtgtcttcgatcagatcgccgaactcggaatcgccatcctcacccaacggcgtatgcaaggaaatcggctcacggccgtacttctgcacttcctgcaccttctcgacaggcatgtcgagctcgcgtgcaagctcatccggcgtgggttcgcggccaagatcctgcagcatctgacgctgcacacgagacagcttgttgatcacttcgaccatgtgcaccggcacgcgaatggtacgcgcctggtcagccatggctcgggtgatggcctgacgaatccaccacgtggcataggtggagaacttaaagcccttcttccagtcgaacttctcgacggcgcgaatcaaaccgaggttgccttcctgaatcaaatccaagaacagcatgccacggccggtgtaacgcttagccaacgaaaccacaagtcgcagattggcttccagcaggtggtccttggcacgtctgccatcgttcgcagcccacttgagctcacgcttgcgcttgaagtccatctggtcggattcggtgtccagcaggtgctgggcatacagaccggcttcgatacgctcggacagatcgacttcctgttccgcattcagcaggctcacacgaccgatctgcttcaggtaatccttgaccggatcagcagtcgcacccgccgcaatcacacgacgcttcggattgccggatggggtcagattctcatcatcatcgtcatcacgcaccacgaaagcgcccttttccttaggctcttccggctttttgcgttcttcctcatcctcgtcgtcatcatcttcaggttcggattcctcgtcgtcgtcgaggtcatcctcgtcatccgaatcgacgtcatcgagatcggcgtcgaaatcgtcaagatcggcgtcgtctacctgagcgtcctcatcgtcaagtgcatcatcctcgagcgactcctccttcttggcaggggcgctcttcttcgcggtagtcttgcgaggggtcttcgttgcggtggttttcttcgccgcactcttcttcgtggaggccttgcgcgtggcggctttcttcgtggaggtggtcttttcggtcagatcagcctgttccatgcttgccgtcgtttccttggtggccaaacttatcctcctattgatcctgcctcgaagcgtataccacatggacccacttctggcaagggcaaatcgtcaactatgtgagtaaaccatcttgcaaggacgattattcccgcataatgaggccttcacgcgcaagtcacgccactttacggcgtgttgccttatgtttccgacgtccaggcaggaccaatacgtcgttcaaccgccgagcatacaatcgccgccagcgaacattgatcatctatcgcgagcgcgctgatggctgatgccatggctccttcccggcccatccaccacatgatgtagctgatcacggcgaacggctgcgcccgatatgtcttcggaatcatatcgataatgtcgaacagcatgttgatcgcctgatcgcaacgtttcatatcgggtctggctaggggatcacggaatgaatcgctgagcagctgttccagacgctgcgcattacgagacagcttgggtctttcggcgaaactcatgagaaagtctcggtcggcgtatcgttcgtcaacgatggcggaaatgagaaatacgtcacgaatggacagcatccgattgatgcccaccgtagtccgcatgatcatattccggtcaagaccgcattcggcatggaattcgccttccgaatgggaaacgctctcgtccgatgcctgcgcaagcgcgtccatccatatgaaaagcggttcacgaatgaacgaacgcactgtttcgcccacgccgtcggatctgcaatccctttcgaatcggctgatggcttcttccatttcagtcccggtgatgcgtccggttttgttggttgtcattattctgccctccttggcatggtctatcggcttcctcgctcgccgcttatatggcactatgcccgatgagccgatgcgatgccgcttttttcgaggcctgtggtcggaggatggcttcttcggcgtttcgcaaaatgatttcggtaccgcaactattgcaatcattgagatttggtcttgtcgaatgcctgtggataactgttggtatgactagctcctccgatttggaacagattgaatcacgcattgtttcgttggtgaaggatttcgcattccttcatgcggacgattcggttgcctcctcttgcaggcctattgccgacatggtcgccaagcaggcggtcacgtcaagtgagggtggcaagcggcttcgcgccttgctgacgttggattcgttccgcgcattcgcttcggaggatgtgcgagaacgtgatttcgacgcgctgcttgatttagcgtgcgcggtggaagtgttccagaccggtgcgctggtgcatgatgacatcatcgatgattccgatctgcgccgtggcaagccgtctgcgcatcgcgcattctccactggtacgcatagcgaggccatcggccatggcttgggcatcatgctcggcgacatgttggccacggcaagcgtggacatcgcggacaaggcagcttccaagctcactcatggttccgatgtggtcgcggcattgctcaacatgcaccgcgaggtcgaagtcggtcaagtactcgatttggccgtagagctcaatccgttggacgatccagacgaactggtggaagcttcattgaacgtattccgctggaaaaccgccagctacaccaccattgccccactggaattcggcatgcttgccgcgggtataggcaaagacgatgcgaggaagcaggcattggcagtcggcttgcctcttggattggccttccagcttgcagacgatcttctggatgttgtcggttcgagcagcaatacgggcaagcccgttggaggagatatccgcgaaggcaagcgcacggtgcttctagccgacgccatcaacacggcgaacgacacgcagcggcgagagctcatcgacatgtgggaggccgattcgcgttccgaaactcaagtaaaacgcgccattgaactatttgagcaaacaggagccatcgaacgttcccgcggtagaatcgcggatttgtggaatgaatcgaaaacagctatcgaaacattgagcctttccgaataccacgagtcactgctcatcgaggcctgctcacgtttcgtgccaagtattcacgtccaaacacgcgcgtgacacgcgacctgcgtgttttccaaccaacatccggacaggacgcgcgttcgttgcacaatccgcaaacctctgcttgtagactacaagtgggaacacgttcgaacgtgagttgttttgaagaaggaaccgtagcgatcaaccatgagtgaagctccacacgcccctgaaggtcaggtcatcgagggccggtatcgggtcgtcagcagaatcgccgatggcggcatggccacggtgtaccaagcggtagacgaacgtctggagcgcacggtcgccatcaaaatcatgcatacccagctggcgcagggaccgcaccgggaccagttcgtggaacgattccatcgtgaagcccgttcggccgcggccattgccaatccgcatatcgtgcaggtgtatgacaccggcgaattcgacggtctcgattatctcgtcatggagtatgttcacggcgtgaacctgcgttacgaaatgaaccagcagggtacgttcagcgttcgagagacgttacgcattattggcgagacattggatggcctcgcttccgcacatcgtgcgggcgtggtgcatcgcgacatcaagccggaaaacatcttgcttaacgaccgtggccatgtgcagatcaccgatttcggcttggctaaaacggtatcgcaggccacactctcctccaccggcatactgctgggaacagcagcatatctagcaccggaaatgattgagaagaatcaagccacacctcagggggatttgtattccgtgggcatcatggcttgggagatgctcgccggcaacgtgccattcacttcagataatccagtaacactggtattcaagcatgttcacgaggatgtgccaagcattgccaccgcttgcaaaggcatcaatgaaggcgtggccgcattccttgcccatctcacggctcgcgcggtcgaggctcgtccagcagacgcatccgttgcgttaaccgagctgcagcgtctgcaatcgacgcttgcggtcagcgattggcagtatcgtcttcccccggtagacgtcagcgcttccgacagtgccgcgcccgcaaataacggtgcgccaaccaatgtcggcaatcctgttcctcccgctcccccggcaccgccgacgcagcaattcgatgatcgcacacgcaagctggacagggtcaagacgaacgcaacaaccgtcatgccggtgcagcaacagaacatcgatccagaagcgacgacacgtttctcgctgccggcagacggcatcgtcaatagccttgacaatgccgtcgacagcgctgcatcgcaatcccccatcgcgcaaagcgacgaatccggcaatactccaaacagcaaatccgcgaaaaagcgtcgcacaccgctcatcgtcgcaggcgtggtggcgctgctgcttgcatgtggcgccggcggttgggcatggtggtactatcagggccccggcagctattggaccatgccccagccggatggtatgacatgcgacgcgtccgcagcatgccccatcaccaatgtgaagtggagcgactacgagagtctgctcaagatttccgatatcgaatatgaggtgtcggaagagtatagcgattccgtggaggaaggcaatatcatctccaccgacccggcgaatgtcggcgatcgcggcagcaagcgtcgtagccagaaagtcaaggtcgtggtctccaagggagtccggcaggcgacggttcccgccgatattctcgacgcgaccagcgcatccggcaaggatccaatcaacgcactgaagaaggctggattcgataatgtcgagcagaccgcggcttctgatgacacgtattccattgacgtgcctcaaggggcgttgctgtcgttaagtgtggatcccggcgccacattgccgcataatacgacgatcaccgtcacggtgtcgcaggggccaaagccagtcactatgcccgatatcgtcggcaagacgaaggacgaggcacagcaggcgctggatgatcttagactcaccaccaattggacggaatccttcgacgacaagattccacaggggcaggtgatttccgcttccgtcaacaacggtgatacgttgcattggggagacagcgtcgacgtagtggtttccaaaggaccggaaaccataaccctgccgaattatgtggggcagaaagcctctgacgccaaagccgcattggaaaaactcggattcacggtcaaggtaagttcgcagctcacgttggattccaatcaagacaagaaggtcgcttcgcaggatccggtaggtggcaccgaagtgcgtcttcgcgacgagaacggcataccaaccaccatcacattgaagatgtattcctcactgttctaaaagtgcattacctgctttgccaaacatcatggtataggcataaggaaagccccggctcgtgtagtgtcgtgccggggcttttctctttggtttctcagctgttcgcctgttcggcggctttctgcgccttaagctgttccttgactttctgagcgtattcgttcacgtattcctgaccgctcatcttctgaatttccatggtcacgcgatcagtcagcgtgcgcaaatcgtcgtgcgtgatctggtcggcgggcttcttctccacggcaatcggtttgccgtagatcactgtggtcttgcccttaccaggaataatctgaccgggcttctgcaactcgcgagatccgataatggcggacggaacgattgggcatccggtttcaaaagcaagtcgcgcagctccggtatgacctttatagaggcgaccgtcagggctacgcgtgccctcaatatgaatgccgaacaggtggccgtcttcgaggatttcacgcgcgtggttcaatgcgccaagcgatttcgacccaccggaacgatccacggggaacacgccaaccgaagtgaaccaccacttcttgaacttgcctttgatgcccttgccttcgaaatactcggctttgcccatgaaatgaatcatgcgcggacaagtcagcggcaacagcgcgtcatcgatgacggcaagatgattggctgcgataatggcaccgccttcgcgcggaatgttttcaagtcccttggcagtcggtcccatgcggtggatggcgatcggtcccaggcctttgacgaaaaaccagtagagcatttttcacgatcctcctagcggatggccatccgcttgattacagttatcagtatgactgacctcaacaatagcaatgccgatgaagaacgcccaaatgccgcgccgaatggtggcgaaggggcttcttcaaatgcggacgatttggatgccgcatgggctgaattcgcaagttcgcatgccgacgatttgcaggccgtggagcattctcgtagcgcgaaacgttttgaaaagcatgcgcagcgccgtgagaaggaggcgttgctttcgattcaggatttggatcagggcacgttcactgatgacactccgcaaggtcgtggaccgcgcgatttcactggttccagctggttggacaccgatagtgtaatggatcgttacggtgatgatttcactcctccgaatccctccatcggtcatgtcaagatatcgaagttggtgttttgggtgcttttgatcgctggtgtcgccggtatcatcgcatctgcgttcatgcctgctttggctgggattttgggatcgattttcggtgtgtgcgcgttgattggcgctgctggattgatcgtacagcacaagggacatacacaaacccgccgcgatgttttcgatgatggagctcgcgtatagcaacatatggagaagactgcatcagctacgtcttttgtgctcttctctgtgatatttgtcgctgcgatacgtataaggcgtgtctcgtcgttgagtgttttgacgagacacgccttatacgttcttatgatctgccatttcgccgaatatcaagctttcttggactgggcggcggtgatccactggtcaagcagtgccgaggccttgcctgaatcaacggtttcttcggcaatggcataggccgctttgaatcgttcagtcaggctggcatcagctggcacctgatggccgtccgcaacaatcgcggatgccgcgttgagcagggcggtagtgcggaaaggaacgtctttgcctgcaaggaaatcacggaacagctgagcgttgagctccggctctccaccctttaagtcagccaccgtcaccttgtcgagaccaagctccacagtcggatcgaattcactctcagtgactttgccgttgctgaactcccagatggacaccggaccagtcggagccatttcgtcaagtccctcgcttgacgtgtacaccatgccggtctgtccgttagccgcatataccgcagccatgatcgggctcattgcgcgattggcacagcccaccgccatgtgcttcggcgaggccggattggtcagaggtccaagaacgttgaatacgcatggcatgccgagcgccgcacggacaggtcccacgaagcgcattgccggatggaatgtgcgtgcgaaagcgaatgcgatgccgcattcgttgccgacctcagcaacctgttccggttccagatcgagcggcagtcccagcgcctcgaagcaatcggcagtgccgcacttggaagaggctgcacgattgccgtgcttcacgactttcgctccggctgcggcagccaccaccgcgcccatggaggacagattcaccgtcgcggcaccgtctccaccggtaccgacgatatcggtggtctcaccgtcgatatcaagtttgatggcatgggagaccatggccttggccgctccacgcacctcatccggagtcaagccaagctgctgctgggttgccagaaccgcaccgacggccgccggattagcgttgccgttcatgaggtcatcgacgaaccactcggattcctcggcactcagatggtcccctccgaccagcttggtgaggatcgacttccatgtgatttcagccatgatgccctccttgacgcttcagcatgtcacgttgttgatacgatatcgccgccattgtaaccgttctacatttcatggtttttcaacgtccatatcacgaacaggtaattgcagaaaagcgctcatcataaacaacacagacattttcaatatctatcttccgcatatcgggcaacgagcatgaaacaaaaaggcggtctgcgaaaaatccgcaaaccgccttcattatgcgcgaatcatcagagcatcacacgatatgtcactgttcgttctgtccgtggcacatcttgtacttacgaccggaaccgcacgggcactgggcgttcttgccagttcccgggaaggtgcggccatccgcccacggagagcgcaattcctcgctcttcgggcgcttattggcaggaaccttgccctcagcatggctgatcggctgcatgcctacgatgccaggctcattcttctgttcttcggccagttcgtcgatgacggtcttctcggcctcatcgtcggtttccggctcggcaggagcggtttcaccggtcggctgcgcttcgctatccaggcccatcaccgcttcggctgcgttcacggcctcttcctcatcggattcggtttcggcgtcttcggtggtggcgacacgatcgatgtcaacgtggaacagcagctggatggtctcctccttgattgcttcaatcatggagttgtacatctgatagccttcgcgctggtattcgaccagcggatcgcgctgacccataccacgcagaccgatgccgtccttgagataatccatctcatacaggtgttcgcgccacttgcggtcaagaaccgcgagcacgacacgacgttccagctgacgcagaccctcttcaccaagcttggcttcgaagtcggcatactggtcctttgcgtcggaaacgataagctcctgcagggctacgatggccttgtctcccttgagcttggagacagcgtccttggcggcttccggatcgacggcaatcgggtacacggcgttcagagccttgaacaggccttcccaatcccaatccttcggcttgtcagaacccttgttggcgcccttgatgtagctcaataccgtatcgtcgatgaacttgaggatatcctcgtggatgtcttcgcccttgagcacagcctgacgctcggcgtagatgacggtgcgctgcttgttcatcacgtcatcgtacttgagcacgttcttacggatttcgaagttgcgggattccacggccttctgtgcggtgcgcacgcccttggaaacgctcttcgcttcgatcggctcgccttccggcatgcccttggccataacgcgggccacgagctgggtgttgaacagacgcatcagatcgtcttcgagcgacaggtagaaacgggactcgcccggatcgccctgacgtccggaacggccgcgcagctggttgtcgatacgacgggattcgtgacgctcggtaccaagcacgtacaggccgccgagttcaacgacctcttcatgctcgtccttgacctgctccttgatttcggccaaggtgcccggccaacgcttctcgtactcgtccggagtgtcatccggagaatagccttcggacttgagcttcgcatcggcaaggaactcgacgttgccgccgagcatgatatcggtaccacggcctgccatgttggtagccacagtgacggcgcccttacggcccgcgacggccacgacggcggcttccttgtcatgctgcttcgcgttcagcacctggtggggaatgttggcaacgtcaagcagggacgacacgatttcggaggattccacggaagcggtacccagcagcaccggctggcccttcttgtggcgcttggcaacatcgcgcacgatggcggcaagcttctccttcttggtacggaagatcaaatcgtccttgtcttcgcgaatcatcggcttgttggtcggaatcgggagcacgcccagcttataggtgcccatgaactccgcggcctcggtttctgcggtaccggtcatgcccgacagcttgtcgtacatgcggaagtagttctgcagggtgatggtggcgaaggtctggttctcagccttgacttccacgttttccttggcttcgattgcctggtgcagaccttcgttgtaacggcgtcccggcaggatacggccggtgtgttcgtcgacgatgagcacttcaccgccagtcaccacgtagtcgcggtcgcgcaggaacagttccttggccttgatggcgttgttcaggtagccgatcagtgcggtgttgttcggctcgtacaggttgtcgatgccgagataatcctcgatcttgttgatgcctggatcgagaatgccgacgaccttctttttctcgtcgacctcatagtcctcgtcacgggtgagcttgagcaccagacgtgcgaactgacggtaccaacgggtcacgtcgccttcggccggaccggagatgatcaacggggtacgggcctcgtcgatgaggatggagtcgacctcatcgacgatggcgaagtggtggccgcgctgcaccagatcggacttttcccacgccatgttgtcacgcaggtagtcgaagccgaactcgttgttggtgccgtaggtgatgtcggcgttgtactgcttgcggcgctccggcggtttctggttggtgatgatgcagccggtgctcatgccgaggaagcggtagacacgacccatcagctcggcctggtagcttgccaggtagtcgttgacggtgacgacgtgcacgccctggccgtcgagtgcgttcaagtatgccggcagggtcgccacaagggtcttgccttcaccggtcttcatttcggcgatgttgccccagtgcagcgccgcgccacccatgagctgcacgtcgaagtggcgcaggcccaaggtgcgcttggatgcctcgcgcacggtggcgaaggcttccggcatgagcttgtcgagggattcgccattgtcgagacgctgcttgaacttggcggtctggcccttgagctcttcgtcgttgagcgctgcaatctcatcttccagcgcgttggtcgcctgtgctacgtgctcaagcttcttgatctgtcggccttcgcccattcgcagggctttgtcaacgatatctaccacaatcactccctttgtgtatgcgagttatctcatctgagattagtcgctgtttaacgatttccgaaaaacaccgtccattttacgtaactttcagcttgttgtggccttcttccattcgacacaccaccttcagacatgaaaaagaggcccgcacatacactgcgcgagccccgttcggtcagattatctccctatccaacctgttgcatgtcttacttcgccacattctccggggtgtcgatctcgaagacgccatagctccagccgtgacgatggtagacgacggacggacgaccggtctccttgttcacgaacaggaagaagtcatgtccaatcagctccatctcatacagcgcctcatcgatggtcatcggctccgcgatatgcagcttgcgacggatgacaatcggggtgtcgcctacttggacttcgacggactctcccggacccagctcagcggcgacggcttcggccgggctgttattcggcacttcgaccggctcctcaacttctggagtcggctcgacgacaccaagatcgaccgggaccggatcgctgtagccacgacgatgatccttgcgacgatcacgagtgcgacgcagacggagggtcagcttgtcgagcgccatgtccagagcgctgaactcgtcggcgctggaagcctcggcgcgcaccacggtacgacctgcgatgacggtgatttcaacgcgcttggcggtgtcggcctgacgcggattgccctcgtgcgacaacacaatctgaacacgctgcgcatccggggcgatagcggtcacacgattcatcttgctttcgacaacgtcacggaacctttgcttaatctgcgtatgacgtccggtaacgacgatttccatgtggacctccctagactcaagcggtgttacccgctatatacggaccaaacagctgcttcgctgttcggtagtcaacattgtagccgcaacattgtgatttcactgaaaagttgacgcaagaaaaataaagtttttttgattttcctttcgtccgttttcttgctactatagtgcatttgagacctcttgatggccgcgaccgatccgtcggttgaggaacttccgggctccatagagcacgatggcggataacgtccgcccagggcgacctgagagatagcgcagcagagaacagaccgcttatcggtttcgaccggtaggtaagggtgaaacggcggtgtaagagaccaccgggccactggtaacagtcggccgcatggcaagcctcatcgggagcaaggccaagcagaaggcgtttgagggctgctcgcccgaagccttcgggtaggctgctagagcctgacggcaacgtcaggtcgagatggatggccatccgtgcctgaggcacgacagaacccggggtataagaggtctcactcccttatcacaccgaccggttcccgtggcgaaacagtgtttgaaaaccgcataaccactatgcgaatcagtcgtttcagacgaacaattcctgtgcgattttccgcagaacttcaggattatggcctttccgcccaccagcactccagaaccgtcttttacgcacctcgacatccaatccagcagtttttcttgctgtccgacgtcccagctcccatgcagcctcggcgaacacgccttgggattcggcctcatcgcacacacgttgcgcgagctggcggtccacacctttgcgtttgagctccatgaccgctcccctataccccatcagtcgtgatgtgcagtaccgcaccgcggactgggcgtacgcctcgtcgtcgatgagacggacccgaatcagtctgacgatcacatcgtccaccacctcggaggcataccccttgccgatgagtcgctcccgcatcgcgcctgacggacgcggcgccgcatcaagcagccgaagggccgcctccctgcatgcatccaaatcattcggatcgtcaggaatccgcgacacgccgactgcgacacgccctgcgtgtcgtgcgtgtcgcgcacgcctcggcgtgtcattgccgccaatggacggagttcggtcgtaatcgaattcggttcgaccggcctgcggccgaccaccgcaggaaagggcaaggcccccagcctcagatgataccggctggaggccctgctgttcaagaaatcgctcagcgctgatcatacgtcacgccttgccggctgacttggaagcctttgccgcgcctttggctgcttccggcttgccagcatccgctttcgccttctcctcgcttgtggcattagacgcagaagcctcattaccatcttcggcaaattggtcggtgggctcaatgagaccaaactcggccttcaccttattctcgatctcttcggtaagctccggattgtctttcaagaattggcgcacgttctcacggccttgacccagttggtcgccaccataggtgaaccatgatccggacttcttcacgacattgacctgcaacgccatgtcaagtacggaaccttccttggaaatgccctcgccgtacaacacgtcgaattcagcggtcttgaacggcggagccatcttgttcttgacgaccttgaccttggtgcgattgcctacagcctcatcaccattcttgatggtctggatacgtcgaatatccatgcggacggacgagtagaacttcaacgccttgccgccggtggtcgtttccggattgccgaagaacacaccgatcttctctcgaagctggttgatgaaaatggcggtggtgcccgcctgagccaaagcgccagtcatcttacgcaatgcctggctcatcagtcttgcctgcaaaccgacatgactgtcgcccatttcaccttcgatttcggccttcggcaccagtgcagccactgaatcgatgacgatcacgtcaagcgcaccagaacgaatcagcatatccgcgatttccagcgcctgctcgccgttatcaggttgggaaacaatcaacgaatcagtatcgacgccgagcttgcgcgcatagaccgggtcaagcgcatgttccgcatcgatgaacgcggcgacgccaccgtttttctgggcattggccaccacatgcaacgccagtgtggtcttgccggaggattccggaccataaatctccacgatacggcccttcggtaggccgccgatacccaatgccatatccaatgccagcgatccagtaggaatcacctcgacatcctgctcgggacgatcgcccaatcgcatggccgatcccttgccgaaactcttctcgacctgcgcgagcgccgtatcaagcgcagcctgacgacgcgggtcgatgccgttcgcggacttgttctgtgcggctccctttgccgcgctcgtctgtgccatgactactccttttgctgactatgacgaatggtggcttcaccgtaaggccacggcattcgttcccgcaaatctaacggccgttgtggtcggaggatatgcgatctaacgagtcataaccaacatttcttggaaaatcaacgttttcacgcgatctgaagaatttggaaacagcccgtctaggttgttgtctgtggataactatatcccaacatgcgaacatctgttcgaagaggcgtgttgtgttcggaaaacgtctcagcgcaccggcataggaggcgcgttatggtccttgccccaacgctgggaatcgggaatgcccatctggtcgcataacacattccagaccactcgcggctcctcaccagcgccaagcgcgtccaccgccgtcatgccgccaagacgatcaagcacctggtcatgcgccagcgctcgaccatagctacgaccaagcacctcttcaagtaactgccaaaattcacgttcctgcacgtgccccagtgtacacagacttgaatccatgtacaggcacgaaaaacgcccggcgaacaatcgccgggcgtcaaccttacattcggatcaggcagccacagaatcgagatagtcagccaccatgcgaagcatctgggctgtggacagccctaaggactgcgcgatggacgacagcagttcggaactggcctccttctggccgcgctccacttcggaaaggtaccccaaagacaccccggccttttcgctgacctcgcgaagcgtcttatgatctcgcgtgcgcaggtcgcgcagcacatggcctatggcttcacgcagcgaaacctccttagcctcatcgggctgttcctgagcgtgcggcacagcatgcgtgcgtacccgatcggagtcctcttcctgccacattcgcgtcaatgcggcctgacgctcatccttggcctttttcgcagcgcgcgcacgaagcacctgctgctgcgcgaacatcacagcgcgccgctgagccggcgtaagctccctgacacgagctccggcagcctgcgcagtcgcaggagccatagccttgagttccctctgctctttggtgagtgtcatcatttccattcatcagcccctttttcgtgcgtacgtctgtccactatggtcaacactcatctttgtggattattcctgtgaatccgctgaaagctccctcagtttttgcagaatacaatgcacgacgccgcgtcgcacgctctccctatctccctgcaggcgaagctcaaaagcctccgttcgccgagagcgaacacctccgaacccctccggcagggaacaaccgacatatgcaagacctgccggtttatttccatcaggtccaggccccgccactcccgtggtcgacaatccaataacgcagtcgccatccccctgctgccgatacagcctcgccgttccggcagccatctggcgggccacttcaggatggacagccccctcgctgcgcagcagttccgcatctacgccaagaatcgaggccttggcacgaatgtcatacgtcaccgcggaaccgagaaaaaccttcgacgctcccggcacgcgcacgaaagcgtcggccaacaggcctcccgtcaacgattcggcggctgcgattttgaaacgattggtttcacaatatgcaagaacggccgcagccaattcatcgcattgcgattggttggcggcagccgtctggtccatagattcagtcatgaatgccctacttggtttcttttccggacttgcccgcggacttcttacggccgccgaacgtattgaccagatactcgccaccggaatacaggcagagaatcagcgcaagataaatcagcgcatacgtgatggtgtagtagacggtcatccacatcggggtgtcgttgaccccttccggcgccaagctccacataggcagcatgagcatggccagaccaatgcactggcagagcgtcttgtatttgcctgcctgggatgcggcgatgaccttgccgcccgtgtcgatcacaaagaagcgcatgacggtgatgccgatctcacgaatcaggaacagggcggtcacgacccatcccagcaccggattgccaaattcgttgaagatggcggcaacgatcagtgtgccgcaggtgagcagcttgtcggcgatcgggtccatcagcttgccaagttcagtgacttggttgtatttgcgggccatccaaccgtcaagcttatcggtgcatgccgcgatgatgaagatgacagcggcaacccaacgcatggtgacgttgtccacgccccacgcgccggctttggcgtacagcgccaaaaacacgatgaccaaaatgatacgagagaaggtgacaaggttcggcggcgcgttccagccgtcaagcaacgatgatttgcgttcttcttgcttttccataccgttcacgttaccctgacacttctacttgcttaccaatttgcgtttcatacggagcgttccccagtcacatcgccgctttggaatccgccgccgaagagactcccgaactcagcgacgaggtctcacccttgatgaaggcgagcacctgcggcaagtcctggggctgcaccaacacctcgcgcgccttggacccttcggacggccccacgacgccacgtgactccagcagatccataaggcggccagccttggcgaatccgacacgcagcttgcgctgcaacatggacgtggaaccgaactgcgaggtgacgaccagttccgccgcctgcagaagcacatccatatcgccgccgatgtcttcgtccggctcaatggccttcttgtcggcttccttggccatttcctcgatatcctcacggtaatgtggcttgcgctgggtgcgtacgaattccacggcacgtcggatctccgactcgtcgacccatgcgccctgcacacgcaacggtttggcctgtcccatcggcaggaacagcgcatcgccctgtccaatcagagtttccgcgccagtggagtcgagaatgactcgagaatcagtggccgacgaggtcgcgaacgccaaacgcgaaggaatgttcgccttgatcaggccggtgaccacatcgaccgatggacgctgggtggcgagcaccagatgcacgcctgcagctcgtgccagctgcgtgatgcgttggatggagctttccacatcattcttggccaccatcatcagatcggccatctcgtcgacgaccaccagaatgtacggatatggagcgaccttgcgcttcgatccggcaggggcatgcaccttgccggcgcgcacggcagcattgaagtccttgatatggcggaatccgaagaattcaagatcgctgtaacgagcatccatctccttgaccacccattcgagcgcctgcgcagccttcttcggatcggtgatgatcggcgtgagcagatgtggaatacccgcgtatgccgatagttccactcgcttcggatcgaccatgatcatgcgcacctgatccggcgtcgccctcatgatcacggatgtcagcatggagttgatgaagctggacttaccggaaccggtggcgcctgccaccagaagatgcggcatcttggtgaggtccgccgttacaaaatggccttccacatccttgcccacgcctgtgagcatcggattcggatcgtttctcgccttgtccgaacgaagcacatcgccaagcaccacggtttcacggtcggtgttcggtatttcgatgccgatggcggacttgccttcgatcaccgacaggatgcgcacgtcggaactggccaccgcgtaggcgatgttcttctgcagattggtgaccttctccactttcacacccggaccaagctccacctcatacatggtcacggatgggcctcgcagaaagccgatgactttagcgtcgacattgaactgctggaatgtgaccgtaagagcgcggatcacacgatcgttctccggagtgtgcacggcatgcggcgcgccttgcttcagcatgccgagatcaggcagatgatagggaccctccggaatctcaccggactcgtcggaaacgccctctccgttcgatccggcatccagatcgttcacgacctcattggtcgccgcatcgaccatgacctgcgacccgttggacgtgccgtcctcgtcgatgacggcccacgggtcccctacagccacgccaacggatttgatctcgtcggacgccgcctggccggcaaccgtcggaatggtttccgggatctgcggcatggtgccgctcgccaaaccgattgggtcagaggaaagggaacgcaccacaggcgtctgcggcatggcgacggttccaccgaaatcctgagcggaatgttcgtcggatgaaatgctgcgcggccgcgagacgctctggtatggttcgtcaagcatggtttccgccgtttcgccatgccgttcggcagcattacgaaacgcctcatcaccgtcgtaatgatcgagtccgtcctgagcgccctgcttcttggatttcgatgatatccattgctttatgagggagaacggcatcggcttcttcttttcagccgccacatcgtcggctccattatgcgccggcacgccttctgcgaacgacagcgtggtatctcctatacgcacttcgttcgggaattgctcggtctcgtcatcaacctttttatttgcaccgaatccaaaacggaccttcaatgcacgtactttgtcgggaatctcttgaacccctgtattggtaatcagcaacaacgagaacaaaatgacgaccacgaaaataacgatggcgaacgccttggaaagcccccatgccagcgggcagccaagcacatagccgagcagacctcccgcattctgcagcaacgccatgtcgaaaccttgggcgtcggacgcgagcgccgcgtcgagtatggagcagacggaccacagaatcatggaccaccccgccaccatacgcacattgccgcttttgcgcttggtctcatatatgaggctgaatgccaccagcgccaaaaagaccggcaggatgacgctcatcagaccaaacaggccggaagccaaggcgtggagcatccggccgaacacgccctgcacccggaaccattccgaagcgcagaacattaccgcgagaatcaccagaataaaacatgcgatatcacgtccgtacttggtcaagacacccatcacaggcgacggctcgaccgcgtccatgaccttggtctcgccggaacgtgccttgcccgtggaccctttgccgccggatttcgtattggaagatgctgttcgtgccataacggtcatgattttacccatgggatgcgccatgacatggcacttcctcgaatcgcacacattttctaacttaagtgaacacgcaatttcactgattggattccgccaagatcgtcaccgtcaagttgggtgccaagccggagaagaccgtggataaggtggaaagcttcgacgaatacggcagcgggagtttcatttcaggcgaggtctccgagatgatgctgggtgtaggcgtccgcctgcgcgtctatggcgtcataggcacctgcatcggcatgttcgatgatggccatcgcattgtctagcagcgccggattgagcgcttggagccagtggatgcgcgggtcacgaccgaaccatcccatctgcttgcgtgccagacgcttcgttttctgcgcaatgtccatgaacgtgtcgttcaggtcacgcaacccgtccaaatagtcgacgacctgctggtaaccgagcgctttggctgcggtgatgcccagcttgggacggatacgttccacttcttcgatgaatccgccttcgagcatctgcttggtgcgaatatcgatacgacggtccagttcctcacgcggcagatcgagaccgatttgcacggtggggatgacgtaccggtagtgcggaaggcttgccgaatagggtcgtcccgtcacttcgatgacttccagcgcacggatggtacgccttggattgtgcgggtccatgcgcgccgccgcttcgggatccttggctttcagctcgtcgaacagcgcgcccgcaccttcggttttttcccgttcctcaagcgccatacgtatttgcggatcggtgccggggaaggagatgtcgtcgatggcggcccgtgcgtacaggccagagcctccgacgaggatcggacgcactcccctggcctgtagttcggctattttctcgcgggcgagctcttggaacctcgccacggacatggcgtcgtccggttcgatgatatcgatgagatgatgcctgacctgcgcctgctcctcaaggcttgccttggccgtgccgatatccatgccccgatacatctggtatgcgtcggcgttgatgatttccgcctgttcgcctttgcgcgccaacgctttggcgacggcaatgcccaacccggttttgccggatgcggttggtccgacaatggatacgaccttgcgctgcatcgcaggatcggcgtctcctgttttgtctgttttctcaaaggtctgttcagtgtcgaacggcataggtctgccccgccttcggatcgggatcggcgatgaggttgtgacgcccagcgtgggtgatggtggcggtcacgaaatcgcctacctgcggcatcggctcgccttcgggaacaccgacatgcacgagcacgccggttttctcgcgcccggtgacacgatgggtcgcggcgtccttcttgccagatgcgccggtgaccatcacttcgacgtcacggccttcgaaggttttgagattttcttcggtgatgcgttcctgcaatgccacgagtcgttcgaaccggtcttggaccacgtcgtgcggcacctgctccatttcggctgccggagtgcctgggcgcggcgaatagatgaaggtgaatgcggacgcgaatctcgcctcttccaccacacgcaaggttttctggaagtcctcttcggtttcacccgggaaaccgacgatgatgtcggtggagatctgcgcatccggcatggcctcacggattttacgcagaatgtcaaggaacttcgcggaacgatacgaacggcgcatggcgcgcaggattcggtcggatccggactgcagcgggaagtgcagctggtgcatgacattgggcgtttcggccatggctgcgatcacgtcgtcggtgaaggcggcgggatgcggcgaagtgaaccgcacgcgctccaatccttcgatctcaccgcatgcgcgcagtagcttggagaaggcgaaacggtcgccgatgccgtaaccgaacgagttcacgttctggccgagtagcgtgacttccttggcgccttcgtccacgcactggcggatttcggcaagaatgtctcccgggcgacgatcatgttccttgcctcgggtggtaggcacgatgcagaacgtacaggtgttgttgcatcccacggagatggccacccagcttgacaccttcgacgcgcggtcggtgggcagctggcttggaaagtagttgagttcctctttgaccttgacctgcgcatggccttcgatgcgcgcctggtcaagcagctgaggcagggaaccaatgttcttggtaccgaacacggcatcgacccaaggggccttttttgcgatcttctcacggtcgagctgtgccatgcatccgccgactgcgatctgcaggttcggacgctggcgcttcagttcggcccacaggccgatggtgccgtacatgcgttccgccgcgttttcccgcaccgcgcatgtgttcatgacgatgaggtccacgtcatgatcgaggtattgttcttcggtggcgggcacatagccatccgcttcgagcacacccgcgatgcgttcggaatcgtgcacgttcatctggcatccgagggtgtgtacgtagaacacgcccttgcctcgcgtggcggtgtcttctgtggcaggttccgcaagtttcgaggcgcgctccgcctcggtcatcatgtcttcgttcatagcattccatgctatcggcagggattcccatcacgcgccgtatgcaccttaatgcagcgtggcatgcggtggaattggagggatgacggcgctttcagcgctttttcagttttgccgcgctccttttgggtacactatggaaccgtgatacttgatagacagagccgcatcaataccagtgaactgcaagcacggctgaagtcggtgactttcgacgatggtccgttgccttccgatcagattaccgagttcattgatcaaatgcaggtgtatgagggcgcgatgtatgagatcagcaccaaactggagattctcgattccgagttccaggtgcgtttctcccataatcccatccatcacatggaacgcaggttgaagtccatcaattccattctcggcaagttgaggcgcaaggatctgccgttgacggtggagtcggtcaaggacaatctgtttgacgtggcaggcattcgcgtgatctgcaattatcgcgatgacgtgtattcggtgtcgaattatctgtccgcgcagaacgatattcaggtgttgcgtgtgaaggattatattaagaatccgaagcagaatggatatcgttcgctgcatgtgatttatgcggttcccgtttttctatcttccggaccgcattacacgcctgtggaggtgcagttccgcaccatcgccatggattattgggcgagtttggagcatgcgctgcgttataagacggatttgcctgacgcgaagctgtcggagcattcgcagacgttgcttgattgcgcgagaagtctgcagaatgtcgaagcgcagatgcagaacattcatcgcgatatcaatggcgcgccgcaggttggcgaggcccctaaggccggctgacgtctgccggtttgcgtttggccgcatgcaggagctggtcgatgggcagctgggcgagtatggtgcccgcgaaaatgagcgcgcagccgaggtaggctcgagtggtcatgatttcgcccagcagaagcgcccctccgactgcggagaagaacgattcgagcgacatgatcacggacgctctggtcgggggcacaagttgttggcctatgacctgaagcgtataggctacgccagcggagcagacgcccgcgtagacgatggcgatccagctttgcgcggcaccggcccagtcgatggatccttcgatgatagagccaatccagctgatgatcgcggtggtggtgatctgcccgaatgaaagcaggatggggtccatgtctcgtccaaaggtgtctatgacgaggatgtgccccgcgaaaaggactgcggtgaacagcagcaccatgtccgccagggtgatggatccgaatccgtcggtgacacacagcaggtagaagccgataacggagatggcgacgctgatgatgacgctgaggtgcactcgtcgacgcaatatgacgaaggcaagcagcggagtcatgacgatgtatagagcggtgatgaagccggaccgtcccgccgatccggagtaaaggatgccgtattgttggacggtgcttgcggtgaaaagcacgattccgcagatgatgctgaccacgatgggattgccggcccatttcggcatagcgacgattgcgccgttaccgagggtgatggacggttttccctgggtttcacggcgtttacgctcttgttccgctatggtgctgcggcgaaaccaaagcaacggtatcagagaaatggatccgagggtgaatcgggtggctccgaagaacagcggtgttgtggagtccatgccttgcacttgcgacacgaatgcgaatccccaaatgagggccgccagtacgaggcatgccatgccgccaatctcttttctctgcatgagcacccaccgtaaagcatgtctttgaccaacggataaagcctggccacattctggtcaggctttatccgttacgttgaccgaggagcaatgccaataatgtcccatcaaaggctgaaagccaaatgacgcgtgcgtccccaaaacgcaccgagggaaggcgcacgaaggtacgccgactgaggagcaatgccggggacgctccgtcatttggatttcagtcgcgattgccgaggagttggagaatatacatgaacatgttcacgaaatccaaatacagattcagtgcgcaaaggatggaaaccttcttgaccatttcggggccttgggcggaatactgttcaagcatggcgcgggtggcttgggcgtcgtagacggtcatgccggcgaagagcagaagtccgatggcagagacgatcatgagggtggtgttgccgggggcgaagatcatgagaatcacttcggcgatgataagcacgatgaggccgacgaaaaggatggggccggccttgagcatgttgatcttggtggtgcgtccgaacatggtgagcgcgaagaagaagccggcgcacaatgcgagggaaatgccgatggtgccaagatcgtaggccatgaagatggtgctgagggtgaagcccatgaacgccgcatacacgtagaacatgacgtatgcggtggagactttcattgtatggatgcgcgcgccaaggtagatggcaagcacgatttcaatgacggcgggggcgaagatgccgatgatgcccgtggtttggatgagtgccaggtacgcgccgctcatttgggtgatgatggcgaccacggcagtgacgatcaaaccaagggtcatgtgcgtgtatgcgctgttgacggaactgcgttcggcctgctcgtaggaataggtggcctgcacgttgactgcggcggtaccgttgggcgcataggcgtactgtggctgcgcattgtactggttgtactgttggttgtactggtattgattgttgaagccgttattctgggcgttgttaccctggggctgctgaccgaatgccataatcgctcctttttgctcgattgcgcatcacgatacggcattttcctgacgatttcatgaatattggcttaatctcatgatttcttcaaagcccgcataggtttcgcgttcgacacggggagtgtgccggacgcgaaagactgggacatgccatgtcagatggcgaacttgtacgtcactttggcggtgtcgctgaaatcgagaaggttcgtcacgtcgacggtgatttcggaatcgtctttaagcacatatccgagggttaccgtgccggttgctcctggctgcagttcagacagataggagccggaatcgtagccttccggattgtccaagtacatggcggtgtcgagttcctgaccgttttggaacactttcggattagccagcacggcgaaggagttgttcttatcggtagtgttggtccactcgtaggtgacgagcacggtcggctgattgttgtagtcgttgccggaacgcactgcggatacgattttgacgtgcatatcggtgagatcgccttccatgtcttgctcgcctttcgccttggtgtcggttttggtggaatcatcggttttggcgtccttatcggcgtccgccgacgaggattgcgacgtgcttgtgcccgtgatgtcgtcaagcgccttgctggcggccgattgcatggccaaggtgatgacgatggccaacaccgacagcaccgccgcgactatggacagggctttgccacgctttttgcctcggaacgtgcccacgatggccacgatcgccaataccgcgccgacgagtccgaagatcgccgcgatgttgttgatgattggaatgaagctcagcaccaagccgagcgcgccgaacaccactcccacgatgccacataccgtcgtgccttgcggagccggggacgacatgatcggcgcgggtctcataccgttcggcgctgccgggccgccgttgggaatcggagcattgttgaactcactcatgatctttttctttcttctcgaagtggtcggaacactttcgagcctacgggatcggcttcgttcccggtattggacgaaagtccattcctgtctgcactttggggcgcgcggcttgcgccatcatgcccgatagctcaatggcatgtttccatgagtatgccgataatgggagtcatgagcgtgatcacaaacccttccaccgccgaagtgccagtgcgcaccagaatctggtgcacggtgccgatggtggtgtgcgcgagtttcgcctgtctggcgcaggtgtctttcgcatcccaacagtatgcgcaggatagcgccccctacttgtggatgatcgcgtgcgtgctcgttgcgatcccttcgggtttgattcttctggctcgcaacagttacccgcaagccgtgttctggaccgcatgcctactggtggtggcgctcccctacgattcgctgatcgcgcttatggcgttgacttctctgcttgcgcggagacagggaaccaaagtgacgcttcgatcagtgcttgccgcggcgacaacgacgatctggtcccaggtgcgagacgctttgcatcctgccgaggcttcgatctggcatgcgatcttctccaaaccatataccggagttcggtatggcaataccatggtgatgcttgtcgacgaaagaacgatcatcgcgagcgccgttgtggttgccctgattgcggtggcgatcgccacattggccggattgcatattcgctcgcgcgcccttgcgcgcgtggccgaagcgaaggctcagtcggccaacgagcaggtgagcaggttgcggaccacgcttgacaatcagcagcttgccgatgcgatagccgcggaagcgcatgatacgttggctcattcgctgtcgttgcttgcattgaatgcgagcgctttgcaggccgagtctaggaaattgaaggctgaggccgagcagttgggcaatgccaatgtggctggtatggctggaaagatcgccggcactaccgaggatatccgcaggcaggcctccggcgcgttggatgaggcgcatagtgtgattgacatgcttcgtcatccggaggatgctcgcctgcagttggctgcgaatgatgccgaagcgtcgttgacccgtgactcattgctgcagttgattggcgacgcccgtgccgcgaatatgcggattgatacgtggatcgacgttcaacagctggggcagttagatgagtccatcggcgtgattgcgtatcacgtggtacaggagggattgaccaatgtgcgcaggcatgcgcctggcgctccggtgtcgttgcaggtcgatgcgaaccccccgcaaggggtgcatgtgcacgtcagcaatccgacgatgccgcaatccccctcgcatatggcagacaccaggaagggggccggtcttcctggtttggccaaacgcatacagcaggctggcggaacatgccaatacggttttgaccaacataacgtcttccaccttgatgtacggctaccatgggttgggtgagcaccgaacgcaaccatgacgagcagccgatcaccgtcggcgtgattgatgatgatccgatgatctgccagatgatgcgtctgattttggaggattattcctccggacgcatcagcgttgccttcgcctgcaccaacgcagcagacgccatcgaacatgcgtcgcacaatcctcctgatgtcgtgctggctgatatcgccatgcccggcatggatggcattgaagccactcgtcagctccgcatgcttcccgatcctccgcatgtgcttattctgacgtcgctgagtccaaacaacacggtggaacgcgccatcgaagcgggcgcggaaggattcgtatcgaaaacggacgctccggaagatatcatccgccgtgtggccgacgtgtgcgaaggggagccacagttcaatccggcaagtcaacggcagctcatcggcgatttgcatcagcaccagcctcagtcgcggcgcgatgaggcccgtgccatgctcgacgccttgccggaacgcgaacgcgaagcggtgattctcgcggccgagggcttcaccaatgcggaaatcagcgagaaaatgttcatttcagaacgcacggtcaaagcgcatatttcatccgccgcagataaactctgcatgggccgcgtgcagatggcccgtttggtagaacgagccgacctgccgccacgactatgacatcatgcactcgtacacttgaacacagagcaacgcaatgaggggaacgccatgtcaatcagtgcaacggaaaagcctttaggcaaaatcttcacttcggattaccggttcgtaatcccatcattccaacgcgcatatacttggcaaacggaaaacatcgcgcaactggtcaccgatctgcaggacgcatgccacgacccagacacgccgtatttccttggatcgctgatcctcgtccatgatggacagaccaaataccaagtcatcgatggacagcaacgcctcatctcactttccatcatcatttccgtgctccgcgatctggaagacgaccccgaactcgtggaaagcctcaacgacctcatcgtcgagccaggagacaaactacgcggcatcaaagccgaaccacgtctcaaactccgcgaacgcgacaccaacttcttccgcatgtacgtgcaggaaggcgatctggagggactgttcgatctgcgcgacaacgatatcgaatcgcacgcgcaacgcaacatcgccatcaacaccagacaagtgttcgacgaactcgcgaaaatgcccacacaagaccgccgcgcattcgcatcatacctcgtcaacgaagtcaccctcgtcatcgtaaccaccgacgatctcgccggcgcacaccgtattttcgacgtcatgaacatgcgcggagttcccctcaccgcatccgacgtgttcaaagcaagaaccatcgccgaaatctcccccgccgcacgcaacgcctacgcttcacgctgggacgacatcatggatccactcggcgacgacgcacagacgctcgaagaattcttcagcgacatccatctcatcatctcgcacaaagccgtctgcacacaactacttgaggaattccgcaaggacgtgctcaaaccattcgtcaaaaagcagaacgtcatctccttcatcgacgacctgctcgcaccctacgccaacgcatggcgcatcatcgaacacccgaccgacgccaacctgccagacgatatcattggccaactcgtatccctcaacgactaccaaaccaccgactggaaaccagtagccatgtgggcgctcgtcaactccatacgcaacctcggcaatcccgacacacgcatattctccacgccgggcacacacactgccgcagcctcgcgcacgtcgaacaaaaacctcgaggaacctcaactccacgaccttgaacgacttcacgacgtactcgcggccctagaacgcgtaaccggcgtggacagtctcaacaggcaaaccccgctcaaccgacgcacacgcgcagccagcaccattcgcgacctcgataaaaaccacaccatccaacaaatccgaggattactcatcaccgacgaagaccgccgcaacgcgctcgcgcatctgcgtggcgacctgcagaccagtcccgccatgaagaaactgcttctggttcgggccaacgagcagcgggccgggcatcgtatcacccgaccacgcagcctcaacgcgctgccgatcatgccggaacaggtcgcctccgactcatcgtttgcatcatggtctgaggcgacgcgcgaccattgggtcaatcgcatcggcaatcttgcgctcagtcaggctaatgacaagcagatcgcgggattggcatcctatacggaccgtcgtgaccgtatgctgctgtcggcgagttccaaacgcttcccgctcaccgccgagcttgccgacattgcggactgtacgccacaaaccttgcaataccgccaggatgaaaccattcgtctgatcgccgattattggaatatccgttacgatgccgagcgcaatgacctatccacgctcagtgaggagtcgttgcgagtcacggacacgtccacctccccaacatccaaacgcgtgtccatcgcgcaggtgctcgccgctggtctgctcattcccggtgagacgctggtatgggaccgaccgcgcaagggcgaacgttgggtggctaccgtcaccgccgaaggcaagcttcgactggatgacggcagcgagtactccacaccaaccgcagcggcccgtgccgtcggtggcggttcggcgggattgaccgtgtggaagcgcacgtcgaacggtcagaagcttagcgacgtgtggaaggcctatcgcctacgcaagcgctgaaaacgttgttcgttttgatgagtttgccgtttatcgacggtttcctattggcatgcgagccattcgaccgcaagtttcgtacgattcgtaacgttcgttttcgcgagaatatcgctgatacgattgcgaaccgtgccttcgcttaaaaacagtttcgcagcgatctcacgattgtcgtacccctcggcgaccagttgcatcacgtcccgctcgcgctcagtgagattcgcgaaacgaccggaaaaacgattttccccgttatcgccagcttgcgaaacgtgacgctgcgtctgactcgctttattgacatgcagtttccgcaacacctgcgctcccataaccacctgtccggccatcaccgactgcactgcgggaatcaccgatgagacatcctgtttgatcaggtagcctttggtgccgatttccaacgcctcggcgatgtacgattcgtccgcgaatgtggtaagtatgaggattttcgcattcggatgggcgtcgatgatctttcgcgacgcggcaagaccgtccataaccggcatttgcacgtcgatcagcagcacgtccggattatcttcttcatactgacctaccgcggtttcgccatcataggccgtccatgcaatatcggccgtgcctgtcgctttgagaatcgtggacagcgacgagcatacgattggatcatcatcgacgattgcgactcgcatcatacgttctccttcgttgttgcggacgctgccgcatcatcgtccgttttgggaatggacacgaacacccgccacccctcatgatacgggccgcacaccgcggtaccgccgagcgcccgcgcacgctcctcgatatccgccaatccaatgcctgaagcatcacgcatcgtcgccgtacgcgcggcatcatggaactgacgaaaacgagcggaagactcccccatcataccgttgatgtttccttgggagccatcgttccacagggcgccatcatcctgtatgcgcagctgccataacgcaggaaaatcacgcaaggtgatatcgacattgcgcgccatgctatggcgaatcgtattgttcaacgcctcgcgaatcgtcgtggcgaaacagcgtgacaccgcggccggagccgcatcgatgccgttgctcaaggtgacgttcactgtactggaatcgtccaaaccatgcgcggatgcctcaatctgcgccacgaaatccgtgccttcgtctttcagatcatgcaccgcgccccgcaccaatgtcatcgcctcgcccaccgtgtcgtgaatctgcgcgaacccttgagccgcctgctcctgaccagaaacctgagccaccacttgggccgcttcggactgcatgatggcccgggtaagcatatggccgacattgtcatgaatctcgcgcgctatgcgtgtacgctccgcgagcgtggccacacgaaccgacgcggcgcgatcttcctcgctttccgccaattgcgagcgcagccggcggatctggtcacgtttggaatcctgaagccgcctgttctgccgggtgagcgtgacattgcgcgcgcacaacaggccaaccatgaatcccaacactacatgcaatgccagcagtacggcgatgagtgcagctcccatatcatccgcatgcgcgcctgcattacggcaacggaccaaggtcgccactacgggaatgatccacacccatcgtgcgatgaccgtcgtgatttgcatcgcatcgtattgcggcatgttcggcaattgcgaacgcaagccggcatggttccgtcccgcacggggttgttcgacgttctgtgatatggcgggcagcatggccgcgttgtatgcggcgaccggcatcatcgcgcaccatgatggcgtgaagcatgcgccgcaatccaacatcaacagtatggcgatggtccatgccgacgagcgcgcgtattcccccaccgcggcacagcatatggccagcaacgcgccgcataccagttcagccgatacgtctccgacgatatacaggtttgcgatcagcccgaacgtgaggaatatggcctgaagcaataatcgccgcatgccttcctccatcgtcgccgcttcttgtggttatgtcttaccagcgtagtgtacgttgccgccgttgcgggccatctttgccacgaaggtgacatttgtcatcttccatatggctgtgttgcgccaggtttatgacctcagacaccatgtcgtcgccgtttggtcggagacaatggaatcactatcgtaaacggcggttatcgctgttggaacatgtgaggtaaggagagccgatgagcgagcgtatggaaaggcaaacaggtgagagctccagcagcgcggtcaaggtgtcgaagctggtcaaacggtatggggatatgctggcgcttgactatttcgatcttgacgtgcatcaaggtgagattttcggtttgcttggaccgaacggttccggcaagaccacggcgattaactgcattctcgcattgttgacgttcgatgagggcacggtacgtgtgtttgacgaaccgattggcccgaccagttatgcgctgaaacgccgcatcggcatcgtaccgcagaatgtggctgtgttcaatgaattgacggttgaggagaatatcgattatttctgctcgctgtatgtgcctgacagggcacgccgtcatgcgctggttgaggatgcgctggattttgtgggcttgcgcgattaccgcaggttccgtccgtcgaaattgtcgggaggtttgcttcgtcgattgaacatcgcatgcggtgtggcgcataagccggatctgattttcttcgatgagccgaccgtcgccgtcgatccgcaaagccgcaatgcgattctggagggcattcagcgtcttaaccacgaaggcgcgacggtgatttacacgagccattacatggaggaggtcgagcagatctgcgaccgcattctcatcatggatcatggcaggcatttggccttgggcaccgccgacgagttgaaggcgatgatcgacaccggcgaacgcatcagtgtggaaaccgacgatctgggtggcttgcatcatgaggcgggaacgcagcaggcattggaacagttacgtgcgctgccatgtgtgatgagcgccgattatgacggtcatgagttgacggtacgttgccgtaggggcgatcacaatcttcttgacgtgttgacgttgctgaaatccaatggcacgaatatcgggcatctttcctcccggcagccgacgctgaacgatgtgttccttgaactgaccggcacggcgttgcgtgactgacggaatcatggttcgaaaggtttgacattatgttgcagacattgctggtcaatctgaaattgcatttcagggagaaagcgcagctgttctggctgtttgcctttcccatcattctggcgaccatgttcaatggcatgttcggcaatatcgcggaaagttacgcattgcacacggttgacgtcgtcgtggtcaataacgacgattggcgcgcctctccgggcgcgcagatgctggtcgacggcatttcgtccgatactggcgcgaccggtgccgatggcgatcatgcgaaggtcgatgatgacggtgacgccatgccgaaactcatcaccgtcacggaagccgcatctatggaagccgcggatcgagcgctgcttgacgccaaggcgcagggcagactgtccgtcgacggtagtgggaaactgcagctggccatttcccaagccacgcaaacatccgccacggatgtgatggcgtcgagcagtggtctggatatttccctgacggtgttgggcaatatcgtggacttgtacaatcgcaacaccgccgtggtgatcaataccgcgcagcacaatccgtccgcgttgttggatgacgcgttcaccggcagcatcggctcgtcgagtgggttcacgaaggaagtgcagctgacgaatttcaagccaagcggcaccgcacgctactattacgcgttgctcggcatggccgcgatgatggccatgagtttcgcggtgaacgcggtatcgttggcccaggcaaacctgtcggcacttggcattcgccgttccgtcgctcccctgccgaaactgcaacagctgctggcaggttttctttccagttggatctgctcgttcctaagtctgaccgtggccatgctgtacattcgtttcggctgccagatttctctcggcggtcgtgaatgggccggcttgggcgcgtgcttgatggcgtcattcgccacaagcgcgttcggcacgttgatcggcgcaatacagggtgtttccacgagtgccaagcagggattgtgcacggccttggcatgcacgctgtcgctgttttccggtttgtatggctcgttcgccatggatttaagcgatcagatagcgcagcatgcgcccctgttgagcatgttgaatccggcgcaacagattacgaatctgttctacgacattctgtattacgacagtttccgcccgttctttgccacggtgggcgtattggctgcgatgagcttggtctgtcttggtatggcgaccgttctgttgaggaggcaacgctatgaacacttgtaaagcagcactgcgcattctcaaagcgcgcaaattgtatgtgattatctacttggtgctgatcggcacgatgatgttttccatcagctggcagatcatgcgtggctccacagctgccagagcgacgacgtatgagccggaatccgcccgtattgcggtaatcgaccgtgatgacgacgccgagcatgtggctcaatcgttgcgttcctacctcgctttggacggtgagatggtcaccattgatgacgattccatatcgttgcagcaggctgtcgcatcgaattatgttgatttgattgcgattgtgccacaaggtttcgccgagcgttatctgcagtatgcggataacgccacggctacgcaaccgaccatagataccgttgtcagttatgcttccggagccggatcgctcgcacagctgaaagtcaacgagtttctttcgctgacgcgtaccgcctatctcggcatgccgcaggcacagcgcacgctcgacgccgccatggcaacgacgttggatgctgccaccgccgatatgaaacagtcgcatatcgccgtggtgtcctcggactctgaagatgacggcaccacaccgggctcatcggcattcgcgggcacgctcaaaaccggcttgtatccactgttgctggtcatgccggtatgcacgttcctcgtggtcagcacattcaacgacaacgaaatccgccgcaggctctactcgtcccccgcgcgtctggtgtcgttggaagcgcagcaaatgctgacatgcgggacgttcggtctgctggtatgtgctgcgtataccgcggtgacattcctgttgatggcgctggccggagtgtcctttaccggcctgaatgccgtgaacgtaggcttgtcgttcgtgtcgctgatggtctacacgcttatggcgatcgcttgcggattcctgttggggtcatccggtttcaatgaaatggcaacgaacggtttcgtcaatgtgttcgctctgctggtcatgttcacttccggtatggcgttccccgtggatatgatgccagatcccatgatcatcatcggaaaactgctgcctggatggtggctctgctcatcgatagaccacgtattcggactgggtacggcctcctcgagcggcgtggactacggcgcgtgggcgtcatcaaccggattggtggcaatgttcgcggtagcgttcatctgtctgggcttggccttgggacgcattcggcgagcccgcccgacgttggcctcccccgccacaacgcagttggccaagtagtcgacgccaacactgtggcagccgcatgacgatcgcatacgacgtccacggtctacttgagcatattcctccggtaggctgtgggcgtcgtatgcatgtactgcttgaacgtgcgcgtgaagaatgtcgatgatgagaaaccaagttttttggcgatgtcggaaaccggcatcgatgtggtgtccagcatttccgctccagctctcatacgcacgtcattgacgaattcaatcggcgtctgatcgaccatctcatggaagatctgcgcgcatttcgtacggccgacggaccctgctgaagcaatctcctccagggtgatctgtcgaacgtaattgtgctgcacgtaatcaatcatcttgctcaaaatagcaatcttcggattcttcctgtcgtatttggaagaaccattcttgccatgttcgcccgctatggccgtcagttcacgcaccatcgtataaaaacagctgagcacggtcaacgatgccgtatcatcctttaatttcatattgtcaacggtggcgggatgcatggtctgggcagccggcatctgaccgaatttcgcatcatgcagccgcatcatgcattccagcaacgcggatccatgctcatcttcaggatcacacaccatgtacgggagccgttcgtccgccatcaacggagccacaaagcgttcataaaccatgttcggcatgcacatgcatgaagggttcagcagagtgcaggaaaattcgcaatcggtgccgtcctcggtgaaaccgtaatgcaattggcgcgaattcacgaaaatgccttggccttcttcgagacgaatgctttcgccgttcacgaaataccacatgtgtccacggatgatgtgggtgaattcgaagtcgatatgccaatggcattccgcgcgcatgttcggatactgatgcagcagcgaatgttcggtgaatgagaagaacatcggcgcatcatattgcaccatttccgcgccgttgggcttgcgtccccagttggtgaccggcatgaactcatatggaagacgaccgtcttgcgcaagttcaggctgttccgtttgttcgttttgtccgacctgcacgtcacgaacgtctaatcccatctgtcccatgcaataccccatcagtggatacggtaaataatacgaaaatcaagaacgataatacaacgaaatacagtgtcaacgaataatgatgccgttgaatggaacatgatatgtcacgtcaatcgattgacgtaatacagcagaggaggcagcatggtggaacccaccaatcatccggcacgcgacgaatgggagcgtatgctctccggcgaactgtatgtggccgatagtccgcaacagcaggaagcgaatatgcgcaagcgtcgcttggtgcaggccatcaacacgtccgaatatgacgcgttcaaagaacgtgacgaactgtttcacgaactgttcggcgcatttggagagggtggattcgtggaacccccattcaactgcgattatggatgcaacacgttcatcggcaagaatttctatgccaacatggattgcattttccttgacgtggcacgcatcaccatcggcgaccgcgtgttcttcggcccccgagtgggcctgtacacgccgtatcatccgatcgatgcgacggtgcgttcctccggccctgaaggcgctcgtccgatcaccattggcaacgatgtctggttcggcggcaatgtggtggtcggccctggcgtcaccatcggcgatgatgtggtgatcggtgccggatcagtggtggtcaaggacattccttcgcattcggtggcagtcggcaatccatgccatgtgatccgtgagatcaccgacgccgaccgcgaatattgggaaggcaaggcagcggaatatcacgcttggaaggattcgattcagtaaaacgcaccgcaccatcctcacatcatcatgcaatcttccatcacttggcgcgagtttcttcgacagacgttgacgctcgccctgcccatcgcgtttcaacaactgatgctggcgctgtcatcgtgcgccgacactcttatgctgacgaacgtcggtcaaaacgagctgtcggcagtgtctcttgccacgcagttccagttcattttcagtttgtgtcttgccgcgctcacgcttggcatgagcattctggtggcccagtattggggtgcgggcaacacgaatgccgtcgaacgtatcttggcgttcatcatgctgtatgccggcggattgtcgctggtgtttttcgcattgacgctactcattccggaaacgttgatgtcgattatgacgaacgatgcgacgctgattgccatcggctcacagtatttgcgggtttcgtcggtttcgtacctgttcatcggtttgtcgcaaatgtatttgtgtctgatgaagaatgtgggtgcggcggttaccggaatgacggtaagcacggttggcgtgatcgtgcatgttgcgctgaacgcggtgctgatctatggttggttcggtttacccgcattgggtattttcggcgcggcgatttccacggtgatttcccgagccatcgaactggtgtggtctgtgcttgtaaccagccgcaatggccgcccacgtttgcggttgtcgatgatgttgcatccggatgtggcgttgcagaaggatttttggaagtatagtctgcccgtgcttggcaatgagctggtttggggctgcggtttcaccatgtacaccgtgattatgggtcatcttggtacggatgcggtggcggccaattccattgcgaatatcgtcaaggatctgttggtctgtttgagtcttggccttggcaatgcgggcggcattcttgtcggtaatctgcttggccgcaatgctttcgatcaggcgaaggttatgggcgacaggctctgtgtactggtggcggcagttggcgttggaaccggcctgttgattatcgcggcacgtcctttggcgttgcagtgggcgggattgacgccgcaggccacgcgttatctgtcggttatgctgtttatctgcgcctattatgcggcatgcgggtgcatggccaatctgactatcgccggtattttccctgccggaggcgattcccggttcggacttgtctgcgatgcgagcgttatgtggcttgtcgtcgtaccggtcggtctgttggcggctttcgtgtggaagttgccggtattggcggtctatgctttgctgaataccgacgaatgcatcaagatgattcctgctttgctgcattatcgaaagtatcgttgggtcaacaatgtgacgagacagaccgattccgccgtagtatcaaacgcatgaaaaaccggtatcgacaaagcccgtgtcatactgcattgcacagtgcgacacgggctttgttatttgccgatctcaatcatgtgattatttatttcatgagattgcgcagcacatactgaaggatgcccccgttgcggtagtagtcggcctcacctggggtgtcgatgcgtacgaccgcgtcgaattcggttgtggagccgtcgctatgggtggcggtgacacgcacggtcttcggggtgatgccattgttgagctcttcaacaccggcgatatcgtacgtttcggtgccatcaaggccgaggctctcataggactcgcctgcggggaactgcaacggcagcacacccatgccgatcaggttcgaacgatggatacgttcgaagctttcggtgataacggctttgacgccgagcatgacggttcccttggcagcccagtcgcgggaggaaccggtgccgtattctttgcctgcgagcaccaccagcggaacatcatgttcgatgtagtcgcgggatgcttcgaagatcgtggtcggcttctggtcaaggaaatcgtaggtgaaaccgcccggagtgacctcttcccccacggacgcaagcaactggttgcgcagtcggatattgccgaacgtgccacgtaccatgacctcatgattgcctcgacgggaaccataggagttgaagttcttcggttcaacgccacggtcggtcaggtacttgccagcaggactggaagccttgaacgcgccggctggagaaatatggtcggtggtcacggaatcaccgagcagtgcgagcacgcgggcgccatgaatgtcttcgacgggatccggtgtggccttcatgccatcgaagaacgtctgcttacgcacgtaggtggaatcctcattccatgcgaacagttcgccttctggaacgtcaagtcctttccaacgatggtcgccttcgaatacggaagagtaatccttcaggaacatctcacggctgacggtaccgtccaccacggcggcaacctcgctattggtgggccagatatccttcagatacacatcgttgccgtccggatcctcgccaagcggctgggtttcaaaatcgaaatccatggtgccagcgagcgcataggcgatgacgagcggcggagatgccaggtagttcatcttgacgtccgggctgatgcggccttcgaagttgcggttgcccgacagcactgaggtgacggtcagatcgttggcgttgatggcttcggagatttccggcagcaacgggccggagttgccgatgcaggtggcgcagccgaaaccgaccagctggtaaccgagcgcgtcgagatcgtcctgcaagccagccgccttaagatagtcggccacaacctgggaacccggtgcgagcgaggtcttgacccacggcttgggcttcaaacccttggcatgcgcgttgcgtgcaatcaaaccggctgcgatcatcacggacggattggatgtgtttgtgcacgaggtgatggatgcgatcgccacatcaccgttggtgatgtcgaagtcaccgcggaagtcggtggaaacggcaaccggctcctgcacggtcttgtccgtttcgtacgcgggcaaggtttcgacgaatttcgctttggattcagacagtttgatgcgatcctgcgggcgcttcgggccagcgatcgacggtacgacagtaccgaggtcgagttccaggtattcggaatactgcggttcgacgtagtttggatcggtggtgtcgccccacagcttgttcgccttggcatacgcttcgaccaatgcgatctgttcttcggaacggccagtcaagcgtagatagtcgagagtgacgccgtcgattgggaaaatgccgcaggtggagccgaattccggacccatgttgccgatggtggcacggttggccagcggcaccgaggcgatgccatcaccgtagaattccacgaatttgccgaccacaccatgctggcgaagcatatcggtgatggtcagcaccacgtcggtggcggtgacgccttcaggaatggaaccggtaagcttgaaaccgacaacacgcggcaccagcatggagatcggctgtccaagcatggccgcttcggcttcaatgccgccaacgccccaaccgagcacgcccaagccattgacggtggtggtgtgcgagtcggtgcccacgcaggaatcaagataggcaagagtcttgccaccgttttcttcgaccttggtcatgatgaccttggcgagatattcgatattgacctggtggatgatgcccgttcccggcggtaccacgcggaagttcttgaatgcctgctgaccccaacgcaggaactggtaacgttcgccgttgcgctggtattcgatgtccatgttctgttcgaccgcgtcggcgatgccgtacttgtcgatctgtacggaatggtcgatgaccatgtcggactgcacctgcgggttgatgacctcaggatctcccccaagatccttgaccgcatcacgcatggtggcaagatccacaatgcagggcacgccggtgaaatcctgcatgaccacgcgggacggggtgaactggatctcatgactcggctgtgcagccggatcccaatccaacagtgccttgacatgatcatccgtgatgttggcgccatcgatgttacgtaccaggttctcgacgagaaccttcaacgaatacggcagatgatcgatgcccggcagatctgcgatgcggtaatattcataatccttgccgtccaccttcagggtgtcgagctggtcgtcgcgcacagacatgctacctccgagctttttggctgtataacacagctgattattcgtcgcctacgatacagccaagttaattcagctctggcgtgtcttcttaaagtatgggacaatactcggaattttcggcaccaaacgcaaacacaccaagaacacgagtgccgaaagcaccattgccaccgccgtcgcagccagcatctgcccggtcggcaccaccagcgcgaagaaattcgccaccggttttacgagcatgcccccgaatccaattgcggcaaaggccaataccaatatgccacgccacgaatgcaacggctttgccacccgcgcaagcacgaacactcccatcatgagcagaataatcgcgttgacgccacgcagcatcgccaactgcgcacccgaatcctgcacattccacttcatgaatatcggcagcagccacgacgtggacaaaatcgacaatccgaccgccacaccgcagggcacagcaaaatgcagcacgcgtttcaggaatcctggaatataacgacgcgtgttcggagccaacgcaagaatgaatgccggcatgccaatcgtcaatccacccacatatgtgatgtggcgaggcagatatgggaatggtatctgcgtcagcaccacacccaacgaaatcagtgcggaatacacggttttcacgaggaataggcttgccacacgttccatattggccataacctgacgccctcgcgccaccacatcgggcagatgtgagaacttcgaatcgacaagcaccacctgtgccacggccttggtggcgggcgcagcattgcccatcgcaatacccagatcggcctctttgatggcgagcgcgtcgttcacgccgtcgccggtcatcgccaccacatgctcacctgcatgcaatgcctccacgatcgcctttttctgatcgggcagcacacgcccaagcacatccacgttttccagtacttgcgccagctccgtaatgtcagcgggcagctcacgcgcgtccatgaatcgtggttcatggtcgccggtcagatgcacttttcttgcgatcgcgccgacggttacgggattgtcaccagagatgatgcggcaacgcacgccttgttcacggaaccatgcaagcgtttcttcggcgtcggcgcgaatatgttcggaacagcacaccaacgcgacagggcacgatgccggattgagttttggatcggtttcgtaatcgtcgggcgctgcaccgtagattcgcgcgaccagcagcacacggttgccgtcattggcgagatcattgacttgtttgagtatgtcggcatggtcaccgttgatttgggaaagaatgacttccggcgcacccatcgtccacactgcattgccgtcatagatcgaactccacttgcgcgccgacgagaacggtactcgtgcctcgacagtgccgtccgcaaatccctgttcccgtagtccagacagaatcgcttgccctgtaccgttgggctgtccttcgttcgataggtcgaatagagcctgtctgacgtcatgctcgttcacggtgcctcgcatgtcgtcggggccacgaacacccagcaattccaacgaatcgagtcggatggtgccgtcggtgacagtaccggttttgtcaaggttcaggcaatccacacgagcgagagtctccacggattccagctcctgcaccagcgtgttcttacgtgccaaacgaatggctgcgagcgcgaaattcagcgaggtgagcagcaccaggccttcagggatcataccgaccacaccggccactgcggaaatgaccgcggaacgccattcgccggtcgaaatggccacattccagccgccaacagtgcgtacctgcgaccagatgagcagtacgcagagcggcaccaccaggaaggtcatgaatttcagaatcgtgttgatgcccttgtttaggtcggatacggttttcctgtaaaccttcgcccgtgcggtaagtttggccgcgtaactgtgctctcctacggcggtgactttcaccaacgccatgccggagatggcggtggatccagagaaaatatcgcagccttcgcccttgcgtacggtccgtgattcgccggtaagcatggattcgtccagctccagtccccaagtgtgcacgatctgcgcgtccgcgggcacctgttcgccggaacggatccacatgaaatcaccgagcacgatatcgttgtgcggtatttcaacgtctttgccgtcgcggtgcacaagatagtcggaagccaccagaatcgacagtttgtcaagagtacgcttggctttcaattcggtgcagatgcctatgccggtattgatgatgatgatcatgccgaacaccgcgtctctccacgatccagtgatcaataccataaccatggccgcaaagatgatgccgttgaacaaggtgaacacgttggctcgcacgatatcgataagcgaacgtgaggtcgatgccttgaccacattgtccaatccgctttccctgagggcgatcacttcgccttgtgtcagccccgtctcttcgatgaggggcattgttcgactttcgctcatgattgccagcctaccgtcacactcccgttttccggtcaacttcttgtgaaacacaggtaaaaatcagggaattttcagggtatttcatcaaaagacgaactgctggtcattcataccgacatggtgcaaaaccatatcagtgggtaatcgtggttaccagcatttcccggtcgtgaggatcattattagccacggccacagcagcatcgtcgagcggtatcgcgtcggtcatacgatcgttgaccgtcatggtagccgcatacagtttgttgtctttcggcacggcgataggattgagaagcaccactggaacgcccgctgttcttgcggtttccaaagcatcattccagttttcggcattggcttcgttcgcgtcgattcctgcgatgataatgaggtcggccttgcgttgcgccatgtcacgcacgccttgctgcgcggtggattgcgcgtccacagtgcccgagacggtaatgtacaccggcttgagtttaccggcttccatggcatccattgccatggaatcggcggtgacatcatccgatccaatcatggcgatggacaggctgtcacgatcctccatggagtgcgccaccgcagtattgggagattgcgtatcccccaccgcggcattcgacggcacgcaaccagatagcgccgcgcaagacaacgcaatcgcagtcattccaaaaaacgcacgacttgcgaataacggcatgctcactgttcgtgctttctgaacagcgccacagtctccacatgatgggtcatgggataaatgtcgaacgcgcggatatccgccaattcgtagccaagtaacacgagcgtggcggtatctctggcaaggcttgccggatcgcatgcgatatagaccacacttttcgcttcggcttcggcaatctgcctgcacaccttcgcgcgagcgccagcacggggcggatcaagcaccaccacatctggcttggcgagatcattgcgcacgttggcaagtgttttcgccacgtcgcccacacgcgcatcgacattacccagatgaatgtgcctcaaattacgttgcgcgttccttaccgcagttttgccgccttcgacgctcaacatgcgagtgcgctccgccgtcagcgtggccaacggcagcgtgaacagacccgaaccggaatacaaatcccacagacatgcggatttggcaccgtcaagctcgccgcgtaccaaatcgatcacatggttggtcaaagcgatcggcgcatgcctatgcatctgccagaaaccgcctgcatccacgttgtattcgaattcacggccggcgacaatcaccttttccgtaagctcacggcttccagcaaccacctcgccgttcacaagcacggcgtaattgtctgaaatcggcgcattatcgcgaggttccggaacggatagacgaatctgggaacccggttcgaagctcccttcccacacatgctcacgttcggccacttccagcaacgtacggctggccaacggcatggtatcaatcggaacgcgcacatgcgtgcctcgacggtgcatcgacggacgcccatcagcatcagcaatcatctcgatgcgagtacgccaatgcaaacctcgctccgcatcgtcttccgacatacgctcaatgggcacttccacgtcgacgtggccgagtcttgccatctgttcggccaccgacgtgactttccatttcagttgccctgcaagcgacacatgcaccaagtcagcgccgccgacaccaccgcccatggcaaggggtccagctaacgaccatattggatcagtacggtcttcgctcgcttcgagtacttccaccacttcgcctgtccagaagcgatcctcacgatcatgcggctcgtccaatgcgacacggaccagttcgcccggcaatgcgaatcgcacgaacacaacacgtccgtcaatatgaccgacgcaacgaccctggtcggcgtaccgttcaatgcggatggtcgattccatcagtgctcttccctcatttcggtagtttgtgctgcctcagcatcgtcttcagaaacttcctgcatcatcttatgtcggtgcattggcgtcgccacgatcagatacgagacccaaatcgcgagcgcccagaacggaatgcccatcagcagacgcgctgttcccagccagccgacgtgattgccgagatagagcggcacctgcacgatcagacgcagcgcgaacactccaacccacattgcggtgatgatggtataggcgcgattgagcgccttgtcacctcgccaatcggcaagccaggcacgaaaatgttcagtcggtaacgttcggatgaactcgatgaccaatcctaagccaggcacccggaccagcagtgaaatcgtcagcaaaacaacgtaaaaggcgttggtgagaaatccgaacatgtaatagttacgtgcctcgtgactgttccatgcccagatcaggcagatacctactgccagcaagcctgataccgctcccatgacggactgtcgttggcacaggcgcacgatcacctgcagcacggccaacgcagcggacacgccgatggtcagttgcaaattggacgtgatgacgaacagtgccacgaacacgacgcccggcagcatcgattcgataacgcctctcggaccgccgatggcgtcgatcacggaaaaatcgtcagtattaccggcgtcggcaagcgcaccaagaccagttcgttttttcgcttcggtttcagccatacgtattagctatcggttcaagcggctcaacgcacttcggagaacatcggtccacgagacagcgtggtcttgacctcaacctgctggtcggagtcgaatggacccttcggtttgccgggaatctcagtcttctgctcagcctcttccgcagctgccttcgcagccttgcgttcggccggagcgaccggcggatgcatgggaataaggtcgcgtggcgccaacggatcatcgcctcgttccaccacaatatcagcgaagaactggttcaatgcctttgcttcctcaccctcaggatcggtggcagccttgcctgagaagatgccgcgcaacatccaacgcggaccgtcgacgcctacgatgcgggtaagcaccttgcgtccacccttgacggtaaccggcaatgccagttcggtgccgaatacgccttcgacttccttcgcgtccttgttggcttcaatcaggtcggcacgaacgtcatcccacaatccgagcgtcttcggtgccgcgaatgcctcaatctccacactggaggaaccgtaggtgatggtggtgccaagaacctgctgggtggcacggttggccttcactcgcaattcaatgcccttcaggaacggcagataatatgatcccatatcgaggtactcgtcgtagtcgggaacgttctcatcttccacatcccacggaccatgctcgtcaccgcggccctcgtattcagcggaaggctccggaagcgccacgacttcctgagcttcgtcaacattttcagctgcgtcgacagcctcttcgttttctccggcggccgcttcaagagcttccttgctctgatgcttcttcttaccgaatccaaacaatcccatgatgttcctcatttcataacagttgcaaccgtgaatagcctagcacctatgcttaatatgggctgggaatcggggtgtgatattccaattcccagtctgttcacgataaaaagtggcttaaatgtcatacataatgctgagcggcgcatgatcggaccagcgcaggtcgtaggtcggagccttatcgatcacgaatccgcaggccgtttccgccagttccggtgttgcgaactgatagtcgatcctccagccgacattgttgtcgaatgcacgaccgcgctggctccaccatgtgtacggtccttggatgtctccggcgagattacgaatcacatccacaaactccagttctcccaaccatttgtcgacatatgcgcgctcctcggggaggaatccggcatgcgtttcgttggctttggcgtttttgatgtcgagcggcgtgtgcgcgatgttgaaatcaccgcagagcaccgcttgttttccgccgtgtgctgcctcgtcacgcaactgttccatgcgtatcagcatggtgtcgaggaaacggtatttctgcttcattttttccggatcatcggtatttcccgcatgcacatacacgcaaaccacggtaatgacatagccttgtggagtttgcatgtccgcttcgatccaacggccggaatcgacgtcatcctcaagtcccggcaatccatatcgtttgtcgacaaccggcaatgccgacaacagacctacgccggcacgccccttgatacggcaaatctcgttcatacgatgcagttcgctctgatcggaaatacgtcccgccgttgagtattcgaaaccgaattcgtcgaaaataggatcgatttcgttttgcggggcacgcacctcctgcatacaccacacgtcaggtgtgttgcgtccggcccactcctcgatgcctttgcgttttgccgctcggattccgttcacattggaagtcgtgatagtgatcgtcatagcgttctagcctagcttgcatacaagaaaagccctcggcacatgccgaaggcttatcttgatgatgttatcgcatcaaatcagtcaagaccgagctgcagcttgccgccggggatggcgccaagcagatcacgggtgtactgcttctgcggatggtcgaagacctcgtcagtggtggcgtgctccacaagcttgccgtgctgcatcaccacaacctcatcggcgatctgacgcacaaccgccaaatcgtgggtgatgaacaggtagctcaggcccttttccgtctgcaggtcattgagcaatcgcaacacctgatcctgcaccagcacgtccaaagcggatacggcctcgtcgcagacaatcacgtccggatcgagagccatggctcgtgcgatggcgatgcgctgacgctgaccaccggaaagctcgttcgggtagcggaaacgcacggaccacggcagttccaccatatcgagcaactcacgcacgcgggcagcacgactcttcttgtctccaatgccgtggatacgcagtggttcttcgatggaacggtaaatggagtacatcgggtcaagcgagccatacggattctggaacaccggctgcacgtggcggcggaagtcaagcaattccttgccttggaagccggaaatgtccttgccttcataagtgacggtgcctgaggtcggttcaagcagcttcagcaccatgttggccaccgtggacttgccggaaccggactcgcccacaattgccagcgtggtacccttcttgacggaaaagctcacatcgtcaacggccttgaacatctccttcttgcgcggcagcttgaactcgcgtgtcagatgatccaccgtgatgatggattcgccggacttcagggaatcttcattcaccttgtgttccatcacgccgctggcatcgccaccatgctccttgacggagatgatgcgctgcgaggccaacgacggcgccgccgccaccagtcgcttggtgtatggatgctgcggatgctgcagcacttccagagacgggccggattcaacgacctgccccttgtacataaccacgatgtgctgcgcacgctcagccgccaaacccaagtcatgggtgatgaacagcactgcggttcccaacgaatcggtgagcatctggagatgatcaagaatcttcttctgcacggtcacgtcaagcgcggaggtcggctcgtcagcgatcagcagttccggacggcatgccaagccgatggcgatgagcgcacgctggcgcataccaccggagaactcgtgcggatactggcgtgcacgagtggcggcatccggcagaccagcctcagaaagaagacctgcgatgcggtcatccatggtggagccgattacatacttcttggcgatgtaccaagcgtcatcctcggccacgccgaccttgatcaggtcgtcggccacgcgccaacgcgtttcagatcctgggacccactccgactcgaagtacgccacggtcttgtcgaagtcgtcgccggtcttaccgatcttggacagcgcttccttcgccgcggacaacagctcaggaagctccttggagccaaggaaagtttcatcgtcgttgcctttaagttcgacatcggcatcggcgagagccttcgacagcgaggaacgcttctcatgggcgatatccatattgttggcggccagagcctccttcacctgggtaccgatacgccacaccgggttcaggttgctcatcggatcctgcgggacaagacccatcttgttgccgcgcaacttgtcgaaatccctctgcttgtaaccggagatttcctcgccgtcaagcttgatggatcctccgaccacatggcctgtgcccggaagcagaccaagcaccgccatagcggacgtggacttgccggagccggactcaccaacgatagccacccactgacccgggtatacgctgaaagaggagttgcgaaccgcatgtaccggctggccatcatcagtggtgaagtcgacctggaggttcttgacttccagcagcggaccgttggcacgttgcatggcctcgagcttgttttcggtattcatttcagtcatcgaatatccctcacttacactcacgtacggctcttcggatcaagcgcatccttcacggcgtcacccatcatgatgaaggcaagcacagtgatggcaagtgccgcggacgggtagaacagcaccatcggatcggtacgcagaatggactgcgcattggagatgtcgccaccccagctgacggtagtggtcggcagacccacaccaaggaagctcaatgttgcttccaacacgatgtatgtagccagagacgttgtgcccaccacaatgatcggtgccaaggaattcggcagaatgtggcggaacaggttacgccacggcgtggagccaagtgcggtggaagccgtattgaactccagattcttagcttccataacagcgcctctcgcaattcgcgcaacggatgtccagccgaataacgtcatgaccagaataatcttccaaatggaatcgttggtcttgaacatctgcagcaccacgatggcaccaagcaaaatcggcaaagccaggaaaatatcggtcaaacggctgagaatggtgtcgacccagcctccgaagaaaccgctcaacgcaccgatcagcgtacccaacagcaccaccagcaccgtagcgaacacgccgacgctcagcgaggtacgagtaccatgcaccacgcgggagtacacatcgcagccttgcagatcgaatccgaaaggatgtcccttcgaagccggttccaaggagttctcaagcgtgcagtagttcggattctgcttggtcatcactcctgggaacagcgccacgaagataatgaacacaataagcacagcggaaatgatgaacatcgggttcttgcgcagggtacgccatgcgtcagcccaaaggcttgaagccggtgcggactcatctaccgagtcaacgtccttaagcggcgtctcctcgagaggagcaacatatcgttcctgtcccggaagcgcgtgagaaagattcgtctcgttcatatcagtcattgttcaatcctcccaactcacgcgtaacggattcgcggatcaagcgccgcatagagcatatcgaccagcaggttgcacactgcgaagatcagcataagcagagtcacaatggacaccaccagattgccttcacccttgagaatgctttgataagtcaggtaaccaatgccatgcacgttgaagatggtttcggaaatcatggcaccgcccatcagtgcgccaagatcctgaccaaggtaagtgacgacaggaatcatggagttacgcaaaacgtgacgattcatgaccgacctgttgtccatgcctttggcacgtgcggtgcgcacatagtcaagcgcgatattggaagaaatctccgaacgactcaatcggatgatatatgccatagacacagatccaagcaccattgctggcatcagcaggtcgatgaatcctggattggcaccggccgtaactggaagcagacgcaacttcacgcctaagaaatactgggcaaggaagcccgtgacgaaggtcggtacggagatgagcaacagagagataatcaggatcacggtatcgcaccacttgcccttgttcaggccggaaatcgcgccgaagatcacgccgaacacggcttcgaacacgaaagccatcagcgcaagcttgatggtgaccgggaatgcacgtccgatctggtcgatgaccagctgaccggagaaagtcttgccgaagtcaagagtcagcgcatttttcaggaacagcaaatactgcacgatgaacggtttatccagattgtattcggcacgaatctgcgcggcgacggcctcattgaccggcttatcgccaaacatcgccttaaccgggtcgcccggcaacgcgaacaccagggcgtacaccaaaagcgtcgtgccgagaaccacagggatcatctgcagaatgcgtcgcagaagatatctgcccattggtttctccttttttgcttattcattgtcaacctttttcagattattactcataatcatcggggaaggttaacgatttaccccgcaagttttgtggcaacacacaacaaactgctttatattgcagtttcatgggaatcagctgggaaaaatgcttggctaccggcatctaccccctgacgcctcttggccacactgatgtcaccctgaaacggtgcgtattacatggaaaggaaggaacggatatgatccgccccttcctgcaattggctcagcgagattcactcacgaagatcggctcacttgccggacttggtcatgttctcgtagaccggcaggttctgccagttcatttcgaaaccggaaacgccggtagcagccacaccgtaggcgttggcgtagtacagcggaacggccgggagatcgttgagcagcacttcctgagcctgctgatacagcttattggcctcatcggtggtctgtgcggcagcagccttggagcacaggtcatcgaactccgaattctatgccgagacgggttttggcgttcaccgtttccacggctttcggcagatcggaaggcgaggtgtgcagaatggaaccaacgtgcttgtcgacgatcagatcgtccaaatcgccgcttcgcgcgtcaagctgcatcatctgtccgactttttcctcaagggtcattcgaccaagcagatcggcgatgcgttcctcagtaggaagttccggattcctataaggcagatttacagtattttcagtggtttcggtcatggattgctcactttcctcattgaagcgattttctttaattaccaattggtagtttagtatatcatatgcacatccgcaactcgacataaacccgtcaacgcaaaaggcgagggaccatcagacctcaccttttcgcacgcgcatgcaatgccaatctcaacaagtattcaaaatcaacgatatgcatcccacaacggggatggaaacagcatgttttccatctgagcccactctttgcataaatcaacttcaggctcgcgcaaccaccataattgcacaccatccatgatttccatggccttacgcaccaccggtcgcatgctcgacttccatgaacccaattgcggaggaatcagccaaggatattgcgaatagttctcccaaatatcgtccatacgagcagtgaattcatcatgcaacggatgttcaggattcaacgattccacagaaagcacggtaaactttgaaacagacacccccaagtatgccaaaaccaagcgtcactatatgtggacgcagcaatgaacaattcccctatgacaactagcatggggagacattatttgtaaagcataaaagaaggtccattcaaatggagaagccgaacgatattaaaagagactccatatcagtgaattactttttgaatactgctgcgtacagcggtctcttctcccttctttcggttattctcaccggccaagtttctgcggcgtcatcgctatatgttgggctggcgctcggaattttatctcttttttctagaggcagtactgtttttataggtagcctgattgagcgtttctcaacggtatccctcaccgagaccggtttcggattcatggttttttcacttttgctgctacaaccggcaatgggtggttttatcggcttcctttttgcggatttggctttgctgggactcggtctttcattggttaattttgccctacgagggcatatcatcgctacagtaaaggataaaaaaattcaggcttctttgtttgctttagtgaccatggcagccaatcttggatccgcgattggacctctgggttcgaattacatatataaggctttcggacaaacgctctttattgcaatcatcgtcggactctatgctttttctgctttactagctccaatagcgctgactcatcatgtcttcatacgcaatgagaagagcggcgaggaaaacacttcctccatcgtgaagaccattacagactcgctgaaaagtcccggtacggttcttgccatcctggcggtgttcgtgggcagtatcatgaatggtcagctttttgccggaatggcattggaattccactcgttatccgatagtccagtcataagaggattgttctattccattgatgccatatcggtcatagcactgcaaatgccggtaagtaagatcatctcgcgcaatatgaccaaagaacataatgccacctcattcatagtcaaaagcctggggatttatggaatttccttcgcactattcgcctgcggagtctcgtcgtactggtggatatgcatcatttccttggttgtgttctccattgcagaatgcatctatgcgccattaatcaatattgctctggtagaggcacagccagataagcctttggtggacattctgaactatcggctaataattgcagccattggtgaatcggcaggctcattccttggcggttggatcgttccggcactacgtcctgcaggattgacggcttggtattggtgtgcactggcgttagtgggaataatgcctgcagtcgtcactaatcaaattagaaaacgtggacaaagaatcattcgtcattgaaagaaaaagtcttggtgagtacaccggaaggggaatgacatgaaagtattattgctgcaacagcccaaatctttctcaaattatcctaaatggattgaggaaatccaagaaagtttcgattgtttagaagttatggtcttcacctcgaacgatcgagccgcacaccatagttggccgagctccgtcatcaaggaaatcgaggtttccgattattcctctgatagcgctaccgcaaaattctttgatattgtcaggaaatttaaaccagataggatagtttccagctcagaggaagacgtactgagggttgcagaggcgagaagtttatttggaattcccggtttacagcatgaactggcgttaagctgtcgagataaagtcacgatgaaacaatcggcccttgatgccggattaaagattattccccataccacctgccaaggctttggagatattatttcggcgttcgatcgttgggagacggttgttctcaaacctcgatggggcgcagggtctgcaggcattacgatattgcattcgaaagatgacctgcccgctttagctaccaagccggaattcatacgaaacgtgcattcaaaccagtattacttagaggaatattgttccggttccgtctaccatgtggatgtagtctatatcaattccggttcgattctgatctcaccatcacggtatcttgtcccgccactggatttcgagaaacaaaacaccggttccgtgatgttggatgagaacggtgccgactattccgagctgctccgactgacaaagcaattaattgcatctttcaacgatcagacgattccgaatgtgatgcatatcgaattctataagaataaaaccggtgatttcgtattcggggaaatggcggcacgcagaggaggcggtctcatcaagcaggagctggcagccgcctatggcatagaccaaagcaaggccaacttcctattggaacttggtcttgtcgatgcggatgcgaatattacgcgatcatctcagtatggcatactgttggaaaccgctggattgaactggccaaaggaaaaagaaatcccagattgggcggttttggaatctgtgggcaagaaaaaaggtatcgctcataactctgttgattctgacaggaaatttcttatttccggcaagaatgaatctgagattattcaacgttctaattatcttataaatagtcaatataatgagtaaaattaactttttacagagggacaattgtaactaattctgcagcaggttctatatatgacgaattattatgtagaattggtaattctactgaatctagactcttccgtaaaataatgatactagtatcgctagggatgttgggagccagcattggcgtccatacgggaagcgcagcaggtagtctgactgcatcaaaatggtcgacatctcaagaaaccagcatgtctctttcagcaaacttttcaggcactaccacaatagaagataagcaaaatgagggtggccgtcaggtcacccccgaacgtatgcggaacacacataaaatcagcggcatgcatcccagaggggcgcgggaaacagcagattctccatttcggaccattcctcacacaagtccacttccggttcgcgcagccaccacagctgaatgccatccatgatttccatggctttgcgcaccactggccgcatgctgccggcccatgcgcccaattgcggcggaaccacccacgggtatttcgagtagtgttcccagatgtcctccatgcgtcccatgaattcgtcatgcaatgggtgatccgggttcagggattccaccgacagcacggtgaacagctgcaccatcatgcggcggcgcgagttgtgtttcaccaggtagcgcagatacgcgggaaaatgcggcgcggacgggtcgctgcccggcatgcccgaagagaagaagtcctccggcgtgccggtctgcccgtagtattcgtcatataccagcgccagcattttgtctttgttgtcgacgtatcgcaacacgccttgtttggagatgccgaccctgtcggccacgtcttggatggaaatgccattgaatccacgctcactgatcagctgaacagccgcatccagcacttccgctcgacgctcctgcggtgattttcggatacgtttcgaagtctcttcctctgccatgattccgagtctaatgcaccttgcgtcgattgccgttgattgactgcctatggcacgtcatcgtgagaggtatccgcccgaatccatccatgacgccatacgcgagtcagatcccacgcctcaagattgccgccgttgcgaggatcccgcggtggtttcccttcgccactacccggcttcgcggagcgcgcaagctggtagctccaatagatctgccccgccgacacgtcccatgccgcgcgttgcaatcgtgacacttggcggtatgcagccgatcggttttggctgtgtagggcccactgattctccacgcaccactcgcccaccagcacgggaatacgacgggccgccgaacggatggcgatgctactcgcgcccaccagcatccggtacagccatggcagtcgtcgcgatcgcaggtacaaccggcgtgccggtcccgaaaacagctgatcctccatcgctatgagatactgatgggtgtcgagcatgacgttgcacatgccagcacgacgaaaccaaccgccccagcggagtagtcggaaaccgtcatggaatacgatcacggtttccggacgtagcacggcgcgcaaccgggcgtaagcgtcgcggtagaagcgcttcagaaaacgcagtgagacatacgtgctaccggaagcctcatgagagtctttcgccgtgttcgacgtgctatggaacactgaccagctcactggttcgttgagtacttcgatgctgtgcagggccggttcgtcgcggtatcggcgagccaatcgctccagcacgttcagcgtgtactccaccaagtccgtattctgcgcccatttgcacacacccgtcagaccgccgttgtcgaagccattctgcgattcgggaacggtatgcaggtcaatcataatcttcagtcccgtctcccgcgcccaacggaacgcgcggtcgaggtacgtgatgcagcccggatgcccgggccagtcgccgaagatgaaatacggtatgggaatgcgtacgaggttgattccgtggtcggcgatgatacggaaatcctccagggtgatgtaggtttcgcggtgccgacgcagttcctcggctagattccgttcggaccagagggatacgtgcgtgcggtgcatccagatttcatcgtcttcggcgctgcgggtgaacggtttcggatccatccatttctccagcaccagccagttgccgaggttcacgccgtcgattcgctcgtcgatgcctagcaccatgcgtctcaccgcccttacgttcgggggttgcccgacttttcgtttccgcccatcacaacccatggcaaaacccattcggcccaatgggccaaggaaccgcgcgtcattcgcaacgttccttggttcattgtatgcgccccgcgagcggccacgcggccgctcggaatcggatcacagccggatcagggtcgttgaatgatcgtggtggccggccgggcgggatcagtcgacgggcttcgtctcgtccgcctcgtagtcgaagaagtcgaagtcggcggtcttctcgtgcagagcggcgtcggtgacggcgatgccgaccatagtgccggtgaattcgccgtacttgcagtattcgtcggagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccgtcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttcgtggtgacggtggcgtacacgctggtgagtttgcgtgcgatcaggctcgtgcggttgagcgatgccaacgattcctcgccgcggatgcgcagccaaccggggcgttccgtcacgttggcgaaggtggtcggcatctgccgcggcgaataataccagttgccgatcgcgccgccgtcgaagtcgtcgtgcccgggaatctccggcatcggcgcatccggcagatccggctcttcgacttcgagtttggccagattggagccgtccgccatgcgcagccagccgtcattcgtccatgtcatcttctgaatggcggtttcacggccaagcgtacaacgtaattccggcacaaacggacggctggtcaggtgcacaagatatgtctcgccgttcggcagatccacgtaggagccgtgcccggacttctgcagcacggaatccgggttgaaatagcgcggcttcaaatgatcgtcatcagcacgctcgtttgactccttcggctgcgaagtgacgagcggaccattcggatccggctcatacggaccccacacattgcgggaacggcccatggtcacggcatggttgtagccagtgccaccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacgcccggcttctcatagccttcacgggtctcccactccaagctgacgatgtacttcttgccattgtcatcatgtaaaatggacgcgtcgaaaccagaagatgtcagatataccggctcgctccacggaccttcaatgctctttgacttaatcagataattattcacgtcgaaatagcgtgcattcatggagttcataacgccgtaaatcacgtaaaacatgtcctcttcctcacaatacgtgagacatggagcccaaatgcccttagcgctcggcagcttggtgaggttcggcttcgtatcatcagtaagcacgtgggtgagcagctcccaatgcttcatatccttcgaatggtaaatcggaatacccgggaaccattcgaatgtagagacagcaacatagtagtcgtcgcctttacggcagatggccggatcaggattgaagcctttgaagatcggattatgcagcattgtcgttccttaatgttcttgatatcacgcgttgctttgtacgattcttgcgtccgacggaatcacttttggacggggaaccagttttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctaggccccggtacagcgagcgcttctgttcggcggtcagggtttcgacctgagccccttcctcgccgttgagcacgctttggccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcgaggaccacgttcttaaactcgggcgcgagcttgccgtcggggccgcgcatgaagtccttccactgttcgatgtcgaaaccgtcgtggaacaccacgactttgtcggtcggcaacgcgcccttgtcagcgtcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggtggtgttcggctcgttgatgatttcgatgcccatcagcgcccgacgatggccgtaccgcttggagaggcgttcgagcacggacagcacgaattcgacttcgtcgggcagctgcgcccacttgcacacgccggagatgccgccgttgtcgaagccgttttggctcatcggtgcggtgtgcagatcgataaggatggtcaggccgtatttctcggcccagttgaaggccttgtcgagttcgtcgatgcagccgatgaacggcgcgcggtcgccgaagatgaagtacggcacggggatgcgcacggagttcagtccccacgatttgatggtggcgaagtcgcgctcgttgatgtattcggcgcggtgggtcctgatacgggcctcgtagacggccggatcaagttgcgtcggcagatagtattcgtcatcggcagtggttccatcgaataatgccgggttcatccacttttccagaaccagccagttacccaggttcacgcccttgatgtaattaaggtccatatgcactccttcgtacgctttcaatcatattttttattacttagtaattactaagttagatgatagtacatttttctcctccccgcaactcgtctcggacatctctccgaaccgctgtcgcactatttcgcataaagcaccctttgcgaaaatcgtgggaccgacaatcaaaatcgtgcagcaatttcacagaatcatgcgattaatcataagaaaaaagcctctttcttgcgggaagaaagaggcaacctgcagccggagagacgattactgcttatcgctggcgaatcgttacgtgcaaggcactcaccgaggcagcgggcaacgttaccgtcagctcggcaccgccggcagattcgtgcacgctcacggcactatccacgtccacggcatgagtgcgcaccagatccgaatgctccactgtgttgcaatcatgcggatcttcggaagcaagcgtttccatcgaatcaacctgagcgccgcacggcaaatgcagccgcacttcggcaccatcgttcatatgcgcattggtgagattaatcagcagctgcgtgccatcctcattacgtgacgcaaacgtatacacggcagaatcctcggaatcgttacgcgccacatcaagtgcggtcatgccacgatgcgccttatacatcatgaacacatcgtagttaggcgtaaggatggtccgatcgccttcagtcaagatcagtgagttaagcacattgatggtctgcgcgttacacgccatggtcaccttgtcgcaattacgctgcagcagatccaacgtaagcgcggtggtgatggcgtcacgcatggtcacctgctgcttgagcgcagggcgtgcgaagaatgcggtcttgtgccaattgccccattcgccgatgattagatcgacatgcgcgagcttggaatccatagccacctccggctcatgaataagcgccaggccgtcattcatcaaacgccactgatcacgcagaatatcttcaagttcgaggcatccctcaatcaccgcattccagccgtcttcatcgaaccgggtgggagtgtcggcatcgttgtccacattccaattgtagaagtgcagatcatagccgtcgatattcggctgacgatattcggcaagaccacggaagaaatcctgggtccactgcacgcgttcgcgcggcttgttgccgtcaggaccactcgcaatagcatacattggggtcggcgcgaacacatcggtggtgaagctcggcatggcggatgcgaacctgcggtattcattgaggtaggtccgcggagtcatggtaccgccgccagcccacacttcgttgccgatcccccaatatttcaccccgtaaggtgccttatggccgttagcctcacgttccttggcaagatcagtgggctgcgcacgattgcagtactccatccaatccttcatttcggcgactgtgccggaaagcatgttgatattgatccacggttcagcgccgagcatttcacacaaacgcaggaattcgtcggtgccgaagctgtgatcgtccagctcataggtggcgaaattctcgttgaaagtggttttacgttcgctttgcgggcccacaccgtcacgccaatggtaggtatccgcatagcatccgcccggccagcgaataaccggcggctgcaatgcacgcaaagcatccaatgtggccttgcggtagccacgctcgttttcgatcggggaatcctctcccacccatagaccttcatcaatgcattcgccaaggaattcaatgaattggccatgcagtttcggatcgatacgaccaatcgtactgttcgggtcaatgcagacaaccatggtttgctccttttgccgtagtgctcacatctgcaacgttcgtaattcgtatggttcttgtagttattgtgccgcacaatatatgcgaaatggccgaagattccaggagagataatgaaagaatctccggccaagttatttcgaaaagcgccgacgctacttcacctttttaatcatcagaatgaagatgcaggcgagcgccaccataatgattgccgtcgggaacaccagtccgtacgagccggtagctaccacaatggcggaggtgacaatcgggccgaccatctgaccgagagtagtggcaatgttcaaaatgcccagatccttcccggcctcttcttcattcggcagaacgtcaacattgagcgcctgatcgacggaaccgtacatgccgtagccgaagccaccgatggcggagaagagaatcatgcccaacgcgttgtgcatgagccatggcagagcataaccgatggcgagcagcacgcttgcggccacaaccggaatcttacggcgaccgattttgtcggaaatcggacctgcggaaagcgcggaaatcagggagacaaccatcagcaccaagctcatggtagaaatggtggccgcggaatcttcaacactttgaccaatgtagtcctgcagaatatacagctggtagttgagaatcatgtagtagctgaacagcagcagggaacggccgataaatgccagccagaagtcgcgagcgcctttggtcggcggacggaagctcatgataatacccttgaaatcaaccttttccttaggcatatccttgctggacttttccttcggccagaagaccacggcaagcacaccggaaagacccatagccacaccggacacgatgaagcccgggagctgcagggtgatgaactgcgcaccaacaatctgaccaagagcagaaccgaacaacgtacctgcagagataaatgcggacatggtgccgcgcatatcttcaggaatacggtcagacagagatgcgatgaccggtgcgatcatcatgttcagaccaaccatggaaatgcagtagctgatgccaatgctcacaccgtccggcagaatgccgataaggaacagcgaaatgcccgcaacaatgccgcccgatgcgatccatggcgtacgacgtccgaagatcgagcgcgtacggtcagacatgttgccaaccacgaggttggaaatcagcgaagccaatgccgtggccgaattcagcacgccgaaaatggcgtctttgctgtcgggcgcgatatcagccaaacgctgcggcagcagcactgcagcaacgatctgtaacgccagcatccatgcgaatgagaacacgaagaacgctacgcagaaacgcgttttgtcgattttggaaagctcgttggcatgttccgcaggccgtgcgtcagtcatgcttgtctccttatctttctttttcaaagtcagtcctctacgtttttgccgaatcttcaatgatcatgcaaacaacagacaagagaggcgttgtgttgaagtcaactctcatcggcttcgtcagttatcttatatcttaaagatataagataacaaatcggcgtgtcgaacaacgacctactttcaagcacagcaatcaaccgcataaccgcaatatcgaaaccacatgaaaacgcatgtggacagcggcaatagtattcttcaaatcagtatggaatcacaggaaaacacatcagcaaacagcatcaagagccgtccaatcaaccaaagaaaacgactctccccagcgcagcgacgcaaacaaatcacacaagaagcggtaaccctaatcacgcaatacgggtcatacggcttcccaatgcaagcattagccgatgcagttggcatgaccctgcccggactcaaccattacgtcaaaaaccgagaagaattactctcattggtcatcgaaacgttctacgactccgaagaaggcaatgcccacacgacattgggcgcagccatcagccactgcgaccaaatagattcagcaaccaaagaacgccgacatctgcccggtgcattgcacgaaaccgtgcgcttcaacgccaaacgtcccgaacttgtcgcactgttcatgcgcctcgccatcgaagcgtccgatccagaacacccagcccacgagttctaccagaacagacacagttcgattttgatcgacatgaccagcgtggactgggaactaccggaagaataccgcgatccagaacgcctacatgacctcatcgtcaccgcgttctttgccatggacggcgtgcaaatccagtcgttaaccaatcccaacgaatccatgatgcaactatgggaacgcgcagaacacatcctattcccctcccccacatgggacggctaccgctgaacagagcgcaaacaagcaaagacacctcaaaagcaaaaaggcgtttgcctgcggcgaccggtaaccgatcaccataggcaaacgccccgcaacacaacaccggcttgcgaagatggcatgaagagaagggaaacctgccacccggcattcaacaaaccgctgccacaaccaagccgacgcgttacgcacacattcgcatcagccaggcagctcccgtcagtccagcacaaacgtgttgaacgaacgcggagcaagcgtcaccttgataccgcgatcggcattgcaaggatcggcaaattcaaacggacgctcctcttcgagagcgttctgggccaccaccacaatggtgccatccggattacggaacgcaatagccatcgaattgaaatgacccgtagtgccaagcacatgcgcacccggcttgacgaaatgcgagaaatgacgcatcacataatattccggattacggcgaacctcatgcgtatccgcagtaatggtgaacagtgaattctgccaccacccccacgtagaatcctgatcgtcaagaatcatattccaataagtgtaagcagtcgcgccattacgcaaataatggttgatcaagtggaaaatatactccgcatattcccacgtattatcgcccataccgcattcggattcagactgaatcagctcgatttcaggccaggattcatgcgtacgcgcaatacagttctggccggcccactggtaagcgatgcccttgatgtacttgcgagcgccatcgtcgaacagaatattgtcgacaaaacggttgtaattattcagcttcatgccgtagccgccggtccacgccatatcttccggaccattcagcgtacccagccaaatatcggtgtcaagaccagcttcgtcaaaagcaggtccaagataatcgcggatgaacaccttgagcgcttcggaatcccacaatgcactcgggaacttctgatcggcaaacacctcattctgcacatgcagctgattcacggtaatgccatgctcggcataagcttgaatgtacttgacgaaatacttcgcatatgccttaagattctcaggcgtctgcaccaaacgaccatagttataagccttcggacgcttcatccatgtcggcgggctccacgggctggagaacagttgcatgttcggctgccattcctgcgcgcgatgaatatacggaatcagcgtccgctcatcatgttcgacggagaaatgctccatctcataatcgccgtcggtctcgttatagctataccaatgatcggcgaaatcattggcaccgaccggcgcacgattgaaggtgaagttcatctcatccgggctgaacagttccttgatgatctgatcacgttcctcttcagtaaccgtctgcagaggaagccagccaagctcgttgaagcagccgccgaagccacgcaatgcctgatattcattgccatcaagctgcagatcggaagcggaagtggcatgcgtggattcaatttcggatgatttgtcggcaagcttgttgtcttgcgttgtcgcgatccaagtagtcatggaaagtccttagtattgtcgctgattctttggatttatatttattcgtttttttgagttgtttttatttgattattgggatttagttatcgatatttagtttttgagattgaattattgagattgaattatcggcaacgcaatttcatttcagtaagcgcaaaaaccgcaggacgccgcgataatctattcacgacacgctccaggccgctctagccaagtctttacggtcttaaacagattatcgcggcatcctgctcgtaacgctatgacgttacgtttgcactgttatttagttttgcattgttgttcagtttgggaaaaacttcctattacctctcttcctctcctctttcgaaattgaggggagggggaagggatggggttacttgaccttcttgatggccatgatgaagaagcagccgatgatggccaaggcgatggcggtcgggaaggcgaagttgtagccgagggacaccacgatggtggacatgatgaccgggccgcacatctgaccaagggtggtgcccatgttcagaatgcccagatccttgccagcctcttccttgttcggcagcacatcaacgagcagagcctgatcgaccgcggagtagacagcgtagccgaggccagcgatgccagcgaacaggtacatgcccagggtggacgggatcagccacggcatggcgataccgatagcgaagagcacggaagccacgacaaccggagccttacgacggccgatgagatcggaaaccgggccggagatgaaggagccgaccagagacatgaccatcatgagcatggcaacgacagacacggtgacagcggattccttgacggactgaccaatgtagttctggatgatgtagagctggtagacgttgatcatctggtagctcatgagcatgcagaaacggccggcgaaagccttgtagaagtcgtgggcgccagcgaacttcggcggacggaaggatacgaggacgtccttgaaggagccctcttccttcggcaggaagtcagcggactgttccttcggcaggatgatcacggcgacgataccgccgaggaacatgagcacgcctgcgacagcgaagccggcagtcaggttttcgatgaagaatgcgccgatcatggtgccgatcggagtaccgatggtggagcctgcgccatagaaggcggacatggtgccgcggatgccagacggcacgcggtcagacagcacggcgaccagcggggcaatcatgcagttgaggccgaacatgcaggcgcagtagaagatggtgagcagcaccgcgttgtgcgtggtgccggtcaggaacagggtgacgccaccaagcaccgcaccgaaaacgatccacggagtacgacgaccgaacctggagcgggaacgatcggagaagttgccgaacatcaggttggcaaccaaggatgccaccgcggtgaacgcattgacgatgccaacgagagcgtccggatcggcaccttcgatggtcttgtagtgcatcggcagcagcacggcggagacgatgccaaggcccgacatccacagcacgccgaacagcaggaagcccgcaccgaaacggatggtgttgaccttgctcagtggcttgccggtttcaggagacagctgcggatccttgtctgcagcggcgatgttggcgttataacgcaccaaacgctcctctttgcttgcgattgcttcactcatgaaactctctccttcgattcatgtttcagtagtgttttctgtgatattcctgttttccgatagggcttctctgcccagccagctaactaccatttggtaactagccggttttcatcatagatgccttttcgaaagaacgcaagtcagacgcgaatttttccgacggcagcgttttcaaatagcaatccacaacgattcgccccatacggcaacttcagtttttattacttagtaactgcttagttaaagcatattacaatctcttgtatctgtcattttccgacgtgtcccaacgtttccaacacacttcctctcccccttcttgtaacttagtaagcacaagagaggagaacgcatgcgtcgccgcaccgaaagcaaaaccaagaaacgaatgagcgcagaagaccgcaagaaagcgattctcgaaaccacggtctctttcatctcacaattcggattctggggatttaccattcgcgacgtggcacaagctcagaacatcaccgaagcaggcctcctttactacttcaaatccaaagaacaactccttgaagcgacactcaaatacgccgatcgcactaaccaaatcgccattgcagagcatcttggcgtcgaaggcgtgaccggcgaagtcttgcaagacggcatcgcataccattgcgatctcggactcaaggccatctccacgggaaccgtggaaaccaacgcaggccgacccgaaatggttcgcctctacaccctgctcgaaagcgaggccctaagcaaagaccatccggtgcacgagtatttcgaacagcgcgaaatcaatctgctgaaggaatacacgttcgcagccaaacgagatggcgtcgccgatccggaacgcaccgcactgcaggtgctatccgccatggaaggcttgcaattgcggtggctcaacggatctcacgatatcgatttcgttggagaatggaaggccctgatcgaccttctcattccctaaacgttctcttctcgagttctcttatcgcagatttcagccggcgatcaccgcaacattccagcggccgatcgtcaacggatcaccctgcttaacggctgcaccttccttcagcacgacttcagcatttgcaacctcatcaatactgccgtcggtggcgatgacgaccggagcgaccactacttcaccctcaatcgggcttgcaacagtaacttcgtcggcggaatagttgagcaaatacgtcacgttctcgccgagggcattcacaccctggcgaaccgcgacctgtcccgcgagcgcggttccagcgccctcgacgccggcatgctccacagcctctcgcataaccgcacgaatggaatcggcgtcaagcagtgtggcgacccactcggcatcgcccttgccgaatgcgtgacgggtgactgcggcgtaatccttccaagcgtagtgtccataggatgcgagcacctcagtatcggcgtcagcgttcaacagttcgatcagcgactgagcatcggtggacgcggtttcggcgagcgcacctgcgaattccacggaaacgtggccgtttgggcgggtgaactggttgtacgtcatgccgaacacgtcggtgaggttgtgcggcgcgcggtcgtgccatacggtcacctcgtcgtcggtcacgaaggagcgcatggtggagacgaggtgtccgccgttggagacgaattcacgcaggcgatcggtcgtttcctgcggagcacagtacagcgccggggtcacaatcatctcgtatgaggccaaacgctcggcgggagcgtcggaggggatgaaatcgcattccacgttgagctcgaacagcgcgtcgtagacattgcgcaccacgtcattgtatttgagagtgccgccgaatgggaagccggcttcgatgaggaaccagtcgagcgcggtcagcgattcgttgctgaccatgatggctactttgttgtgcttcttcaggtggacgagccgctcccccacttccggtttggcgacttcgcgaccgaatacgccggcttcgcagtacgtggggttcggttcgaggtcgtggctcagcaggcccttccaatatgtttcaaaggaattatggatggagtgccagtgccagtattccaccatgtcggcgccggaggcgaggtgggagtaggcctgcaggcgcaactggccagggaatggcacccagccgtgctggccttgggcctcggtttcgagcaccaggtagttctggccgttcttggtggagcgggtcatgtcgccgccgaaggcgatctccttgccggtcaggtcgtcttcggtcgggtggtagatgtccacgccggtgatgtccactgcggtcgcggccttgaagtggtcgacggccggctgcacaccgaaggaatagccacgccattcgaaatcgaaattgtgggtgatgaactggtcatcgtgggcgtattcgcgcacaatatcagactgccactgcaggaaggcacgcacctgatctcgacggaatttgtcaaattcgccgcccagggactcgttgatggtggcggtcacgtccgggaagtcctcccaagagtcgatgcggttggaccagtagtcgaggccgaagtggtggttcagctcattcagatcgccattgaacttctcatgcagatacttgacgaacagacgctgcatgtcgttggacacggaatcgtagtacttggtttcattatcgacctggtagccaatcaccgccggatggtcggcaacgtgggagatcagcttgcggatcacgcgctcaccgtagaaacggtaggtggcgttgacgatgtccatgatctggcgggcgccgtacttgccttcgccgttcggagtgaccgcgagcacgctcggatcgatcttgacgagccagctcggcaccgcgtaggttggagtgccgacgatgacatcgataccgacacgctgtgccgcgtcgagagcacgatccacataggtgaagtcgaacgcacccggctgcggttcgcaggtgctccatgtggattcggcaatacggataacgttcagtcccgcttccttcatcatcctcatgtcttcatcgacacggtcgatgcctttcatcatgagatattcgtcgtaatatgcggcaccgaaaagaatgtgatctgcctcgtaacgacccatggatcctccatcgtcttcattgacttgttactgattgctactgtttctgcgtctaaggctgttcttctgcgatatccctggaatatatccttggatgcatcctcggaactctcatatctaacaaccattagatataagaaatataaatcttctagattcacttgtcaagaaccgcaaaatttcatggcgtgtcttacctaacaaccattagatacagcgtttccccttgaccaaaaccaaccaatcaccgcacgccacacaaaatgctatcccagcaggcaaatccatccagccactggaggaaccctcccgcaaacatgcctccaaaagtccagatccatccagccactggaggaatcaccccgcccaaaaccttccaaaagtcctgattcttccagcgagtggaagaattgggacgcgaaaggctatagaaacacagcccgcaagagagttgcacacggcttagcggtagctgtcccagacaggtgaggggaagatcatcttttcgaaggcgagccattcatcgtagaaatcgatgggcggcttacgcgtccaacgcagttgaatgccgtccatcgcttccaagctttgacgcacaatcgcacgcatattctcccaaccaccgatttcaggcggcaatttccatgtgtactgggaatagtgttcccacacgtatttcggacgattctcgaaatagtcgtgcaacggatggccctcgctgaaagactcggtttccagcaccatgtatagctgcagcaagctacgtcgactctcattgtaacgtaccaaaaaacgcaggtatgcgggaaacaacatgccttccggatcgctgcccggcaatccggattttgcaaaatcagccggagtgccttcctgatcataattgtcggtgactagcagcgacaacaaccgttccttattgccgatgtaatgcagcagtccaggctggctcatgccgatcgcatcagcaatgtctttcaatgacgttccgtaataccccttttccccgataagacggctcgccgcagcgatgatttccttcttacgttcctcaggtgatttacgaacacgtttcttcccctcattacccataaggaacagtgtactatctaccgttcattagacaggcaaaatcgtatcggaccgttgcatttccactcgccacacaaaaacgagccgatcttcaacagaccagctcgaaatcacattcagtcagcctcgaccaaccaaaaatattcgaaaagcaattttacttctggaacacgtcagggtgtttcggatcaccaggttcgtcggcgaggacgccctcgagcccgaggaactcctgccagaattccagcgaattgccgtacggagctgcctgatggccgcgcgcctgcaggttcgccttcgcctcgaacacatcctcctcgcggatgccatcgaaatacgattcgagacgctcacggttcgtcggatcatagaacagcgatccgatgatttccgtcagtcgttccgcgcgcgctaccggcagtgaatcccagtgacggaattcaatgaagttcttcagacggacatcgttgaaatgcgtggaaatcacatgattgatttcgtatgcgttgagttctcgatcaggatacacgtcgttcgcattctcatagaatgcaggatgatgcagatcagttccgggagtttccaacgcttccggagtgtgcgtcagatcagcgaacatcatcggcgtgctcaacacgtcgaccgcataatcttcccaaccgaagcgaggatcaaacaatcccggaataacgttcgtgcgctgcaaatccaaataatcccacatgcgttggcgcagcagcggatacggattctcctgtccctcgaaatacggggtgttacggaagaaccatgcgagaatcgggccgaccaccgtacccaaccgcagtttggaaatcgcgtcctgttcggaaacatagtcgatgctgacctgcgtcgaagcggagcaacgcatcatgcacggaccgaactggccgacgcgccccaaatacgcggtcatcgccttgtaacggtccttcggattgacaggaatgtcggcatagccggacttcggctgatacccgtaattaaccaagcggaagccgagatcgtcaagcacaggatcgacttcgcggcggaacgcaccatagatcgtgcatagatcttccggcttgtgcagaatgcccagcgagcattccagctgaccgcccggctcaagtgacacggaaataccttcgcggccaagaccaacaagcctgccgttctcccagtattccttgctttcgtcgtaatatgggcgaatgcggttcagcaacgcctcgataccgttctcctcgtaatagttcacggcggtatcatcgctgttatgcaccggcagatgctcgatttccacaccgaaaccaccggttccacgctcttggcagcctgattcgaagaatttgaccagactttccacatgcttcggattcggctcggtaagcaggtgcgcataagaaattcgtggcgttgtcatgttggcaatcctatcgaaactcgttgatgagcacggcgcgattgctatacgaaaaactgatagccaactcttgcgtatatcgaatcgaatacacattttcggttaaaacagacatgctctgcaaagccgaccaataataattaacagctattaataaagtcagaagcaattaccactattcgaagaattgtttgtacatatcgaataaaaataccgacgctgaagatgttgtcagcgtcggtattttagtcaattccagtcagtgcttattgatttatccgcctatgatcaggcagctttttcgctttgcgccgtctcaccctgttacgcagccttgtgggccttcttggcggctgcgatcatcagtttgatgcggttgagctggttcgcttcggatgcgccaggatcgtagtcgatggacacgatgttggcttccggatgcaggcggcgaatcttgccgaacatgcctcggccggtcacgtggttcggcaggcaggcgaacggctgcgcacaaatcacgttcgggcagccggattcgatgagctcaaggatttccgcagtcagcagccagccttcaccagcctgcacacccacggaagtgacctcgtcggccttcttcacgagttccggcatcggcaggtcctgggagaacttgccgtgtgccaaatcgatcgccttgcgtacaggagcgttgtacaagtcaagcgccttgcgcatcagcgcgtagccaagcttgttgccgcccatgccgaggtaatgctcgttccagtcggaaatatacgggcgggtggtcatgaattccatgatgcccggcaccacagcctcgcaattctgcgattcgatcacgtcgaccacatggttgttggcgtccggctggtacttgacgagaatctcgcccaccacgccgacgcgcaccttgcgcggttcgtccttcaacggcagtgagtcgaacgatttgacgatttctttgacgagcgtcgaatatggcaggtatcccttgccaatgaacttacttgccgtcttcgagcgaccgtggttctcgagcgtttcacgcacgatggtgttccatgtcttatacagctgattcgcactgcccggcgtcacctcgtacgggcgcacgcggtacagacatttcatcagcaggtcgccgatgatgagcgccttgatgacgcgatgaagcaatgccggcgtcgctttgaagcccggattgtcttcaatgccctgcgtggaaatggcgatcactggaatttgcggataaccagcatcgatcagcgccttgcgaatcagaccgaaatagtttgtggctcggcacatgccgccggtctgcgtgatggcgagcgcggtgtgttccggatcgtatttgccatccagaatcgcgtccacgagctggccgataaccatgatggccgggtagcaggcgtcgttgttgacgtatttgaggccggtttccacgttttcgcggctggcgtgttcgagaatgtcgaacttgtagccgccggagcggatcacggattccactagggagaagtgaatcgggctcatctgcggagccacgatggtgtagtccttcatgtctttgccgaatggcacgcggttggcgtatttcgacatggtggcggaattgtgtgcggacttcttcgcttcgccgacgccgttttccgcggcacgcttggatgcggctttaacggcttcggtgagtttcggattggctttcatcacggtgtcaagcatgacttgacggcccggagtcggcgcctcagacccggtcttgcggaattcgccctgcttgttaggcgcactgtcttgtttgttaggcatgactgcggcgattccgcgctgcttgttgcgttcgcgttcttcgacggctgccttgagcgagcgcagtcggatttttgccgctcccaagttggagacttcgtcgatcttcagcatggtgtacacgtcggccttgtcggcgaggatttcgcccacctggtcggtggtgatggcgtcgagaccgcagccgaaggagttgagctgtacgagttcaagtcccggataggaggccacgaagtttgccgccgagtacaggcgtgcgtggtaggcccactgattggtgactcgcaacggcattttggtgaccttgcggtcttccacatgacggaagccgtccgcgttcttcttgcgcggatcgtcttcgtccgcggcgaggaaatcactcaggttgagcttctcccccggctgcagttcgcagatcgaatcttcagacaataccaccatgccgagcgagcagatggtttccggaatgccatggttgacttccggatcgatgtggtacgggcggcctgcgagcacgatgcctcggcagtcgtgttccttcatgtaggcgagtgccttgaggccttccatctgcacatcgtgcttgaagacttcgttttcggcataggccgctttgactgcggtttcggcttcttcacgggtcacgttggcccaagcgaattcttcgacgatacggtcgaccatgagttcatggttggccatgttgaagtatgggcgcatgtaacggatgccctcttcgcgcagttccggcatgtttgcgccgatgaccacgggatagttggctactaccgggcagttgtagtggttgtcggtgttgggtaccaggttctcttcgtagctgacgcacggatagaagatggttttcacacccttgctcagcagccatttgatgtgtccgtgcacaagtttggccggatagcaaatgttttcggatgcgatggattcaatgcccgtttcgaacagttcgtgcgagcttcgtccggaaatcatcactttaaagccgagcgaggtgagcagtgtgaaccagaacggatagttctcgtacatgttgagtacgcgcggaatgccgatttcgccgcgggttgcgttcttgtcggtgagtctgcggtaagcgaagcaacgcttgtacttgtaatcgtagaggttcgggcgatcggaacgcttctttttcgcgtctccgcctcgttcgcagcggttgccggtcacgtagcgggatccgtcttggaaggtggtgatggtgagcttgcagtggttttggcacagtttgcacacgtctcgttcggaggtcatcgacaggttgtcgagttcttcgccgctcaaaatgttcgatgcggtatggcatacgcctgcgatcaccgcctctttggtgtcggtggtatcgacgtcttcgtcttccgcttcgtcggcatagtgcatgcgtgcggtcagtgcggcaccgtatgcgcccatgagtcctgcgatgttcggtcgggtcacttcacggtctgtgagcagttcgaatgcgcgaagcacggcgtcgttgaggaacgtgccgccctgcactaccacggtgtcgccaagttcgccggaatcacgcagcttgattaccttgtagagggcgttgcgcactacggaatagcacaggcctgcggcgatgtcttcgatggacgcgccttccttttgcgcctgcttcacggacgagttcatgaacacggtgcatcgggagcccaaatcgaccggatgggtggagttgagcgccgcttgggtgaattcctgaatggtcagacccatggaaatggcgaacgtttgcaggaacgatccgcagccggacgagcatgcttcgttcactgcgatggagtcgatcatgccatcgttgatggcgagatatttcatgtcttggccgccgatatcgatgacggcggtaacgcccgggctgaccatttcggcaccgcgatagtgagccatggtttccactacgccttcgtcgaggtgcaggccggtggtgatgaggccttcgccgtagccggtcgcacaggatcgtgcgatccatgcgccttcaggtagttcggcttggatttttttaacgatttgtacggctgccgtcagagggctgccttcgttggtcgcataagaggaccatacgatttctcgatcgtcgttcaccaacgtcgctttgatggtggtggaaccggcgtctatgcccaggaagtgcggtccttgggctccttcgagcgtgccttgatggatatgctcgcgatgatgtcgttcgttgaatgcggtgcgatccgcttcggtagcgaacagcggaggcatggtcggagtgttggacggcaggttttccagttcgtccagtcgtgccagaaggtcggcgcaggttcgtgcttcgtaatgcttagtcaaggtcgtcaccatcctgatcggcctgcaatgcggcaccgtatgccacatacaggtgagcgtcggtcggaacaatgaattcgtccactttgccgtcgagcgcccgcttgaacgcggctctcagttcggacatgaagaacaacggaccacccaggaagatcacggttccgtgaatcgggcgtccggaggcaaggcctgcaatggtctgcgtggccactgcggtgaagatcgatgcagccagatccggcttggccgcaccatcgttgataagcggctgcaaatcggttttggcgaacacgccgcaacgtgatgcgatcggatatagggtttcgtattgcgtggccatttcgttcaggccagcggcgtcggtgtcgagcagtgttgccatctggtcgatgaatgcgccggtaccgcctgcgcaggaaccgttcatacgctgttccggagtcggcttgagatacgtgattttcgcatcctcgccaccaagttcgatgatcacgtcagcctgcggatattccttgtcgatggcttcggtttcggcgatgacttcctgaacgaagggcacgtcgaggctgtctgcgagggcaagaccgcctgaaccggtgatggccaggcgaatcggctcgtcgcctcggccaagcttttccagctcctggtggatgtcggccaatagtccggccacggtggcgcgcacgttcgcgtggtgacgccgataatcggagaacagcgcgtccgcgagcgcgtcggactgatcgagcaccaccgccttcacagtagtggaaccgatatcaagacctacacgcaacggctttgtgccgtgcgtttcggtcacggcttctgctgcttcaaccatgtctcaacctctatcgttctatccgccgggctgcattccatggcaggcatggaagcccctaccccgggttatccaatcatgtaatcgtagtctgtgcccacgcctaagtgctttgtaaatgctcgcaatcagcataaaatgcacgacacagcgcacaaattagacaactaatccagtcaacgtgcctaattatgtatctggacgctcgacgaatgtcgagatcgcaaacccttccaagcatttccatgtcaggatgcgctgccttcccctgcagaacggtctttgccgtatatttcgggaatgaatcgtgtttgatcatgtagtttcggccaaatcaccacttgtccgctttccagtgatttcggtacgtcgatgatgcgttggttgctgcttccgcggaattgcagcagggaatcatgtaattctttgatataacggccatccacgagaatgtcgatcagttcgagcagctcgcgcttgtcggggctttcgccttcgcgcatgagctcttcccacgtgtagccggtccagcaccaaatatctttggtattaccgaaccgttcgcgtattttgcgcgcaaggggcaacagcacgcccgtgttgagcaatggttcgcctccgaggaaggtgatgccttgcacatacgattggcttaagtcatccatgatttgcgcttcgagcttgtcgttgtattcgtggccggcttggaaatcccagattgacgtgttgtagcattcctcgcaatggaacgggcagccggacacgtacagcgagcatcggatgccttctccatcggtcatgaggaaccgtttgtagtcggcgatcatattgcggctcatgcggttggtccattgccctgctttgggattgttggaacgagttgtggggatgaaaggtccgcgattggtttcgtccgccgcaaagtcacgacgttgaattgctggattcgcgctgctgatcatacgttgtcccttcacgttttgccgttacgtcgcgtttttgcgattgctgcttgcctcatgattgtcacagaatgaaagagggtggaaacccaccctctttcatatttcgtttatgtttgctaccgacgcggcccttacttggcttcctcgaaccattcacgttcggaaccgtcactcaaggtgacatgaccggtttcgccgctcatatgcttgacgcggtgcgcgatctcctcgtgacgtccatgcaccatcgggcgctgcaccgggttgcccaagtagccgcaggtgcgcttggtcacgttgcagtggtccgggtcggagttgccgcactccgggcacttgaaaccttcctcagtgggctcgaagtcgccttggaatccgcaatcgtagcagcggtcgatcggcgtgttcgtgcccaggtagccgatgccgatgttgtaggcgtaatcccacaccgcttcgagtgccttggggttggactgcaggcacgggaactcgcagtagttgatgaagccgccggacgcgtagtacgggaagtccttctcgtagttgagcttttccattggggtcggctgcagccagaccgggtagtggaaggagttggtgtagaagtcgtggtcggtcacgccttccacttcgccgaacttctcgtggtccatacggttgaagcggtcggtgagggattcggccggcgtggagtacacggaatagtggtagccttccgcgtcgctccattccttgcacagctcgttcatgcgcttgacgatggacagtgcgaattccttgccttgcggatcccagccgtgatcgcgcatccagttcttgccgtagaacacgctggtcgcctcatacaggccaatgtagcccagggaaacggtggcacgttcgttgcggaacagctggtcgacgctgtcgttggcgccgagtcgaccgaaagctccgaaacggaacagggtcggcgcattgaccggcgcggcctgcttgcaacgcatgatacggaattgcaatgcctgatgagccacggccatacgctcgtcgaagatcttccagaagcgatccttgtcgccgtgggattccagtgcgatgcgcggaacgttcacggtgacgacgccaaggttcatgcgtccgtcttccacgtccttgccggtcgccggatcaatccaaccctgcaagaaggaacggcagcccatcggggctttgaaggagccggtgatcttcacgatgttctcgtagaagatcacgtccggatacatgcgcttggtggcgcattcgagggcgagctgcttcaaatcgtagttcggatcgcccggatcggcgttcacaccatgcttgatggtgaacacgagcttcgggaaaatggcggtgtgatgttcggaaccgaggccgcggatacggttcaggaagatggcacgctgaatttcgcgggcgaaccagtcggtacccaaaccgaagccaacggtcacgaacggggtctggccgttcgacacacgattggagttgatctggtattccatggtctgcatggcgtcgtagatggccttgcgggtctggatcttcgcccacacctcacgcaactgctgcaaacggctggcatccttgttgaacggctcgtccatcggcagggccggacggtccttttcgaaatgcagacgcttcggttcgacatccttggccaagcgcacctgacgttcggcgatttcgatcggcaggtcgtcaggcatgatctcatgggcctgctcaaggaacttgtcgtaatccttgcgcgcgtattcgacgaagtgctcgtcggcacggttggcggtctggccaccatactggctggatgccacgtccttcatgatctgggtgatctgcgtggcggcgatggaaatgctgttcggcgatcccatcggcgcgttgccgagagtgaaaccgttggcgagcatatcccagtagttcggcagcgagcagttggattgtgcggtgaacggcgagtagtcggcgtcgtggaagtggatgtcacccttcatatgggcgttggagaccgcatccggcagcatggagaaggcggacgccttggacaccgcgcccgccagcagatcgcgctgggtggagtagacgttggaatccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcgtacaggtggtcttcgatcagaccgtgctcaacgagattctggatgtcttcgatcttggcgggaccgttgtaacgatccttgatttcggcttcgacctgattggcgatatcacggattagctgttcctcctgcggcccgatcttcttatcaaggtcggcgaaggctgacttcaccgcgctgatgatgttgatcggatcgaagtcgaccacacgaccgtcgcgcttctcgacgagcaccttaccggttcccgttttaacggttgcggagatggcattcagagcctgcgtttccattcatcatcctttccgggtcggaccccatccgaccaggttttcatgcttcgttatgcatgccagattgttgctacgtccatgactgtacgccatagccagcactaaatgtagtagcggcacgccggcagtaaaactatatattccatttttcggcttgattccgccattccttaacttgtgtgacaaaggtaacgatttcgccacggagtgtcgcccgagtgtcgatttgacgcactcaccgaagagggactatacaaggcggggtaccctcacggaattcgaacatgtgtttcatttgtccgcaagatgatggaatcttgaactatgacttggaaccaggattacacacccccggcagcgcagccgaacagcaaaccgctgccgcgactggccggcgaaaccactgctgacaacccctggccggtaagtctgctcagcgagaaattccatatggccgtcgaacggtggccatcggtttgggtggccgggcagatcacgcagatcaacaccagacgtcagggcagcgcctatatcactctgcgcgatgattatcaggacattgcgttggaagtcaacggtttcgggcagttcgccgcagccgccacgccttttgtgcagggcgaccgcgtcatcatccatggcaaaccgaatctgtggatgaagcgcacgtcactgtctttacgtggcgacgccattatcgcggccggcgcaggaggcagcctgaaggccatgatcgacgaattacgcaagaagctgaaaggcgaaggcctgttcgacgctgaccgcaagcagcctctgcccgagtttccgcattgcattggtctgatttgcgcgccgcaggctcgcgccgaaggcgatgtcatcaccaacgtgagattgcgttggcctgttgtcgatttcaaagtgacgcatgtgcatgtgcagggtgagcagtgcccttccgacgtgatcaaggcgatcgcgcagatggatgccgatcctgatgtcgacgtgatcatcgtggcccgtggcggcggcgctttcgaagatctgatcgggttctccgacgaaggcgtggtacgcgccgcggcagccgcccatacgccgctgatttccgcgatcggccatgaggatgattggacgctgcttgatctggttgccgatctgcgcgcatccacgccaacggacgcggcgaagaaagtcgtgccggacgtgcgcgagcagatgcaactgatcaacgtgaacatcgaacgcatgcgcatgcgcatcgacgccaccgtcaacaatgaaacaagactgattgaaggctatgcgaaccgtccaagcctcacacagccgctcaccatgctggaaccgcatcagcgtctcatcgatgatgcaagaacccgcatgagaatcggtctgacacgtattcttgacgacgcaagcctcaccatcgaaaaagcgcatgcctcactgaccgcgcttagcccgcaatccactctcaaccgaggttatgcggtagtgcagggagcggacggccatgtaatcgacgatgcgaacgccgtgaacaccggcgaccaactcaccatgacattgaagcacggcgtgatcgtgtccgaagtcaccaccgtaacgaaggagtagcaatgatcaacgaaaccacccccgcatccagcctgaccgacaaggaacgcgaagccatcgcacaaatgccttacgaagaggctcgagatcagctcattcaggccgtgcaggcacttgaggccggcggactcaaccttgaccagtccatgcgccagtgggagcttggcgaagccctcgccaagcgcgctcaaagtctgctcggcgaagtgcgtgccaagcttgacgcagcccaggcggaacaggccactgcggccaataccgctggaacgcaagacaatctggcctgaaaatctcaaaaaccgccaatatatcgtttctacatgactgtgcgccacgtacttcatgcagcgcacagtcatgtagaaatttcggatttcttcatttcggcaccacactcgtccggatggtgtgtagaatgaagattcgttgcctcagtagctcagtggatagagcacttctctcctaaagaaggtgtcgtaggttcgattcctatctggggcactttgttttatgcggatacgcagccgatacgtagttgcgccggcactcttctcacacgtcgaattgcacggttgccagcaacgccttgtgatcacttccgtcgattttcaacgatttgacccgacctgccaacatgccggaatccaatacgatatggtcaatgcccgcaaacgtcggcacataatcgatattcgcaggccacgtgaataccaatcccccggccgcttgtttggccgcatccgcgaaccgtgttcccaagaaattacggaacggtgcatgatcgtcggtcgcattgaaatcgcccatgaacacgtacctacgagacgtatcgtaccggagtcgaccaagctcatccaatgaacgcttccactgctgccaatatccatcggtcggagacgtggtatgcaccgaaacgaaacggatctgcgtctgaccatcattgaatgcaaccgtggctcctggcatgaacgacgcgctcgaatcaacatcatcatcagctggatcaacaagcggactcgccgaccacaaaccattgccatacacgccgtctgagcttgccacctgcgcatacggcagcaaatcgccaataccagccttgttcaactcgtccacgaaagcatcggtcgtttcctgcagcgccaacacttccacacgctcgctacgcaccacatcgacaatttcctgcgcgtcggcacgacccttaaacacattgcatgtcatcaaacgggcgtaatcatcctgcgtattggcggacgctcccgaaaccgctgcaatcgcggcacgcggaagcttcgtttcattgtagaaaaacggatactgccaccatacttgcaacgcgatcgccgcaatcgccagcaataccgacattgttcgcttcgaaacaatgccgcaaatcagcgcaatcaccgcaagaatcgcaaaccaaggcaccaacgaaacgataatgggaacatacggccacgcctgaatctcagcaggcagtatgtgcgaaacagtgccaagcaaagctgcaatcgacagaatgccagccagaaaaccgcatatgatattgcgcacgcgatgcgacttagttttcttcaacgtgcgaataggcttaacagccttcgcctgcgccgtacgcggtttcgtaggcgtaccagaccgtgccatacatcctccaacatgggcattgcgttccatcagtcaatacatcaatcatcaaatcagccatcaaaaccgagttcatgacgaacgccatcggcaatagtgcggcttcatagtaccccaacttccacattcgctggcaaatagtcgcaatcgtctccataaatttaacgaaaaacaatcgaaacacaaaaatcaccatcttgccccaaccattaaatactattacgctgggcacataagaaatcgtaactaatgggggtacgacgccttacgcaagagcaatggctgctcatgtataccgagagggggctataccatgctggaacttgatcacgtggggttttcgtatggaaaacgtctgattttagacaatgcgagcgcattattcgaagaaggttcgacaacggcaataatggggccttccggctcaggaaagaccactttgctgcgtttgatggacggttctttacaaccagacactggctccgtcaccattgatggcgcaaatgtcaattccattgatcgaaaaaatcttctcggatctttatgcatgcgcatatttcaggattacaggctcattccatatcttaacgtgcgagaaaacatcatgctggcgtttgaagcggcgcataagaacctcggacaaaccaagattaaggaaacttcccgcgctgaaaacaacacaatcgataacttgcttgaagaagtgcatttagcaggctatgcaaaccatttggctggccaattgtcaggaggagagcagcaacgtgtggccatcgcacgcgcgatcgccatgaaaccacgtgtgattctcgcggatgaacccaccggcgcgcttgatgaggaaaatacgcaggcaatcgcaacattgctttcagatattgcccacaaagagcgatccattgtcataatcgcaacgcatgacgctacggtcgcgcagcacagtgaccgcattgtgcgcattcaggaccacaagttggtggagcaatgaatggaatgccttaccacagcactggaatcacgaggcacgttacctctggatatttgagattccatccgatgctcaccatctcactctttgtggtggcattattgtcggcgatgctacccgtggtggccttaaacagcttgaatctatacgtacaggccgccaaagaaggcgcagcaggtcaatccggagggtacacgtaccaaatttcaggaggcagcaacgatgtagccgaagaactcaggcaacaggtccaaaacggtaaggccatcggcgtcaaatccacacaaggatcagtaggcctcacctccgccagcggctcttcacgaaacaccatcgcagacataactttcctaacaggcccctcacgatatggcacgctcatcgaagggcatcagccgtcgcaaaaaaacgaaatctccctgtctcgggccgcagctgaacaaattgacgcccagctgggagatatagtcaccgtgcaatgtgacgattccgcattatcaagcgactataagctcattggcatcaccgtcgatgctgcgaacaccaacaccgtgtatgcaacagcagtgtcttccaaagacaatctccaaaacatacaaatgtggctcaccgacgatgacgctactgtaaatcagggagaagtcgcaaaagagagcgcaaccaacaatgtcaatatcggatacatcaaatcgacaatacgaaatgccgaagaaacggttcgtactcgcgatctgccaggatgccaatggtacggaatagttctgttcctttgcttgctgtgcgtacatatcgcagcaatgacggcattcttccgagcaggtcagtgttccggagatgctgtggtagaagctctggtagcttgcggattctccctcaccaccagcagatggacagtgttccgaggattgcttatttgcacaatacccggagccgcaattggcatcgcggccggatatgcggtattcggtcttagttacaggaccataggcaacatattcgcccaatattgggaatggcaaccatcagcaacttccctgctgtccatcttttttgtcgcagcgattttgctgtgctcgctatgcttgacatggttggttttgttcttccgcatgtcctttaagcatgacatcacaaccagaaacgcattatggtacatcattctttcctcggccgttctgctgttttcttgtgtggcgatagaacgttatcatgcagccgcatggccgtttggtggatcagtgggctcggtcatgggggcttgcgctctgggacctatgctcctttcactgccttggcttttccgcacgccagcacaatgcaatgcgatagaacgtacacgaagtttgtctgccccagtatgcgcattggcactcttattgttaggtgccagctcattgttcagcgggcaaatgatgatagcgacaggcaattcggataatgggctgttcatcgccgattatttgactcaggatgacttaaactatcttgccggcaaatatcccgagactctagacaaagccatcgtgctcacggcaccggatgaatcccggtatctggtccgcgccgcgacttcccatgcttacgattgcgtcattcaacatggttccgacgatgcggattgctactcagattccgataatgaaaccactgtcatgcttgttgatagcaactcgtctttagccggtaaaaccaacgacgttcatattgccgaaggcggtaacgctggtatcattctcatcgataccgcaacccaaaaaataactcaggcagcacaagttcccaccgagggcaccgactcgctgctcaatgattacaccatgcccggcgtggttcttggaatcgactcaccgcaggcaaagacgcttggccttgcaccgagcaaccggcatactctcgttattactgatttcccgtcaatcgcttccggcgttcgcgattcgattcgatccgacatcattaaccgttgcgggtatgcattcattaccgaacacgacaccacctcttaccgctcctacatggcacgcgccattgccataccagctttggccacaattatcagcggcctgacattcgccgcattggccatatcaacacgtcaatcgcagtcagcgttacgctggacgcttcaagaattcggtgcatcacgattccagctcatgcgtttgttcagacctttaggaataaccatgtcgttgggatcgaccatagccgtattcttggggtggctgggctcgcatccttggattattgcgcccgcgaacgaattcggcaccacaggctggtggtggctcataccattacctgtcatttttattgaaacggcattgttctgttggtggttttcgctacctgagcgccgcaatcagtgaccactggattcgccttcgcacataatcgggtcataattggacttgggcgaatcacgtaacgaaaaatcccgaggagcgatgctcgactcgggattcaaaaaagtttaagtgcggcgacgtgctactctcccacaccctctcgagtgcagtaccatcgccgtgctaggccttacccgtcatcagaaagcgaatcccgtcgtaatcccgtcacaatcccgtcatcagaacctgtctctgagccattgcgatagatattgatgcgcagatccgtatcgccgccaaggaattccggttccggcaatccggcatcatgtacctcctgcagaacgcgcaggatgccgctcccccaatgttcgatatagcccatgtattcaaaagcagaggccaatgcttcgttgcggatcttcgaataaccctgcttcatgcgttcaatggtctgtcccagcggcaagcgcccgggcgaagtaatttccaatcgatcatcgtagattgcgatctgaatgcttgaatgatcgatatagctgcgatgcactatcgcgttgacgatcagctctcgaatggcatccggcggaatctcatacacgtcctgccggtacacgcctttgaaccgagcgcccatatggatgttgcgcaacacatactggtaggactcttcgataagctcctgcggagtaccggcgaactcacgtcgatccacgaacacagctttggtggttcccttgaacacgccgcattgcaccacggatcggacggccgtattgccggtcagaatcgcataggcattggtgggcaccaattgcccgtcttgttctgccagcacaccccactgcagcaactgtttctccgtaaccgttttgactttttcggggtcttcggcattatccttcgcggttttcgtcagacttgcgcacaatgcttcgatgtcttcttcagttacggatagtccaaggcactgcacttggtcgaaactccgattgctgccttcgatggtcagttcccgaatagtgggctggtctgcttgacgcgtggtgccggccacacgaacgaatgttccctgttcctggccgagcgacttgatatggtacggacgttgcaaaccaggagcgatttcagccacaatgactgtcttaccggccacgtcatgcatggtgatatcggggatgattaacggctcgcaactattgacaatggcatccgaaatagagtccattaccgtgaacactttgtcttcggcaataccaaccacacggagcgtctggtcttcgacaccgaacaccaaacatccgccttgtccattggcaaacgccactgcggttttggtgtagttgatgctcctggagggaggtgtgagcttgtactccacattcttggattcaccgtttagcagtgcttcaacgctcatacattgattatctttcatatgtctaaaccatttcagttggactgattgtttcctgcattagtcagggttgaatcatcattcccataagcaagccaacgagctttagcgaatagttcatcatatgtgataatttcaggagtgacaatactggaccgaaaaagctcaaaagatctaattttctttgtgtttttccaccactgttctcattaataaattcttttgtcgatccaataacaagatatgctctaggacggaataaaaagacctctgaagacggaatatcacagccttcttcgtcctgcgatgtcacaacatgctcagagacttcatcctcagcagcttgaacggttgcatgaacttgaaagattccgccacttaaatctttcgatgcagcccagcaccccggtcgatattcatcattagtgagtagcttagtagtcggttttttaatttcagcaaacacaagcgatttgacaattccacttgtctgatataaagcatctacacgtttacctttgcccgtgaaagagttacctcttacaactgtttctaatttgtctgaattccacgctgtaaaaagcggcacgccaagacctgctcccaaaatccaaggattgttttcaaaaaaatcctgccaagcactctcagtaagagaatcatcctgcatcatttcttcaaaaactgttacggcttttcttcttgacgtaacagctgcaacatcttcgccgtctggatcgttttcgattaattcacgcactttatccggctgccgagaataaacttgtcccaatgtttccccattgtcatcaagcattctctgaagaagcgttgcatctaaacgtttaggtaaattctcatccgcaggatcccacatgcccacgcaacgaatcaaatttaaaaaatcatcaacctgcccatccgttaaccgcaataaattaaagagttctcccggctttttaggattaacccgttgaatcacaagttctttataatggccggcttccttggcaacacttattttgatttgcctttttagactcaaatccatacttcgactctcccattccacctcagagacatcaatttttggatcaatatcatcacaatcaaaaacctgattgatatttcttgccgggaaaccaatatcctttgaattcggacgattatatgcaaacatattggaaatatacgttcgtccaggaactcgcctttggaaataatcaatctcatcattctgaggtttagaactgctcatacttaatccttcaacgagtgaacgggccaggtccaggtggagacttctttgcgctttcgctcgatggagggaatggcgcgaagggctttgcccatgcgtaggtagttcaccagcacgccgtcgtccagatccatttccagattgcgggtagccaatgggtacagggtctggtcctcgtaatccttgcactcaagaacggccttgcgtagtttggcggcctgcttcttgtccgcggtgcggtcggaacgctccaggctatcggcgatgtcggcgattttgttgatgtagtcacgtagataattgagcaccgtactcgtggttttcggcgtataccgatgcagatacaccagcgccttgaatgctcccttgttgttggtctgactggagtactcccagtaaatcggccgattcgaatacatcttcacatggtcgttgtagaaatcattcacgaaatacttgcgaatgctcttgcccagcacctgttcgatgtaggcgatgttcgcggccagattctccttgccgaacgccacggtgaggaacctgcggaaccgtgccacgatatcatcttcgaagcagtccgtctccgtaactggaatgacattgtctgcatccggttcgaatgacgggtctggaatctgcgcatagtagtcatcaagagtttcaccctgagatgcgagaatcaatcccggcttgtcgagcgaatatctgccgaacatgcagcccaccgcataggaaatgagttccttgacgacatcttgcgcgaatttctcgttgcgcacttccggagtatccttcggatatgcgaacgcggcgttacgcttcaatgacacgcgttccagcggcacatcgcatggcacgtcatcacgcacgccatatgcgtccgcaacaactatgttgttgtcaatctcaagctgccgctgttccgaagcaatcattgcccaatatgagcgaacattcttaacaagctcttctaggatgccagatgaagagtctgcctgttcctcatcaaacaatatcggcttactgaaattccacgaagcttcttgagtgttccaatcatctttagcattccgaattaactcatcaattcttaaattccaatttcccggaagaagattggcaattggcaacttcgcaacttgtccaacctcaaaatgcagagtcggagccattgctgctaaaagctgacccgttactgaagcattgcaaattgcaataagcttatccctatccagttcatttttaggaaaaagacaatcaccaacatggctgaagacgaaaccttctgggtaataccgaaatgaaggagttccagaagacacattggaccacgatactgaggactgaaaatagaactgtggattcctgataactgattttggcctgaaatcatacaattcttgaccattattttcccaattaatcacataatcttggtttccataccatttgcggtattcaccacctttgttgtaaggaaaccatttatcgcaaaccgaagtttttctgtcctttgcgttatcagacgtgagcttcgatttggattgcgatacttcccaccactcacgaatgaagcgattgttatcagcggtcgcaagaccctgccttggttttgcaactttttcaagcttatctcccttagtgaaagcctccagcatgggttcactaagccaatagacaattggcgagccggggatttgcgcgaattcgcgctggctcacctcgaagaaatacctgcgcatatccgaatgcgcggattgctcattattatgtgcgtcggtaatctccaacgcacgaggtccttgctgtttcgcacctacgaaatcgctaagtctaacaaatgcgctcttcttactgctgtatcccttttccaaagtaaaggtgcagattggaacggtagcgccttcgaagccagagtactccagctgaatcaatgaactgatgtgttcctgtcggataatccgttgacgcatctgctcataggaagatatgaacatccacacgtaaggagtcatgaagccaagctgcccatgcttaggcaccaactcaaacagtctataaatgaatgccgcaaagagatcagccttgccattctcatactggtcctgcacgaactgtttgagctcgccgctcatattctttgcgcccatgtatggcgggtttgccaccactgccgcgtatttgcgagcgagataccttgtttgagtgaatacgtcctctgcatgttcacgcagaagtgggtcgaacaacgtattgatgtcatccgcgctttccggtgctgacgccgctaattcaacaagctcctgcggcggctgaatcagcgaaccgtacacgtccgccttcgcataggtgttccataccgtggagtccagattcacctggtataggtcattcagctcggcgacttcgtcttccttgaacgcaatcggcacaatgcgctgaatattcggctccacctgcctcttgaagaatctacgggaacgggagcgagccttcatggtcagagcgaaggcggcaaggcttgcggctcgttcatcgatttccatgccgtacaggttgtgcttgagaatcaggccgggaatatcgctcggcgcatacccctcctcctcgtagatctcatacagcaggtcgaacgcataggtgagcatgtggccggaaccgcatgcgggatcgcatacggtcaaatcttcaggcgcttggatgttgagaatatcctcgttcccggcggagtcatcctccgaaggctgaatatagtagttccagttcttgtacaactggctgtctggatgtgactgcatccagagcctgcccacggtgttctgcacaaggtagcgcacgatccaatccggcgtgaacagctgggtggcggcgggaatctcattggctccggctttgtggttcttcttgaacccgtccatcacctcgttcttgcgttccgaaatgtagtactggtacagccagccgatgatctccacgttgccggacggatcatcaacaccgcaatcctccggggtcatgacctccaccgcattcctcaacacggacccctcggcgagcagatcggctggcatgagcagttcatccactctgccggcttccttgccgacgttttcaaacatgaacggcaggttacgattccagaaccggcattcggattgcagcagcagaccataagccaggccctgcggatcatctgccatgacggaaccactcagcaatccttcgatgcgctctttggccttatcattcccccgcaacgagaacaccctgttgtcatactcgcctcgtttcgcggatgcaagcacttccggcagaccattcgtgctggtcagaacagctggagagaccaccggcgtgccggtgaacccgtgcacatccatgtaacggaacgcgatgatgcgattgaaccaccggtacgcataacgctccaccacgtgcttgcgaccctgctcacttccaccggcctgttcgatttcacgctgcagaaaagcgaacacacgcgggtcgtcaacctgggcgtcggaattcggcaccagtgcggcgtcaagccgtgcctgtaccgcattcatgagctggcggcgcgcatccgttgcgaaggcttgcagtttcgacgtgttcatagcaggatcttctttccattctcaatggcggcgataagctcacggcggtaagcatcaaggaagtcatccacatcatccttggtttccaaggcgtccttggtatgcggcctgctgatggtggcgaacgacacggccacgcgcggggtttcctcttgccatgattcaggaatgttcgtatccgtcggtgtagtagatggagtctgcgcctcatctgcgagcgcggtcttcggcctcggcgcggaggctgctagcgtgttgatgagttgcgggtaagtgcgttcgctcagttcgtgtacgctttcgcgcatgttgtagatgaacggtatgcgctgcatgcgtcccgccacttggtccagttctgtctcgaccttggtttgcgcggcttgtgttgcgtgctgatattcggtggaatcgtggattctggcgcgaatatcttccacgtcgttaagcgcgttggcgcgttcggtttggatggttgcgtctgttgccttacgcagatcgtcaatggcagtcttgaatttattggttttgcggaagatgttcgggtcgtttgccagctgttccgcggattggtacaggcttgctgccgtagtaccagatacatagtcgatgttcggcttgttgtttttcagccattccaatccgtctgcaagaatcctggattgggagccgttgaggaaagcgacaatcgggtcgattacgtcttctttaaactcgagcagttcttcggaaccgttttcggtttcttgtgcggtgaaatcgccaagcagccagtcctcacccattccggaggcatagttgattttctcaatggccttgtcgagctgctgcacaaagccgaatcgggcattgcgcacgcgcagctgggtcagactctccgcttcccgcttgagccgcgtggtaacggcctccgtcagatcaatcgcgttcgatggcaggtccgtggcggtgagcccaaggaaatccctggcgaagtcacgcagctgtgaaacttttctcgtgtcgaatacgcgtggcagatccactcggatggaatcctgcttcttcgtttccctaagcaaacgggcggcctcgctgcgctgcaccggcttgccatccaatgtcagtgtgattctgtcggaaccatacaagtggccgatgcatgcgagcgtggcggcgtacggccaaccatagggaacgctgccgtaggcatcaagaaggctcttgacggtggcgaccatgcctttgcctttgtcacgactgaccgcggcgaacacatcatcggcgggaacgtcgagcttgtcctgcactgcgttcatgccgtcaagcatgccaggctggtgctgcgaagcgttcatgatgatgcgagcgagatccgtttcctcatatcgttgcccaccaagtagggaaaagttcgtgtagtaccggccgatgagcgttccaagcccttccgccatacgcgcctgcacctcggtggatttcacttccacttttccgccgttatagtcgaactcgccattggccgcggctttgacgatgcgggtacgcagctccgtgtaaagcctttcattggcgacgctcttgcgggagatgatctgctggcgcacttctgactggctgttcttgtcggtgcgcatgaggtatgtgtaggttttcacgtacatgcgcagatcatcgaacagtgttctgtcggacatatccaacagcaaagtgatggtgtcgcgcatacccatgcccatgcgaatggcatcgtcacgatcctgcgcattggtcgaagtgaccacgttcaaccagatgggctgttgcgcggactgttgcaccccatctatgcgcaaaccatagcggaactgggcacgctgttcgccgtatgccacggtcatcttgccgagcacgtcactgaccaggatcttcttcagctcgtcgatttccttgctggagtcgatgtccgtgcttttgatctcctgctcaatatcctgctcttcgttggtcaggtaattgtaggtatctcccacacgctgcacatacgtgtctttttccaactctcccagaacatacttgatgttccgttccagttccatcacgtccatgtcgaactggtcggtcagcagaatgcgcaggttatgcggtgtggtggggaatccgtcgacatgcttgaccagcagcagcaccttcagcaggcgcacgcccagttcctttatatcggagccgagtctcttttcggcttggttgatgcggaagttcgaggttgattggatggcgtcggcaataccgtcatatagtttgtcgaacggcatcagagccccgaccatctcattctggctggaccgcagcgtgctgctgatggtggacagcatggaccgttcacccacagatgcgtggcgtccggaaaacatgttgtaccggctcatttcccgcagcacgttctgaaagagctcgaactcatagttcacaaacggatacgatgcgatgaaatcgtctttgctgtatgccttgttattactgaatttcgaagtctcacgagtgaattcgaacatggtgcgcaggttcgcgttctgctcatcccacagctcgttcatcaccgactcatattccggtttcttggtaagcaggcgcttctgaatgacctccaccacgtcggcgctgttgagcttcagcttgatggagaacctgccctggatcttcgagaaatcatagctttgttgcttggtccgatcgccaacaatggtatccatgtcttcttgggaagtgaccaccacccatgcacgcccgttggtcttgacggcaagatcctcggcgatggattgcagtgacagcatgagttctctgttctcaccgatgaactggcctacctcatccacgaggaacaggatgcggtggttcggttcctgacgggacagccacacgttcacgtcgtctgcgaagtcgccgaccgtcatcgtgtacgtatcctcgtaccgttggatgatgctgtcttgctccggtttgcctgtcaccgcggcataggcttcgcagatctcatcatcccatagcacggcctcaccacggccttcgctccatggtttgccagccacctgctcgaattcttgtttgaaatccttgaaataaccattgctcgccaaatcgcgttcgaatttcgcaacgtatggattcttgccgtagaaaccacgcgcctcatcgaatacgcgaacaaaagcgtacagcagcatgtcggaggcattggatttatccgccttctgatcgatgttgaatagaatcgacgtggctggtatcgtcaaagccttttcaagctgacctgcaagcatctggtcatcctgtgcttcggccttgcccatgaaggcatgaacaatctgttcgcgactcatggtcggcttattgcccttgtcaacgagttcagccgggacctcgcccagaatatgcgacagcatcttcaacaggtgcgatttaccggaaccgaagaaaccggaaatccatgcgccattctgttcgtggttcgacgggtcgttgtatgcgtcaaggaatttggccagattgcgacaaatctcctccgtcagcacatactcgttgacctcatcgttaagatttttctcatcattggccttgatcacaccattgatgttgcggtcaatgtccttgctgaacagctccttgaaactgatagcgctttccccgttcatctgcgttcccttcttctttgaacgaatacttgcaaatcctgcctcgtgtcatgttgcagctgacaggacattcctttaaaccgctatgcttccagctgcacgctcatctcacgcagattttgcgcacgatagtaattgtctcccggcaaacagttgaacagcgacatgaccgatcctgaagtagcgcttcttgtgaacgtacccggataaaacagtaccagcgggcgatcatcgatacgcccttgcaacgcgttgagcagtgtatgcgcacgaatatacgggtaaaccttgccgattcccgtaataaacacgatatcggccccgccttcgctcttggcctgctcgtaatgatcacgaatggtatcgggcagatgattcgcatcggcacccagtatattgtcgagcaatctcaagaagttatccgtgtgaacatccgatgaaacctttttgtggcgtttttcctccctcttgaatatgcgatccaaaatgccacgcttctcaagaatccccaaagcaatgtcgtacaaatccaacgtaagcacttgcggagcgtaatcgccatcatctttcggcgtcatcgtctgcagacgattcgccaactgcttgatatgctcggcgacttcaagctcctgcatgggcgggtagtcatagatgtaatacggctgttctcccgccagcccactgttggtccggaatgaacgggactccatgatctcatataaatgagcgaaatcagcatcaatgtcacgacgctcatccacaaatccaataccggcgatggaatcagccatgctaccctccgttctgctcataacgacgattcgcgcatcggaagatacccgaacgaatccgccctctttctaagaatatccgccaaagagggactgggaaggaaagacagcaccgtgtcggaatttttatcgaacagatgtgcctccctcatggccttgaacagattggaccgaagtttcttcgccgttccctcgcttacggtttccagttcaggatgccatgtggctttgtccgcaatgaaccgatcataatcttcaaagtccagatgcgtattgccggtaagataatgctttttaagtacttcgccggcgaattccccgacgattgcgtaataacggcacatcgcgatccacataagtgcctcgcggtcggatgtggaggaatccgggcctgccaaatatgcaagctccccaaccgtgagcgcactgagccgcctagtagtttccgccacaacgcgcctgttcgcggaatccgtgcgaatcgcaagaacgttttcctcgacggcctgttggcgaatcgcggcaatggacttgcccacctcagtttgggaagaacactcagcgtcgccgccgcctgcatgattcagatgattcagatacatttccgcaagcgcccggccctgcgaggcaagaagtccaccgacagtgaaggaaagccggtaccgcttcccctgcgtcgcttccgcaccgtacgagcccgccatgcgattctccctctgctaagacatcaacgttaagacacaagaatgtttcagaatattcctaggtgtggaagtatctgcgtatcaaccctagtgtggaaccgtttcggtacatctcgcggaacctcttatgatatgcaatctccgctgctcggataataggcaatatagatgatgcgcaaactcaataatcagaataacggaatgaattgaagccaaaggagacatatcaagtttcagcaaagttcgtaaggcaagagcgactgcaccgttgacacacatgagaaaaagcacgaccttccaaccggcaccactcgaaatgaggacgaacgaaaggcacgcaagagcaagacgtttccatcgttccgcaaagaaaaaacgacacggaacgccgagacctatcgatctgttggcgtcacgccgtcatccttgtcgtccttctccgggaaatacacccacaccgcgcccgcgggcagcccgtcattgtcttccggaatctcgattggaccccactcatagacatcggtaccacggaatttcccgttgaacttgcattttttaagtgtaaaagccattcctcgaatgtcaagaaattttgctctacatcggaatacggctccgaagaagtgggcgaaacttttgaaggcggccccgcagaaattcgcaaagtcatcgaagacggctctatcgaagttcgcatggcttttgaaggcggctccactgaaattcgcatagcctttgaacgtagcctcgcgaaagtcaacgatattgaagttagctttgcagaagttcacgtagcctttgaaaacagatccgcaaaggttcgtgtagcattcgaaggtactttccatgaagttcacgccctcgtgaaaagcaactccatggaggtcgaacgcgcagtcgcaccacagctggtcatcacgtacgatttgctgcacgcggatttctctgttgtcgtcttttcgtcctttgagaagatggttgcgcatgacagcaatgatggtggattccacggccttgtcggcgtcgccagacctgggctggtccgtcgccgacttgccgtctgctccgaggggatacgtctcgcggtcggaacgcaggtagccgcacaggatgtccaccacgcgctgacggtacccgccaccataggtgtccgcgacgtccgttagcgcgtagacgcctgcgatgcgtgtggaggccctgtcggagcccaattggtcgacagcgtcctgcatcttcgtgttgacgaggcgatcctcctctcggcgctcctctcgtttcgcgcgctcctcatcccgtccggcttgctgccgttcctggtacttgatcaccaaataggccaccgcgcccacgccgccgacgatcgtcagagaagttgcagcgatgctcgccacgtatttccctggctccgatgtcagatgccacagacagcacatgacggctgcgaacgcgaggatagcgagaacgacccatgcgacgattttgccgagcaacggccattcacctatcgactccttccatctctgtagcaacgtcttcttctgaggtggctgcatcgtttctccctacgttctatcttccatgttcgttatcatagaccttcttcttccatcatcatcggccaagaagccgataaacaaaaggcctttcgctgtttggtgggtgaaggctggttagcagtgaggacattcggggagtttggcggtatggataccacttcgctgttaaccgccgccttacagttgcccgacctgtggagggtgccaggcgtggagttccgcgacggggcggacgtcaagcgcaagctgcgcatcacgatcggcttcgcgcccgactcacgtttccattgccccgagacgggatacagcgaggcgtcgtgcccggtgcatggcgcgcggggcaggtgttggcggcatctgaacttcttccagcacaaagcgttcatccacgcggacgtgccgcgcgtgtcacatgcccgaggcatgacatcagagcggtgacggtgccgtgagcacgtctaggaagcaggttcatgctcctgttcgaggcgatggtcgtcgaactggcgaaaagccagccggtccggacgttgtggcgcaggtcggcgagcacgacacccgcctgtggcggctcgtcagacattacgtggacgaggcacgcccgtacggggactacacgggcgtgcaggcgataggcatcgacgggaccgccgcaaaggccgcaactgcatcactgtggtcgccgaccaggcggagcgcaacatggtccgcgtggtgccgggcaaggacgcgcataccgtcgaacggttcgtgcaggatttcattgaccgcaacggcgacccaaaccgggtgggtctggtgacgtgcaacataagcctggaattcgccagaggcatctgcgaacacttgcccaacgccgcgaaggtcatcgacaagttccacacatcgtcaagcacgccaacgaggccgtcgacaggggtcgcagggccgagggcgggcacaacacgaaatacctgtgtctgcgcaacaaacaaacccacccgaaccccaattggagatcaagcgcagcctgcggaggcgtcggcccaggaccgctagggcctgccggatgtgtgagccctgcaggacatctgcgccgacagcgccgaccggatcgggaccgaaacgggggccaaagcattgcgctcgcggatgatgcgctcccgtctggatcccatgaaggccttggcccgacagccacgccgtcactgggacgacgttctcgcctacttcggtcatcggtgcgccaacgtaatcctcgagggcctgaacagcatcatccagaacgtaaaaatccacgcaaggggcttcaggaacatgaactgcttcaacgcgatgatttgcctgcggcaaattcgatctacgaaccgtcactacctgaccgacttcacccacaccaaacagcgaaaggccacagggcagacagaaccaaatttctagatgattttcttgcatttttgaaggaatacagagcctcgcttcctcaaccaattttcagcaaactcgtaagttcacaggctgtgaggaagatccagaagacgaggaagttttcagatgggaacgattgaaaaaccgttctatcggcgtatggcatttgttttcatgctaggctggttggttaattgcggtggaagccttcgggcgacacctaggaggagccgatgcgtcggctcctctttttaatatcttccagcccatcagttttttcaatcgtctatttcaatcgcgtgaatcgcgacttcgccatcttccgagaactcggcttttctgaattccaggcggagttccatgccggtctcgtcgaactcaccgttcagattacgcaccagcgcatcgaccaatcagccgctagagctctcagtcatattctccctactccgatagacgcacctaggcttaacgcccatggtattcgctcctttgactgttcggtggataacatgcggataatccgcattcaccatgagccatgttttcttcgcgagcgcgacgggctttcaatagataggatctgcttccaggtcagcaattcgtcagaatgcgtccgcgcgccttcacgcactctcagcactctcatgcatctacatctcaattacatactttgtcgctcatgcagcatgttcaatcgccaaagaatgtacagtcctttatatcagcgcccatccaaggctacgtttacgtcctgaaatacggtggacttcttttctatctcattgctgctacgagtagcagcaacagcttccaagtctcttagcaatgctcaaatccagggtctcttccttttgccaagccgcataggcatgtataaatcaacatatctgccttctctgaactacactgttcctagaaaagtttcagcattgaaaggggtaaccgatgacgcgcaaaggtgggttttgaaggggatcgtcgcatcggcggcgacctatgccgtcaaaacggcggtcgacattgcggccaatccggaaaacatgcagaaggtggcgcagcttgtcagcgagcaacaggtaggcagcaaactcaagcaggccgccgcgaacatgcatctgccggccgcgcttagcccatccgcaagagttgccaagcaacttgacgccattgaggagacactggagcaatacgccgaccaatttcctgtaaacgcaccagtcgaacgatggaagagcaccctgcaaagccttcatcttatggacaccatgaacagatccacaaccggcagcgagcataagatccgcttggaaaagctccaggcacaaaccgaagctctgttcaacgagatcttccagtcccttgactcgggcgatgccccgatcgaagactgaccacttccccaccgcttttatacccgttcaccgccactcccaagcgcaccgacgcgtctgccggtcgtatactgctaccaagtggatttgaaggaaataaccatgatcgacgacgattccaacgaactcatcccattcgaaggcggagacggtgatgccgacgccagcaccgggaacaacaatccagacgacacgcaaagcgtcaccatcatccaagacgaacaaggcatcgtcttcctcggcgacgccgggaccatagatctctggctcaaggacgaaggcttcggttccaaagcgttcacagccaaagccatacagaccgtctcctcggccagcaaaggcgcacaaacggtcggcaacgccatggccgaaagcgggcgttgggtgaagctcaccaaagaatcagccgaactggttgccaaatacggcaagaactgcaagaaaggaccgttccaagccggcgttgtacgacaaccgaacgggcacatcatcaaacatctgcaattcacccagccagggcaactcaaccccgccatgctcaccggcatcagcggcgtcatggcacagatggctctggaacaggccgtctccgaaatcaccgattacctgaaggaaatcgatgcgaagctcgacgacctgctgcgcgatcagaaagaccagaccgtcagcaagctcgccagaatctctcatatgattgacgagaccatgctcatctaccagcaagtcggttcgatcagcgagaccacatggtccaagatgtcaggctgcccacaagacatcgccaccatccaagcgtatgcaatcgccaaaatcaaggacctcaccgagaaggtggaacgcgagcaggatcccaagcaggttcgcccgctgacccagcagattcgacaggagatccaccagtggttgggcatgctcgcatccgcggtcaggatgcaggatcaggtctcctgcatcgagctcgcacgcgtatgccaggaggagccggaacagctcgaagcacacaagaagggcatcgtgcttgctaggaacaagcgtcttgcggaaatcgagcagtcactcaacgcattgggcaggcaactggaaacgaaggctggaatcgtaggtgggaaggtgctgctgaacccatacagttcacctcatgccattgccaacatcgaaagcatcaccagcgatctcaatgcattcgccagcacattgcagcttgagcacattcatctgcatgtcgaagacggtcccacctggatcgaagccgcgggcaaggccgtagacgacaccggcaaggccttgcagaatgccaggcagcagaccgcacacgccgtccaagacgccggcagtgcgatagcgaagggcgctcaaggcaccggcgtcgccgttgccaagggaatgcaggacgccggaaaccaggccgcgcacatcgcgcaggatgcgggcgacgccatcacgaaatgcgctcaggacgtaggtgccggaatcgccgacggagtgcagcagtttggcaaaggaatagcagacggattgaaacagctcccggagatcaaactgaccaagttcgggtggggcaagaaataagccggagagtcacgccgtgagcaccgagcttctttcgtcgtttcgtgggactcttccatctgatcatcatcaacacgtgccacaaacaagccaacaagcattttggggagggctattcgtgcgatgttgcgctctatcattgataaaggcatccagcaaccgcatatagtaaggaatcgcatgcgttatttcacttcggacacgcatttcggtcatccactagtcaccgcgctgcgcgggttcctgaacaatggcaagctacgtgctgagtacctcgacatctggcagacgcagacccgcaccgccgcacacgcgtggatcaaacaatatgtgcacgacaatcagacatcgttcaaagcgatctgcgacatcgcacgtcatgagaacaccatcatcgacaatatcaacgagatcgtcgggcacgacgacgaactgtggattctcggcgacctctcctaccgttgcaccgtcgagcacacactcgaatgcctgcgccgaatcaactgccaacatctgcatctgatcatcggcaaccacgaccgcaacttccgtctccgattcaatgacatgctatacgaagacgtgttcgagaccatcgacgactactgcgaaatcgacatggaacttcccgttctcgatgaatccggcaaaataacggtggcgaccacgcagcaaagcatcgccatgagccacttccccagactctcggcattggccgaagaacacgacgattggccgagcaactggaacgagttcgccgatatggcgcctaccaccgaaggctggctgctctacggccatacgcatcaggacgttcccgacggcaccgatccgcgaagtgtgaacgtgggactcgacgcatgggatttcaagcccgtcagcgaacagcagatcctcgcctggcttgcctcccggaactccaaccaatcaaggtgaattccaccctgagcatgaatccggactgtagaatgccgggtcgctggtatttgtcgacgccggcgctccaggtttgcaaccattcgagtttgggacactgtcggcatgttcccggatcaacattgccgatgatggcggtgacttgagctttgagctcttcggggatgatggccgtccatgccatgttgccacgctgcgccggatcgcctacgaattcttgcagcacgcctttggctgcacgcataaactgcgcttgttcggatggcgtcaacggcaggcagttgacgataagtttgcggttgttctcgattcccatgcgttccaccttggggcagacgcgagataagcctttcggcgcgggtggcggaaaaagatttagccgggtctgaatcgacccggctaaatcatctacacttttgctttgctcaggcgagggattcgtacgcttgcgcgtcgaccggctcgagccattcgttgctcatcgtgttcggatctcctgctgaaaccatgaatgccagatgggagaaggattcgcccggagccgcaccatgccagtgcttggtgtcggcgggaatgcacatggcttcgcctgccttgagttccctgggctcctggccttcgatctggtagtagcctcggccgcccacggcgatgagcacttgggctccaccgtggtggatgtgccagttgttgcggcatcccggctcgaaggtgacgttgtggatggagatttcgggagcgtcaagcaccggtgcaagataactttgacctacgaaatactgggcgaagccgtcgttcggctctcccatcggaaatgcgcttgggttttccataatggtcctttcgtatcaatacgtgttcattgaacctctctgaaaaaccaatgtccaataagtgtcgaacatgcttttccatgcaacaaatgcatatagagaaagctgcgacacgtattggattaataaccgacgcaacggtaccgtggaacatattgacgtcgttcattccatctatttcaggtaagggagctgcacaaccatgacagacatgcaatacgcgccattgggccggtcgggaatcaacgtttccaaggtctgccttggaggcatgagcttcggtaaggcctcgccggatttccatcagtggaccatcgaccagcagggaacggaacaagtcatcggccacgccatcgaccgaggcatcaacttcatcgacaccgcgaactgctatgccttcggcacttccgaagaatacattggtcaggcgttgcgcaatctcaatgtggcgcgagatcaggtggtgctcgccagcaaagtgtacttcaacgatgggcatctttccaaagaagccatcaaccgagagatcgacggcacgctcaagcgtttgggaaccgactatcttgacctctacatcatccaccgtttcgactacaccaccccggccgaggaaaccatggaagcgttggacgcgctagtcaaagcaggcaaagtacgcgcattgggcgccagtgaaatgtatgcgtaccagttccacaacctgcaggccgtggccgacgccaatgggtggacccgattcaccagcatgcagtgccactacaatctgctctaccgcgaagacgaacgcgagctcatccccgtatgccagcagtacgacgttgctttgacgccctactctcccatggcttccgggcatctggcacgcccggcttgggattcgaattccgcccgcggcaccaccgatggcaccatgcacaacaagtatgaccaagcgaaggcgcaagacatgcccatcgtcgagcgcgtgcatgaggtgtccgagcgccacggagtgcccatggctcaggtcgcgcttgcatggcattgggccaaaggcgtgaccgcaccgatcgtgggctgttcgaagccggaacgcgtggatgatgccattgccgccctaggagtgcagcttacggaagatgacatcgcctacatcgaagagccgtataccgcgcatgagctagtcggtccgctttcccgcccaggagagaaggccttggccggcactttggctcccacactcaaggaaaccactcgaaactagcttcgcttgactccgcggggcagtatctgccttacgtatggcagatttcgctccgcgtccccatgcatctatggcaggtcttatagataaaaagcgggttagagggtacgaaacataccctctaacccgcttttgctcgttcctgactgccatatataaggcagatagcatcggacagcctcgcgaatctgccatatatagctgagttagaagtcgaggccctccactcaagaggggacttcactggccgaggcgttggacgagagccgttgcccttcccgccaatcaccggtgccgaccatggtcgccaagtcggaaccgctgctgcctagcggtgatgacgaagaagcggcgaatagaatgacttcttgccgatgaagtcatggtcggtcacaaagtgattgaccgacaatgcagctccgccccaccagatcggatagccgatgaacacggtgatccaatcactcacctttcacagtgatgggcagaaacgttcagcagcgcccctcgtacaggaagaaggaaagcgaaccgtcttccaaaccaccttgagtaaaggaatccctacgtatggtacattccgctttacgcgtcaaaccacggtaatcataaaaaccgtaatcgcaggtggtgtcagtgaagaggaaatactcgttcattccagcatcacgaaacacgtcaagcatgtggttgaacagcttacgaccgacgcccatgcccctcgcttccggggaaaccacgaacagcgttacctcagcctgatagcttttgccggcatctcgcttcaacatttcatcggcctgcaaaatcgcaatctgatcggcaagtcctcgacggccatccttgcttgtcaacaagggcaacgccaagcaatttcgcgtaatagcatgacgtatcctctgcgctgtggtaacacgggatctcaacgagcccaataccacgccaagcacccgaccatcacgttcagcgaccgtagcctcggtggtgcgggaaagaaaatcatgcatgtcgattgccgcaagtcggtgcatattgcgcagacgaatcgccttgcgcaacttgtactcacgcaacccgcgctcatcgttcggaacattcccgttatcatccgactcatcatccgcataccaagcttgtcgaacaagctcttcaagcgcaggaaaatccgtgcgacgcatcgtccgaagcataattgtttctgaagtcatgctcccccatcctagccgcagccatgccaaagctccgttcatggatggcataatgcacatagtattgcgatagcaggaatgcgcaggatttgttggcattggcgtgtgacgcttgggggtctggggtcacacgcttaggatgagacaggattgcgtgcgacgcgcaatgaatgagaggttcatcatggcaatgttgattagacgaattacaggcactctatgcttagtacttgccgtggcatgcgcatgttacgctttcgccgtgcgcaatacgcattccggcacgagtttctggattgtttggctagcgttcgcagttttgttcgcgatactcggattcggtctgctcttccggtggtggacgatattgccaagactggtcagaggcatattgattgcggttgcgtgtattggtctggtcgcgttcggcacggtggaaagttgcatcgtcagtaaaatgcatgcgcaaggcaaaccggatctcgattatgtggtggtgctcggcgctcaggtgcgtaagtccggcccgagccttgtacttcgctaccgtctcgacaaggccatcgaatatttggatgagaatccgaataccatctgcatagtctccggtggaaaaggaccgaatgaaccgttccccgaagcccaaggcatggctgactatcttaaagagcatggcattgacgagcagcgcattcttgaagagccggattcgaagaccactgaggaaaacatcgtcaacagcaagaagctgatcaacgacgatgatgcttccgtaggggtgatcaccaacaatttccacatgttccgcgcactgcagattgccgacaaatatggtttggacaacgcccaaggcattgcggccggctctcccccgaacatgcttgtcaacaacatggttcgcgagttttttgctgagattaaattcctgctgtagatttcaagtttctcaagctgtaagcatatcgggaataagttgaggggttggctcttggaaccaacccctcaacttatttgggactcttacgagtcagaagctatcgatcgaagctcactcttcggaagcaagctcgtcagccacagctgcagctgcggaagcagcttcgacgctctcggcttcttcgtcttcagcggcttcaccgaggaaggcgctcaggtccagggtttcgccctcggacttgaaggtcacggcgcgcatgccggcgagcaggcccttggaacggccgacttcctgcactgcggagccgagctggccgttgcgcatgatggcctggatgaaggcgttcggatccatgccgtactgctgggcgatggaagcgaggaagttgaacacgtcggactgggagaccttgacgtccagcttctcggcgagcacgtcgagcaccatctggtcgcgcagttccttttcgacggtttcttcagcttcggccttctgctccttggtggcattggccggatcagcggtcacgcccttgagctgctgctcaaccatttcagccttgacgcccttcggcaccggaatctccaggccctcttcgagcttggcgatgaaagcgtcacgagctgcggtggcctgacgaccttcggcatcctgggaagcggccttcttgaggtcttccttcagctcgtcgagggtgtcgaactcagaggcttcagaagcgaagtcgtcgtcgagttccggcagctcttcagccttgacggagttgaccttgaccttgacctgagccttctcgccttcgtgctcgcctgcttccaaggtaccttcgaaggtggtctcttcgccggcggacaggccttcgagagcctcatccagaccgtcaagcatggtttcggagccgagctcgtagctcacgccttcctgggagtcgaccacttcgccgtcgatttcggcggtcaggtcgatgttggcatagtcacccttggcggccgggcgatccacacccacgagggtgccgaaacgctggcgcagggcttccagacggttattgatgtcttcgtcggtgatttcggccttggcgacctcgatctccatgccgtcgatttccggcagttcgatgtccgggcgacgctcaacggtggccacaaacttcagcttggtctcgtccttggcggattccggaacttcctgaacgtcaatttccggctgggccatcggacggatgcccttttcttcgagagccttggagtacagctccggcacaccgttgttcacggcttcgccagcaacggcaccgaagccgatgcgctggtcgatgatcttgccgggcacgtggcccttgcggaagccaggcacgttgacctgcttggcgatttccttgcgagcattgtcgagatacgggttgaactcttccggatcaacggtgacggtgagcttcaccttggtcggctcaagattcctgacgctgattttcacgcttgcgctcctgaaaaatacggttcttcacatttctgccgttaggcaacctctacatgatagcgcgactcacggactctgcaaccagcgcgacctgccacgccctcgcgccctgctcggtgaggaattgcgcaacgtcacgtttttgcggttcgtcggtccaacacaggttgcgcagatactgcggtttgatgatgacgtccgcgggggtacgcgtgtcttccgctatctgcgccaccatcttgcgtgccttgtcaagcgttgcgagacgttccggataacgttccctccagactcgcgtcgctcgtggagcggatatgctctgcgcctcctggttttggggattgccgctttcgatgaccggccattcgctttccggcagatcaagcgcctgttggattattctcttccacatgcttggcttgattttacgttggatcggcgcgtaacgttcgaacattttctcctgttcggcaccggcttggatgcgtacacgctcgttgatggaacggaccgccctgaattgcgcggcgttatgcggcttgcgttccgccacttcgatgatggtgctgtcggcgagcagcagtgtcggcgaaatatcgtattcgcgtgccagttcatctcgtttggtccataatgctttcgccacggccagggcctggcggtccttcatgatttcggtgatatgcgagatgcgcagccatgggatgggatgctccttgcgtggcgcagttccttcgcgcagcgcgtaatcgaattcctcctcagcccattcgatcttgccttgcttttgcagttcggcgcgcatggtcgtttcaagctcgatcagcaattcaacgtccagcgccgcataattacgccagtctcggggcagcggcctgtacgaccagtcggccgcggaatgctctttcgcaagcgtcagtcccagataatgctcggtaacggcagctaatccgaaacgtttgagccccagcagccgtgcagcgatttccgtatcaaacaaacgtttcggctgcaatcccaaatcaacgaatcccggcagatcctgcaacgaatcatgcagaatccataccgcatcacccaccgcacgattgaaatcgttccaatcagcaccttccgcagccaatgcctgcggatcaagcaatcctatgccggcaccgtctcttttgaattgcaccaaccaatcgtcatgaccgtatcggaagccagacgcacgttccgcatccgcagccaaagacccatgcgaagacgccaatgcgctgcagtactcgcggaatgccggtagggtgtcgatcacatcgggcacgccctcacgcggctcggcctgcaaccttggctcgtcagtcaacgggataatcctcctcggattgcgtcatggaccggaggaacctagcccacgcgcccacttgggcgcccgcgtcaaggcctccatcggcatagtctagtggcgtccaagacacacgaatctcacacccggtttcgggagcgtcggactgagtgccaaacgtcgtgcttttcgtgactgtgacggttcccgaaacatgttcgacatcgcacgaaccaacacggtccatcatcgcatcccaatacatggacggtatcagacaatcgccttcgcctccagacaacggcaacgcggcgaaagcgacgcaacgccaatgagaatgccagtcatttcggtatttgtgcgaatacaacatcatgatccagcctgtggaacgcgcctcgtcgcattgcatctcaactccaatgccgaaactcgccatggcgcacggcactggaatctcacgatacgacacgcttggtaatcgaggcatgcgttctacggaaagcacggcgtcccataccttgtctggcacaccggagggtcgggtcaacatttgttcaggagggtcggcgtaggcgcacgatcccctacctgtggcacgcgcttcgttgggcgtgccttgaggaaaagcatagatgtccaccatgattcaaggctacggcagagtcgccggttttgcggtatttcacagcatttcgccacgcgtcgaatgtgaagattttttcgcgtggcgaatgctggttcaacaattgcacgaatattcctttttccaatcgctgaggcactttcaaacgattgatttgccggaatcgttggctggaatatgcgtggcttcccgtttagtagacggtgaagccgtgcgattggaattgttccaccacacgctgtttcattgcctcggacggccccttctggtcttccaacgggtagggaatgttgagcatatgccattttggacggccaagctggtggaatccaagcacatcgatatgttccactgcgtcgccgaacgactcgcagatcttcgccacattctcaacgttttcctcggatgaggtgagtccgggcacaagcacgaaacgcacccagatcttcttgccggccttggccagacgctgtccgaaatcgatggtcggttgcagaatgccgccagtcaccttcttgtaggtttcctcatcgccggacttgacatcaagcagacacaggtcgatgtcgttcagcatgtcgtcggtatagcttgcgccaaggaatccggaagtatcgaggcaggtgtgcacgcccatctccttggccgcacggaacacgcgggaaacaaacgccggttgcatcatggattcgccgcccgagaaggtgataccgccatgcgtcgccttgaaaagatccacatagcgttcgatctttttgaccatggcctcgtaatagacgggcttgccgtcacgcattttccacgtatccggattctggcaatactggcaacgcaatgggcaaccgctcatgaagacggtcatgcgtgttcccggaccgtcgacggacgtgttgatgtcccaggaatgcacgaagccgatatcaccgcttttcagcgcgttgatgcggtcacgccggtccagtccgatcggcgattcgaagcctgacaaccctcccataagcgtttggttgacgtagttttgcgattctctgagcatatgccttgttgtggagcgaaaatgtacgttctcagacatcggtgtcctttcgttgtatctctccaatggtttccccacattgtacagggaaaaccaaggggcgaagctttcacgctccgccccttgcactctaccgcttcacacggtaccgttcagtctcagtcgacgacggcgccctggtggaacgtacgggagatcacgtcgagctgctgctccttggtgagcttgacgaagttcaccgcgtagccggagacgcgcacggtcaggtgcgggtacttttccggatgctcgacggcatcctcgagctgttccttgcgcagcacgttgatgttggcgtggtacagaccgtggccgttgccggcgtccagaatgcccacgaggttgccgatgcgctcatcctcgtcgcggcccaagccatcaggggtgatggtgttggtcagcgagatgccgtcaagagcgtcgttgtagtcgatcttgccgacggagaacatggaaggcagcatgccatgggagtccatgccgttctccgggtttgcgcccggagcatacggggtgcccttcttgtggccggacgggaaggcgccggtggccttgccgtattccacgttggaggtgatggtcaggatggactgggtcgggaccgctccgcggtacaccggcaggcgcttgacctggcccatgacggtagagacaacccacttggcgatctcgtcggcgcgatcatcatcgttgccgtacagcgggaactcaccctcggtacggtagccgacgatcagatcgtcatcggcgccttcgacgtactcgtcctcatggcccggagtggtcttggcgtccttgttgtagatcgggtagaccttggcgtacttgcatgcggacagggagtcggctgcgatggacaggccggacataccacaaccgagggtacggtacacttccttgtcgtgcagagccatctcgatggactcgtatgcatacttatcgtgcatgtaatggatgatgttcagagccatcacgtaggtctcggacagccattcgagagccttctcgtagttggccttgaccttctcgtaatccaatgagccgtcggattccggctgaatcggctcgataacgcccttgtcgatgacctgcatgccggtcatttcgtcgcggccgccgttgatggcgtacagcagagccttggcggagttcacacgagctgcgaagaactgcatctgcttgcccacgcgcatcggggagacgcagcatgcgatggcggcgtcatcgccccagtgggagcggatttccttgtcggactcgtactggattgccgaggtgtcgatggagatcttggcgcagaagcgcttgtaggcttccggcagcttcggatcccagaagatggtgatgttcggctccgggccaggtccaaggtgctcgagggtcagggtgtcgagcagacggaaggaggtcttggtgaccagcgtacggccatcatcgccgaagcctgcgtcggaccaagtcgcccagtacggatcgccggagaagatcgcgtcgtaatccttggtacgcaggaagcgcacgatacgcaacttcatgaccaagttgtcgatgatctcctgtgcgtcggtctcggtgatcttaccggacttcaggtcacgctcgaagtacacgtcgaagaaggtggagacgcggccgaacgacattgcggcgccatcctggctcttgacggaagcgaggtagcccatgtaggtccactgcactgcttcctgagcggtctgtgccggacgggacaggtcaagaccatattcgttgccgaggttgatcagctgcttcagggccttgatctgctcgtcatgctcctcgcggaagcggatccagtgctcgatctccggctcggtgaagtcgttgcggtacggcacggagtccttgtcacgctgcttgaacttgatcagggtgttcacaccatacagtgccacacgacggtaatcgccgatgatgcggccacggccgtaggcatccggcaggccggtgaggatcttgttgtggcgggcaaccttgatctgcttggtgtacacgccgaagacgccgtcattgtgggtcttgcggtacttggtgaaaatcttcttgatttccggatccggctccttgccggcttccttgatggcctgctcgaccatacgccaaccgccgttcggcatcatggcgcgcttgcaaggaacgtcggtctgcagaccgacaaccacattgtcgacttccggagagtcgatgtaaccggcgccgaatgcgtcgatgccagccggtgtgtgggtgtcgacgtcgtagacgcgctgcttgcgctctactgccagatagttgtcatcgaggtactgccacaggtgcttggtcttctcggtggcgtcagccaggaaggactcgtcgccctcataaggcgtatagttcttctgaataaagtcacggacatcaatgtccttctgccagttgccctcagcgaagccttcccaagccttagcctgaagctcttccggggagactgccgtcgcatcaactgctgccatttccactccttctgggtgttggtttggcgacgcatcgttacgtcgtcgctagttatcgattctagctgcataaacctgtatagaacctgagtttacgaggaaataaaagtgacatatgtcacacttgcgaagtatgaaaaatcgcggtgccgtaatccggacaccgcgatttcttatatcgaatcaactacttttcatcggaagaccagcgtttccattcgcgatcctgttcttcccatttgatgttgcgttcctgcacgatcttccatgcatcgagcgcgtcttccctggttttgtatggtcccatacgatggctcgccggtgagatcatacccagttcaggctgttcggtaaccgtattgaaataccattgcttttccatatcactccttacgaagcgtgtaacgaaacaatagttcgtcgctgttttattcgcggaacgcgttggtgatcggcaagcggcggtcacgaccgaacgccaatgccgtcactttcggaccaagcgggtactgacgtcgcttccactcggcgcgatcgaccagtcgcatgaccgtgtcgacggtggtctcatcgaagccgtcggccagaagatcctcgcgaccatgcgcatgttcaatgtacattgccaacacctgatcgagcagctcatattccggcagcgaatcggagtctttctgccccgggcgaagttcggcggatggagccttttcaatcgaattgacgggaatcatcacgccgtccggcaacggcgttcccgcagacccctgctcgttgcccacgatatgcagtccgccaatgcccatgccttcggcggcagccttgttgcgccagcgggagatctcccacacacgggtcttgagcagatccttgatcggagcgtatccgccgaccgcatcgccgtaaatcgtggaatagccgcaggcaagctccgacttgttgcccgtggcgacagccagaagccccttggaattcgaatatgccatgacaatcacaccgcgaatacgcgcctgcaggttctcagcggccacaccttcaagatcgagctgcttctggaaggagacgaacagcggttcgatgggctgaatgtcgtagtgcgctccaatattcttcgccagatcggcggcatcatccttcgaaccgtcagacgagtacatgctcggcatggaaatgccatacacgttagctcctcccacggcgtccgcggccatggccgccaccaatgcggagtcgatgccgccggaaaggccaaggcacacgcccttgaaatggttcttggccatataatccttcaagccaagcacgcaggcggtgtacacctcttcgtccggatcgggcttggctgcgataacaccaacctgctgatgttcggaggcagtatccaaatcaaagaagctcaaatcctccatgaacatcggagaacgttccagcagtgtaccgtcagcgtcaaccacaaaactgccgccatcaaacaccagatcatcctgaccacccacctgattgaggtagaccatcggcgcgttcacttcagccgcacggcgtaccgcaagatcgagtcgagtatcagtcttaccctcctcatacggagaaccgttcatggtaagcagcaaatcaatatgctgctcggcaagttctgccacgggaccgccatcctgccagatgtcttcgcaaatggccacgccgatgcgtgcaccgttcacgtcgagcaccatggatttgttgccgggactgaaaatgcggaattcgtcgaacacgccataattgggcaggaagtgcttgtcatagccggcccaaaccacgccatcatgcaatacaacaagtcgattacgcggcttagacgtttcacgatcagtgccgaccgtgccaaccaccacaaacaggtcgccaagcccatcggcagccagttcggtggcaagccagttggctttgttccacgcggctttgcggaaggtggcccgcagggcgaggtcttcaatcggatagccagtaagcgtcatttcaggaaaaaccacgacttgcgcattgttgttggctgcaaggtgcgcataacgcatgaccttgtctgcgttggagtcaagatctcccacacaagtatcgatttgagcgagtgcgaagcgaatgtctgtcatagctgcctaacctaccgttgatttgttgaacgttttattttcttacgatcgcgaattgaaagcggaccgcacgcgtgtcacgaaagttcgttgagcaccgtcagcgccgcgttggcgtagaattccacgccggcctgcagtgattcatctagaccgacgaaatgcgggctatgccaatcggggcagcctttctcgccattggaaccgatgaaggcgaacaccggcatggtgacgggcatgaaatcgcagaaatcctcccccgccatcgaaggatggattggctcgagctgcgcgtagtcgcgcacgttgtcagcgacgattttggatagttccatgtcggagacgagcggattctgaaagtcatcccagtcgatgtctgtggtaatgccgtagcccgcggcgatggattggacctgctgcttgaagcgtttctcgaccagttcgccgtcggacttatggaagtagcgtacggttccttggaagctggccttgtccggcacgacattccacacgtggccgccgtgcagttcggtgatggacagcacgagcggatggaatggtgagacattgcggctgacgatggtctgcaaggcgagaatcattgtggcgagcgcctcgataggaccagtgcccttgtgtggatatccggcatgtgagccggcggcatgcagagtgacgtggaatttcacgcagccggccatcatcgggtcggggcctacggcgatctgtccgggcgcgtaattcggattgttgtgggcgccgatggcggcggatacgtcggcgagcaaccccgcatcgaccatggctttcgcgccgagaccgagctcctcggcaggctggaacagcagtttgatggagcctttgatgcgcttgcggcgttttgcgagccagaatgcggctccgagcatgtaagacatgtgcaggtcgtggccgcaaccgtgcatcacaccgtcgttgacggacgagaacggcaggccagtatcctcttggatgggcagaccgtcgatatcggcgcgcaatgcgatgcgtgggcctggttgctcgccgcggatcaggccgaccacgccggtttcaagcgggttgttgagcacttcgatgtcgtgcgcgcgtagcagtttctcgatataggcacttgtctcgtattccttgaaactgcgctcgggatgtgcgtgcagataatgacggatctcgatgatctccggcgtgatctcaatatgttcgctcatggttgacgattgtaggcgcaaccggacgtttttcctattttcgtgttcgtttttcgtgccgacaatggcgttttccgcagtttttccccgtaagctggatgatgttttgaacggattcacggggagatcggcatgtcatcggacatcaaggctgcgtttttcgatatcgacggcactttgacgagtttcgtcacgcatgtggtgccgcgatccaccatcgacgcattgcatgcgttgcagaaaaaagacgtgaaggtgttcatctgttcggggcgcgcaccctcctatatgggtgtggtgcttgacaccattcccgtcgaatttgatggcattgttggccttaacggccagttctgcacaacacgcgacggcctcgattaccgtcatccaatcgacctgcacgatgtggagatcatcaccgactggctgcaatcgcataccgatgtcgtcgccaattacgcggaaagcaactacgggtatttcaatcgcatcaacgccgctttggaacgtacgtggaacagccttggcaaaaccgcgccgaaaatcgacatatgcaatccgcagcaacgtataggaaaccatcgcacattccagatcagcccatatgtggataaggcaacggaagcggaaatcgccggcatgtgcggcaacgtgcgcggtgtgaggtggcatcccgacttcaccgacctgattcctgcggatggcggcaaggcggtcggcatgcaggtcgtgcttgagcattttggttggtcgagggacaatgcgatcgcgttcggcgatggcggcaacgacgtggatatgctacgtttcgccggcataggcgtggctatgggcaacgccactgacgaaccgaagaccgtagccgattacgtcaccgacagtgtcgacgatgccggaatctcgaatgcattgcatcattttgaaattctgtagaaaaggtttttaagagttttcttgcgattttataagacggttttcgcgaatttctgcgtttttcatgccctttataagtattttcaataagtgaacgccgtgttgccgtcgatggttcctctatattggtcaatcgttgggtccgccgcgtggcaaacgggcggcccgtataacgaattgagagaggaactcaaccatgcgtaacaagaagcttctcggcgcgctgctcgccgtcaccacgctcgcgaccttcggtctggccggctgcggcgactctggctccaacggctccgcctccaaggaggatgacaagaccatcaccgtggcggcctccccgaccccgcacgcggaaatcctaaacaaggccgtcaagtcgctcgtcgagaaagatggttataagctcgaagtcaaggagttcaccgattacgttcagccgaacaccgccaccgaggatggtgaagtggacgccaactacttccagcacaagccgtacctcgacaacttcaacaaggagaagggcacgcatctggtgtccgtggagggtatccacttcgagccattcggcctataccctggcaagaccaaggatttgcagaatctgcaggatggcgccaccgtggccgtgccgaacgacgccaccaacgaggcccgtgcgcttctgctgctgcaggatgccggtctgatcaagctgaagaatccgaaggacatcaacgccactccgaaggacgtcacctccaatccaaagaacctgaagttcaaggagcttgaggccgccgtggttccgaccgtcatcaaggatgtcgacatcgcggcactgaacggaaactacgccattcaagccggcttcgacccgaccaaggacacactggtcaccgaaaaggccgacggcctggccgcgaaaacctaccagaacatcctcgtggtgaaggaaggcaacgagaacaccgccaagaccaaggagctcaagaaggctttgaagtccgacgaggtgcgcgactacatcaacaagaactacaagggcgctgtggtgccggtcttctaagacccgcttcggctgcaagaattcaatgccgcaggtatactaccctgcggcattcttgttatggaacatcaataggaacaggacattatgacgattcagatcgaccatctgcacaaaagctatggcagtggcgccgaagcgcatgaggtgctgcacgacatcaacctgaccatcgattcgggtgaagtcttcggcatcctcggctcctccggcgcgggcaagtccacgttggtgcgctgcatcaatctgctggaacgtcccacttccggcaaagtgcgcgtcgatggtgaggacatcaccgacgcgaaaggcaaggagctggcggacgtgcgtgccggaatcggcatgatcttccagaatttcagcctgttccagcagcgcacagtgctgcgcaacgtcacgttcccactggagctcaaccatacgccgaaaaacaagcgcgaggagcgtgcccgctatctgcttgacctggttggattggccgatctggccgaccgctatccgagccagctgtccggcggccagcagcagcgcgtggccatcgcacgcgcgttggccaacaatccgtccatcatgctgtgcgacgaggccaccagcgcactcgactccaccacgactgcgcagatccttgacctgctgcgccgcatcaaccgcgagctcaacgtgacgctggtcatcatcacgcattcgttgtccgtggcacgcaacatctgcgaccgtgtggccatgattgatggcggacgcatcgtggagatgggcgatacggaggaattgttctccaatccgcaaagcgacattctgaaaacactgatcaccgatgcgaaagtggagaaccatcgccataagcatgattccgcttcgtccgatgagcagacggactcgccgaccaaggaagaggtgaagtgaaatgggacagattatctcgcaattcatcgccgattatggcgaactgctggtcgagggagtacgtgacacgatcatcatgaccgcggtagcgacgctactcgcgtatgtgatcggcctacctgtgggcgtactgctcatcacctcagcaaagaagggcatctgcccgaatgcgacactcaacaccgtgctcggctggatcgtgaacatcgtgcgttccgtaccattcatcattcttctggtggccatcatcccgttgacccgactgattgtcggcacttcgctcggcgtgccgggagccatcgtgccgctggtcatcaccgcggcgccgttcgtggcacgcgtggtggagcagtcgctcgccgaagtggacggaagtctggtggaggccgcgcaaagcttcggtgccagcaatctgcagatcgtgttcaaagtgctgctgttcgaaagcctgccgtcgctggtgcgcggcgcagcactgacgttcatcaccctgttcggcttctccgccatggccggcaccgtcggcgcaggcggtttgggcgatatcgccatccgctacggctaccagcgttaccagtacgacgtgatgaccgtggccgtgattctgtgcgtcatcctcgtacagatcgtgcagaccatcggcgacgtggcgtccgaccacatcgaccatcacgagcgctaaaccgacgctttcatgctcctatatgcaagaatcgggtctgaataattgtgttcggatccgattcttgtatgcgaaaacactgctacgtggtgcgcttacttgttgagttcagcaactcaatctatgatataacctgtttttgctccgcatttccccgactcgatgggagatgatgggattcacggcaagggcactctaccatgcaccgaaattcaagtcagaaaccaatcagtatccggctttaatggcggtgatggtcagctcgccacggttcgtgtacccgagcgccgtgaaaaactcggatatgcaggggcgcacagtggtctcgctcggtccgagccgtttggcgatatcttgtttagtggcgcctagacaagaaggaacaatcccactgccatgtcaggtatggtaatctcaaaacaccgtataacctcgaaccatccagaacatcgataaactacttcaaagacaaaagaggcgcggcacgattgcaggggcattgatgacaggaacattaccaaaacagcataaagcggcgcgcattatcgagcatatcgtccttgtactcgcactggtctgggccggcggctgtaccctcatatggacgcaaatagacatgccccacagcatcgtgaacacgacatcctctgacggcacctgcgaagtggccatcggcgaactaggctcgcccatgttcttcggcccaagcaccatcacgatcaaagtctcctgggacaccgattccaacgtcatcggagccgagaacgtcacagaaatcaagacggacctgcacaacgacggcaaatcattggactcggacaacttcaccgtaacctggcacggcaacatcccgaccgtcaccacccacggcgaggaacaatcggaccagagctacacgtttaactggaaataaccaccccggacatcacgtctctccgagaatagtcctcacgaccgagcaggcctcacaggggcataagcatgaaaatcatgactatagctatcatgcgcacctctgacgataatcgcgtgtggtcgtttttggctttgttccaaggttttcattttttgggaaacctgactatctccctcgttttccacgaggcacctccagacacccgaaaataatccgggaacgttccaccaccctgccggcgctcagcgtcttcgccgaccggcacggaaaagtgcaataccccctgtggtttcatgatgttccgcctgggtggtgcccagaagcattcgcccggcagcacgtctccatggcggacaatagacagaacgatacgcggcccatacaaccgtcccagccgccaatgacatcccaaatccatcccgaatcccacaggcctattgcagacagcccagatcagctggctcatagtccaaagccgcctgcgacgccaccgtcccaatggcaggaacggtcagctgcgcagtatgatttccgccctgtcggccagttcccgttcgcgcacgcccatagcagacaggatcgcttgtctccgcgatggcatggcggaggtcgcccgtgcgaccaatgcggagaagcgaccgaacaattccaagtaatcgtccttgtcaagcaaatagccaagatcaccgatggcctggtacacgttctcgttagcgcgcccatcgtacagggcacaatagcagcgctcgtcatgcgcgcacaggttgcggtagaacaccagtctgttgaagatgctgtccaaccgcttgatggtgatgcgccgcggcccgtcgtgcgtgtccgcatacaaaccggtgaaactttcggcgaccgccaatcggacggccggggactggacttggaagaaccataccgtctggccgaaagaaagatcgttggccagcacccacaacgggacctggccgttgtggtcttccatgcaatggcggatatacgccttgccgccatagtcgcccctgttacgcgggttgccgtccaactcaagtatccgcttgaagaccttgtcgatcaacgccacggcgctcggacggcgcctggaatcataatagtcgggattgagatacgggttgacctcgtcggggtgcagcctggtgaactcatgcgcgcatactgccttgagcgcggcctccgcccgtgtgatggcggaaaacaacagttcacgcaactcacggtcgaacaggaacagggcgtacagatcatcgaaacgcgcgcccgtcccgtaccggtcatcaccagcggtcaggcatgcctttcagtcgaggaacaaatccttgtagccattgacgatcggataatagccctcgcgcctgagcacatgaccagcaccggcatcgacagccatgccacgggagcgcaaaatgcgcagctgttcgtccacactcctgtagggcttgcgcaacgacatgaattcgacctcccccaatccggcgatgaaagcactgaggccaccccgcatccacgggatggcctcagcgaaccgaacgaagtccagcttatttcgctgttacagaatagcgccgatcccccgcgaatgcaacccagccggacgtcgagtgagatgaaacctccatatcattattccaaaggcacacgccgatctatcaaggccaccaccagaaaaacccaaacgcctccaaaaagagacgacgcacgcctccacgagactgaattgcgccccgtttgttggacgttgttaattaggatacagccctagaccgcgagggacatgctccggaactcctccggggtgtgtccctcgagtcgcatctgacgccgtctggtgttccaatggatgatgtaggcgtccagttcgagtttgaactgttcgtacgagtcgaactcccggcctcggtagaactcgtccttcaagtggccgaacacctgctcggtggtggcgttgtccaggcagttgcccttgcggctcatggactggcggatgccgaggcgttcgagctcgtcccgccaccattggtgctggtaccgccatcccatgtccgagtgcaggatgggctccgcgccggcgggcaggcgctccgcgagcatggcgagcaggcgcctctgccgcccgaggtccggactgcggctcacgtcccgggcgacgatctccttgctggccatgtcgtacacgggagcgaggtacgccttggagccggcgaccttgaactcggtgacgtcggtgccgagcttggagaacggacgggccgcgtcgaagtcgcgttcgggcaggttatgcacgtgatcgcccgtctcgcccctgtacgagtcgtacctcctccacgggttcctggagcggatggcgcatctcagtcccatgcgccgcatgaccccgggcacgctcttggccgacaccttccgtccgaactcgtggaccaggcacatgtgtatctgtcggtggccgcatccgttcggcgtgcgtccccagatctcgccgaccaatggctcgagatcggcccgcgtcacacgctccggatgcgacagctgatagaagtacgtggatctggccagtcccgctatcctcaggaggtggtcgagccggtgtccccgccctgcgagcagtcggacgacggcgcttcgctcgcgccgcgtgacttggacgcccgcagggcccggagtttttccaggtacgcgaccttcgccttcagataggcgacctgttcggcgagctcctgctcgagcgtcggttcgggcttcggtttggatttcgagcctctgggcctgcccttgggcctcggcccgagcgcctccggacctccggcccggtactcgcggcaccagcgttccaggggtgtgacgctcgcgatcccgtgcatggccatgacctccgccttggtcagaccgttctcgacgtggtcgcgcgccgcggcgaccttcgtctcccccacgtataccgtatagtcaggaacgcttttatacctgttcttatcttccgtatgaaccacatacaccgttggataatgaagacgcgttctctcggacatcgataccccctttatccctatctcgcttatgtatggcagatacacctcggaaaagcgtacttagggggtatgagaacagctgtcatgacaacctgacctgccatatataagcgagatgtctcaggataaagcacggaatctaccatacgtaagcgggataaccaagcttaagcgctcgtacgacacatttttgtgcacaagacatccctccgcaagcgtcatccgaccgcctggtggcacgtttcatatgcacagagaaaacacagcccgcaaacaccacactcgaagcatgacgccagtggctttaaggtagaaccacgccgattctgcttgctgattaaggtaggcgatacgggctttctctggcattcgttgtcgacggaagcccatttggcggatcgcatgttcctccttttcgggtatggagggagtgttcgggcactggagtgagcataacgtaatcatgagagagcaggcaaaataactacggcagcttcgatcttgcgcgttccgcccctctcggtcttccctcggcgcatctctacgaagtgcttgacggtaatttcttccaaggtgaaatcagctagtggggcaagtgtttctgtatctgtgcattcttggaccatccgtgttcatgatcagtctcgggtcgaatctggtcttctccgacgccaaccctcgcaagattgtaaaacgaggctgcaccacgctcatcgcttttcttctgttgaatatcgtgcgcgatgggattcccgatgtagtcgttgcattgactggccaccccagtactctcgacacgtttggatacgatatttttgcgtccgatattctgggatttgcgggtttcgtattcctgttttttcgcacttgtcaaacattttcacattgtttcattggctacgccgctgatttcgttatgcatgttgacggttaacgatctgattccgccattgcacaatgtccattggactttacgtgcagaagcggcttgtcgcacgcgcttctaaagcctgatttcgcatgcgcacatccgcaaagtcacgcaaatactagttagcgcaacactacttggtgagatttgttcccgatgtttttcgtatagtaccttaggtcacccctttttggtatttttttctgttagatatgccacacgaggaatatcttttcggagtatacgagattagggaaaatatggtcaaccaccataaaatgattaatgctgcaatcgcaacgcttgcgacttgcgccatgttgctgccggtagtaggcagcgccaatgctaatgaatcctcgaataccgccgtacttggtgccggctatacggccaccaagatttcgcaccccaatgcagggctgggcgaagatgacggtatcgtaaacgttttgaacggtgaatccattgatgatctcacgcagggtttgcccgagcgtggtcagaactattcatgggcttcggccggctacggcgactggatgtatgtgggcacctgctattccgcaatgggttccacgctgaaatacatggctaacaccatgggcgccaagtatgccagcatcaaggccgctttggatgttgcgttcaacggcgagctgttcctcgacaatggcgagaaccacagcttgctgctcaagatcaacgtcaagaccggtgaagtgaagatcatcgtcaatgcgattggcggagagcatgcggtcaacggctatcgtgcagccgttgaattccatgacaagctgtactttgctgccgccgcaaagggtcagccgtacctgctggaagttgatccgagcagtggtgatgccactgaaatcgtgtatcgttccgctgccatgaccactggtctgaagaagggctacactgctggtatccgtggtttgaccgtggtcaacaatcagcttatcgccagcatgatcaccgataacggtgccactattgtggcttcttccaacccgtcagcaggccaggattctttcgccactatcgctacccagaccgagggcctgtacaactatccggcatgcgctgtaactgatggagtgttcggtggatgtgtgtgggatatggtcggcttcaagggcaatctctatgtcactatggtgactggaaccgcgaagaacaacaagcaatccttcgcactcgtgcgcggcacgcaagataaggaaaccggcaagtggaccttcaagccgctggtcggcgatccggcagacggcgccaagtacgagtggggtttcggagcgagtcgttccggcgcagccaacatggtggtatacaagggccacctgtacatcggcggctacaacgatccgatgaacgctttggagaaggccatgcagatggatttctccgacctgtacaaggatctggagagcccggtcaacctgtggcgtatggacgttgacgaagacggcaacgaaaacttcgaaatgctcgccggcgaagccaacaacaagtacttcggcgattccaaaggcaccatcgatggcaataccatgctgtccggcttgggcgacagcgacgagcagagccgtcacctgaaccagtatgtgtggcgtatgcagtcctacaacggcaagctgtacgtcggcaccttcgacatcagtgatcttgcatacccggcaacccagttcgccaacggcgacattctgaagcgtactccggaagagtggaagaagcagatcgaatacatcaagatcttcttcgactctctgaagaagaatgaccagaacggcacttccggcactacagacacggactctcaggaagcctccaagccttccgagtccgaatctcaggaaaccaccaagccgagcgatgatgacatcatgccgttgaacgaaggcgaagcatctgagagcgatcaagctgcacaggcagttgaagaagccggcaagaccgacgaagtggccgctgacgtggctaccatgcagcagctgctggaggacatgggcgctgatctcaactccaagcagaccgacgtggtctcccctgacggtgtcgctccgcaggccgctgaaacctacacgctcgacgatcgttaccagttcctcgcatccctgcagcggctgctcgacctgtacaacaagaacaagcagtatctgccggaattcattaccaacgagctcgacaagtggcttaccgaagagaatctggagaacttcatcgacttcgtgggcgtgctcagctacctgcattactccaacgatgagactcgtggctttgacctgatcgtctcctccgatggcacgaacttccagaccatcagccgtaacggtttcggagataacaacaaccacggtctacgcgtgttcgccgtcaccgattccggtctggcaattggcaccgcaaacccgtaccatggcactcaggtgtggctgctgaatgatggtgaaatcaagaatgctgagctgacgaatggcgatgcattcgactacgacaagtatgatagcgataagaagagcgccaacgccaacggtctgaccgttggcatcaaccccaatggcaataccgtggaagacgtgcagtacgactaccagtcactgaccgccggcacggattacaccgtggccgatgacggttccatcgtgttgagcagcgcattcctcaatggtcgcgaaaccggcagcaccggttctgtggtggtgttctacaaccagggtgcacgcgtgcgtttcactgtggccatcaaggacagcactccgaacgcaccgaagaaggatgatgacaagcagaatacgaagcctgccgcacacaagaaggcaaacactgccaacaccggttccaacgtaatcggcgttgttgtggtggtcgctgttctggttgtcgcagcaggggcattgttcgtgttcaagcgcaagcgttcctgaattgccagagcctgttcttaggactcattcctaagttcgtccgcatataacaatcccgtatgatccggttcgccggaatcatgcgggattttttattttgcaggaatcacccatctcacgtcatgtcaaactgccatcacaagctgatttcaatgtgcgatatgcaaccatgtggaagttccgatacgggacccattgaaaatggcacgcaatcctacaaataacagattcaccgcaagccacagcaatgccatacgcagcgcggaagacgcctgcatcgcatcgcatatccaaccaatcgcagcaagacagggtacatatattgcagctgtcgccgtacacgtcaatgcaagataacggtaatcccctgccccaatcagaatgccatcaacagcccacatccaaccagccaacggcaatgtcacgccaacaaccaccataccgacagtgagcaaatgctggatctcaatcgactgagaaaacagcggggacgcacaccatccggcaatcatcaaaccaataccgattaccgttcctccgcataatcctgccctgccagcgattctcgtcaaacgcatggctccatcctcttgacgggcaccaatctgcgcggcaaccaacgtctgaccggcaataccaatggcatcaagcatgttcaacacgaaattccaactggaattcaccacctgatacgcagccaacacttccacgcccatatgcgtagccagcaccacattcgccaccaggcatgcacgcaacgcaagcgtgcgcaagaacaacaccgcaccatcgccagcactgttcaacactcctgacaaacgcggccgtaaacgggtaccttccgcacgagtccacaacacagcaggaacaataagcactaccgccataaaccattgcgaaatcagcgtggccactccagacccaaacacaccccaaccgaatccgagaataaacagcagatccagcaacgtattgagtatcgcacccagcgtagcagctaccaacgtgatgcgaaccttctgcagtccgcggaaaataccgttggccgcatacaccagcaacatgccgggaataccgaacaccacggcacgcacgtagtcaaccgcgttatgcagcacactcccttgggctcccatggccatgcacaacgggcgtgcaataacgaacagcgccacagataccaccacgccaatgattccagccagccacagaccatcaacgcctgcttccaagccttctcttcgtttgccagcgcccaaaagacgccccacctgcgatgtggtgctatacgcaaggaacacacatagccccactacagtgagcacaatggttgacccgaccgacagaccggcgagcgcctgcccgccaatatgtccgacgatggcggtgtcgatgagcacgaatgctggttcggcgataagttgcccgaacgttggtatggccagtgtgagaatggtgctgatggtggtgtatgatgcgttgtttgcggtatctgtttcgtgagtattctgcgaagttgatgtggtcataatcgtaagcgtctggcgtgttggggactacatgtgcagtgtaaggtcacgtgtttcgctgttgttgttgattgctcagattatgactatgtctgttttgcgctgttgagaatgtcattgaaggttttcgctgattgtctgcatgaaggtagaggggcatataattcccgaaccgctcgtgacgcatagtccaagctcctgcgagacccattcgatcccgtccaggatcacgaacacgaacacgaacaccaacgcgaacggccacatgaacttccaaccacgccaatccgccttgtgtttattgacacgcacggttgccgaatgcagtggcatattggcaacaacttccgttgctgacatcattcctctccttcgaggcaataccatttcacagggcaatttacacccccgtaaaacagctccttccaaatgtttgcgttatcataataacaccatattccaaaagtgtctacttttcgcacattctagaccacatattcacttcatcgaacaaattgcatggtgacgaaaacaatacagaagtaagcatgtaaaattaagcacagtacgcattttcgttcggaaggtagatacacatggcacgcaactcagtctcgctgcaagacgtcgccagggaagcaggggtttcaccgcagaccgtttcccgagtggctaatgggagcgatgccgtacgcccagcgacgaaacttaaggtcgaggcagccatggagcatctcggatacaggccgaattatgcggcacgtgctttgaaaagcggacatttcaacaatgttggtgtactgctttcgcatatgtcggcctacgggaactcacgtatcctcgaaggcatcactacagcggccgcgaatagcggctattccatcaccattcgccccttggataacctgcaggatcagtcactcgccggcgcactgaaacttgtggaaggcctccccctcgatggtgcaatcgtgattatggaacgcgatttcaccgacttcaaccagttcaagccatccgacaacctacctgtagtgcttatttgcgaggaaccggcaaaccactgccccaccatcgattcggactcgtatggttgcgccactgcagccgtggactttttcctgtcgaaggggcataaaactgtgtaccacatcgcaggccccaccgtttcacgcgcagcacagagccgcatcagagggtggcgcgacgcattagcgcaagtcggcattcccacaccacccatgtattacggcgactgggaagcagatagcggctaccaagccggattggccttggctcacgaaaaggattgcaccgcaattttcgcaggcaacgatcaaatggcatacggtgccatgcttggcctgaggacagcaggaaagcgcgttcccgaagatgtcagcatcatcggtgtggacgattcactccgcggcgttgtgccccgtcttgaactgaccaccatacggctcaagctcagaactgtgggaaaagaggctttttccatgatcgagcaacaatgcaatggcaaaaaagtgccttctggaatcaagaaacttatcacccccgaattcatcgaccgcggatccgtggcggaactcgactaatcgcaatatctcgcgactttaatcaacgcaatcaatcaaatcagccaatacgaaaagcgtctctccagcgtgggtgaaccacgtgggagagacgccttctagattgaacgaaaagctgaaatcgggtgaaatcaggcttcgatgccgagctgctgacgttccttcttggaatacatgaacgccggaagctgacggccctgcttgagccaagcatgatattcggcggttgccgcaaactccacgtcggaagcggaattcagacaggtctccacggaatcctggatgacgccgatgatgaagccaacgcccaccacctgcatggcgatgtcattgctgatgccgaacagcgagcaggccattggaataagcagcagcgagccaccggccacaccggaagcgccgcatgcgccgagcgccgacaccacagacagcagaatggcggccggcaacgaaatctgaatgcccatcgtattggcggcggccatggccatgatggtgatggtgatggcggcaccgttcatgttgatggttgcgcccaacggaatggacacggaatacatgtctttatcaagaccaagcttctcgcacagctgcatgttgaccggaatgttcgcagcagaagaacgcgtgaagaatgcggtcaggccggattccttgaagcagcggtacaccagcggatacgggttgcgatgcaggtacaggaaaatgaccagcgggccgaacacgagcaccatcagcagcatggtgccgacgagcaggagcaggaggctaccgtactcggtgaaggccgccaagccgttttcggaaacgctggtgaacaccaagcccataatgccaaacggggcgagattgatgacccaacgaatcacctgagacacgccatcggccacattggcaaggaacgacttggagctttcattggcaatgcccttcatggcaagaccgaacaggcaagcccacatcagaatgcagatgtagttgccgtcgatcatggcctgaatcggattggccacgatattggtcagcaacgtctgcacaacctcgctcaagccctgcggcaccacatcggcgtcagcggcatcgcccaacgatatggtctgcgggaacatgcgagacgtcagcaccgccacgacggcggacaggaacgtggtgaacagatacaggaaaagcaccgtgccgaaacggccgtcaagcttggaattgccctgggccaaagcgcttgccaccagcacaaacaccagaatcggagcgacggccttcaatgcgcttacgaacagggtgccgaattcgccgatccacgtcatatgcggaacgaccaatgccagtgcggtacccgcgataagaccgacgataatgcggataatcagtgacacgccgttatatttgtcggcaacgccacgaagcgcttttgaaatatggttcatattctctctcgttctttccagccggcttgcctttgccagccagcacaacaagagcacatcctaatcacgctcgataacacgaaatgtaaaatgtccgattatagggacgcgcaacttcaacacgccatagcgatgcgagcaaatatcagtacagcgatggacagtttttatatatcttgattcagcgagcaatacctgctgatcagaccgttaatcagccaagcggcactttcgaaacgaatgtacgaggctctcccgtcaccggatcgtcgaagcgtaactcacgagccaccaattccaacggctgcgagaaatcatcgtaagaacgctgcacaatattcgggtagaaatcatcgcccaaaatcggcaatcccaacgaattcatatgcacacgcaactggtgcgttttgccggttttcgggtgcagcacgtaattcacatatgctttgccgtcgatgcaacgtaccgtgctcccccgctcaatcaacgtttgcgcattgatggtttccggaatttcgtacgcctgaagtcgcccgcgatccttgcaaatatgcgatgctcggattgccggaaagggttgatgcctgtcgattcttacgattgttccgtactgcggatgctgttcgggggcaagcggcgccaaacattcataggttttgatggttttgcgattctggaacagcatttggtaagcgccgcgcaattccggtttgcgcacaaatacgatgatgcctgcggtaagtcggtccaaacggtgcgcgggaacaatatcaggttcgccatactgttcccgaagtcgaatcaacgcggtttcgcgataccacatgccgcgcggtgtggtggcgagaaaatgcggtttgtcaaccacgataatcgcatcgttctcgtaaagaacctcacattcgaccggaatgcgaggttcttcaagaacgtaacgatgcctcttctgctgacgctgttgacgcatcgtatgaacgattactccacggtgacggacttggcgagattacgaggcttgtcaacgtcgtaattcttcagcttggccatgtccatggcgaatagctgcagcggcaccacgtccaccagcgggctcatcagcgtcgggcaggccggacgccagaacaccacatccgcatagcgttcaacatcggggtcgttctcttcggccacggcgataatgtacgcgccacgggccttgacctcttcgataccggaaataaccttggcgtgcagcacattgcggccacgtgccggcggcacgatgaacactaccggttcgccttcgtccaccaatgcgatcggaccgtgcttgagctcgccggccgcgaaaccttcggtgaaggtgtaggcgatttccttcaatttcaacgcgccttccatcgcgaccgggtagccgacatgacggcccaggaacaggaaggacttcgcatcgaccatctgcgcggcagcatcatgcacggtcttggtctgcgtatcaagaacccactggatcttgcgaggcatgtctttgagggaatccaacgcctgcgcgatctcgtcgcggaacatcgcgcccttgacctgcgccaaatacaagccaagcacgtaggcggcagtaatctgcgccacgaacgccttggtggaggcgaccgccacttccggaccagcgtgcgtgtacagcaccgcgtcggattcacgcggaatggacgcgccctgcgtgttgcagatggccagcaccttcgaaccctgctcacgcgcgtgacgcaatgccatcagcgtgtccatggtttcaccggactgcgaaatggccaccaccaacgtgcgcggggtgagaatcggatcacgataacggaattcgtgggcaagctccacttccaccggaatacgcacccaatgctcgatggcgtatttggccaccatgcccgcgtaggcggcggtaccgcaggcgatgacgataatcttgtcgatcgccttgaaatcatgctcgtcgatgcgaacctcgtcaagattgagattgccgtccttgccaagacgtcccaacagcgtgcgctgcaccgccgccggcccttcgtggatctccttgtccatgaaggagtcccaaccgcccttttcggccgcggaagcatcccaatccacggtataggtcttcggatcggccacgatgttgcccatgaaatcagacaccacaaccttatcggcggacaccatcacggcctgatcctggtcgatttccatggcacgcttcgtgtaggcgacgaacgcggccacatcggaaccgagaaaattctcaccttcgccaagaccaaccaccagcggcgaatcatggcgagcaccgaccacgatacccggctgacggcagtcggtggcgagaatcgtgaacgcgccttccagcatgcgcgccaagcgccgcacggccttgaacagatcaggcttgccggtttcctcaacgattttctcgctgattttgcctagcagtttcgccgcgacctccgtatcggtttccgatgagaaacggtaaccttccgtctgcagatcaagacgcagctgagaggcgttttcgatgatgccattatgaatgatggcgaccttgccgtcacgcgaagtatgcggatgcgcgttgatgtcattcggcacgccgttggtggcccaacgggtgtggccgatgcccacggtggccatcggcattggattgcgttccacgtcttcgattagattggcgagacgccccgccttcttacgcacttccacatgatccatgccgggcgcggtcagcgccacaccggccgaatcatatccacggtattccaaacgctggaggccttggaggcacacttccaacggcttgccgcacgcggtttccacatttcctgcatatcctacgattccacacataacacctcagcttatcgggtaatggtgtcattttcgaaacgaaaccgtctcatcgcgctgaacctttgatatatgaacacaaaaatccccatgctgacagttttcaacatggggattttctcagccattcccttgatcgcaatccttacgacgaagaggtgtctgattcttacgattatgcttgcggcgatttacagcacgtgctgcaggaagtccttgaatcgtggttcctgcggattgtcgatgatttcaggaccgccctgttccacaacaacaccgccgtccatgaatacgatctgatcggcgacttcgcgcgcgaagcctatttcgtgggtgacaaccaccatggtcatgccttctttcgccaaagacagcatgacgttcagcacttcgcccaccaattccggatcgagtgcggaagtcggctcgtcgaacagcatgatttccggcttcatggcaagcgcacgggcgatggccacgcgctgctgctggccaccggaaagctgtgccggatagtgatcgaggcgatcgcccatgcccacgcgattcagctcttcgatggcaagcttgcgggcttcctttttatccatgtgcttgacgtggactggcgcttccatcacattttcgagcgccgtcatgtgcgggaacaggttgaacctctggaataccatgcccagtttggaacgctgctcggccacttccttgtcgttcagggtctgcagcacctgcttgccgtccttgtcgacgtacttgtagccgatcatttcgccgtcgacgtcgatttcgccgccggtcagcgtttccaactggttgatcaaacgcaggaacgtggattttccggaaccggaaggtcccagaatcaccgtcaccgagccgggcataaccgtcatatcgacgcccttgagcacgtgcaggctaccgaaagccttatgcacctgtgtggccttcactgcgggaacaacaccgttggtggttggttcagtcattgctcactcccctcacgcggtcatgcccgcgaacgttgcctcgttctgcttggcgatatcgtctttcggttcgccttcggttttgcccggcagcggcggctgcttgccgcgcgcgccggccggtcgcgcatcgaagcccttgccgaaatgcttctccaggcgagattgcagcaccatcagaatggaggtgatcaccaagtaccagatgcaggccacgatcagcagcggaatcggcttgtacagtcgggttgcgattgcggtggtggcgaactgcagttccagcgtgaacggcacggcgttgaccagcgaagtggtcttcaacatgccgatgaactcgttgccggtcggcggaatgatgatgcgcatggcctgaggaagcaccacacgacgcatgatcatggaacgcttcatgcccagtgccttggccgcttcggtctggcccggatcgacggcttcaagacccgcacgcacgatttcagccagatatgccgcttcgttcaatgcgagacccagccatgccgcgttaaacgcggtaatgacggactgcgagtcaatgctccagaattcgatggaagtgaacggaatacccacgccgatgcgaggcaccaacacggcgaacagaccccagaacaccagctgcgtatacacaggggtgccacggaagaaccaaatgtagaaccagctcacgccacgcagcaccggattgatggacttgcgcattacggccagaatcactgccagaataatggcgatgcccatggagatgaccgtcagcagcagcgtgtatttgatgccttcgagcacattctcgttgaacaggtacttccagaccacattccattcgaaacgcggattggtaagcaggccctgcagcagcatggcggcgagcagagcgacgatgaccgccgccacaatcgggcccgtacgcttaaccggcagcgccttgatgcgattcggaatatcgaggccgtcgccgtcgatttgtttcttcgccatgatgcttcagttccttcgttgttgatgtaaatagtggggatgaaatcagtcgagatcggtcgggttgatctcagccttgtcgagagcgccggattccacaccccaatgcttgaggatcttcatatacgtaccatcgtccatcagcttctgtacggccttctgcacggcttcagcaagctgggtgttgcccttcttgacagcgatgccctgcttggccacaccttcgacgtcacccaaggcttcaagctgtccgtcggtctgggagatggcatagccggcgaccggagaatcggcatagaacgcatcggccttgcccgtagccactgcggtggccgcttcggcctgacgcttgtacgacatcacttcggccttgttatcggcctcgcatcctttggcgatggtgttggcttcctcttcctgcacggtgccggtctgcaccgcgatcttcgcgccgcacatgtcggaagtgtcaagcttcttcggattgcccttcttcacggcccacgtggaacctgcacggtagtagctcacgaaatccacggactgcatacgctcttcagtgatggtcatggcggtgatgcccagatcatacttggagccaatggaaggaatgatggtgtcgaacatggaagacacgatgtttggcttcaaaccaagcgtcttggcgatggccttggtcatgtcgatatcatagccgaccggagtcttgccgtcttcggcatagaattcagccggagcgtacgaaagctccataccggcggaaagctcgccgtccttcaccagatcgccggacggaaccagcttggccagctcgtcatcttttttaatggtgctgacatcgtaaccggtggtagtgttcgacgaatccgacgaatcgccggaattggacgcatcagaggtgccgcaagcggcagtggaaaacaacatcgccgcactcagcgcaagcgccacaacggacttgatcttcaaagacatggtacgcatatccttcttcttatctcttcattgccataccgaaaatctcaacgccattcggttgcagagaacctcagtatctcaaataggcacgataagagcgcaatgctacatgtacgttacattgcgcataccttacgtatcagccaagaatcgcgcaatgtagctccgtcgaatcacggaagatccatatacgaaaacggaagacacgcggatttgacccgcatgccttccgtcatatcggcgtcacagtatcgccgtgtgcgatgtctgccttacgtttgatcgttcagccgaggtcagtcggattgatttcggctttgtcgatcgctccgttctccacgccccaatgcttgaggatcttcatatacgtgccatcatccatgagcttctgcagtgcggcctgcaccgccttggcggtatcggaatcgccctttttgattgccacggcctccttggtcacgccgacatcctcgccgagggcttctagcgtatcttcggtttgcgcgatggcatagccggcgaccggcgaatcagcatagaatacgtcggccttgcccgtcgccacgttcgtggtcacatcggtctgcagcttattcgacagaatctgcacttcggacttgccgtcggccttgcattgtttggcggccgcgttgacttcctcttcctgcgtggtgcccgtctgcaccgcgatcttcaagccgcacaggtcggaagcggcgaccttgttcggattgcccttcttcaccacccacgtggaaccggccttgaacatgctcacgaaatcgacggcttccatacgctcgggcgtgatggtgaacgacgaaatgccgatatcgtacttggtgccgatcgacggaatgatcgaatcgaaattcgacgtttgcggcacgacctcaagaccgaacatattggcgagcgccttcgcgatatcaacatcgaagccgaccggggtcttgccatcctccgcaaggaattcggcgggagcgtacgacgtgtccatgccgacggtgagcttgccgtccttggtgactgattccggcagcatcgcggctatatcgtcatccttcgtcacgccggaaacgtcataaccggtggtgttcgacgacgactcagaatcactggaagccgcggaatcggacttttccgatgtgccgcacgcacccaacgaaacgatcatggcggcgcttagtgcaaaaacagcgagtttcctcagattattgaaagccatcgcggatcctctcttcattcccaaccgtatgaatacggccgaaccgaagtcctgcaggcaccatagaaaacgattgctacggccacgttaatagtacgcaaactctattcgatatgccgtttttccttacgaaaaagcgggttttgccatatcacaatatgatcaaaacccgctttgttcccagcacgtcgccagtcatgcgatcattgaaccgtctgatccgtggacggttcaatcatggaattattcggcgcccggcgtattgatttccgacgtttcgatggcaccgtcctcgacaccccaatacttaaggatcttcagatacgtaccgtcgtcgatgagcttctgcacggccttctgtacggcctcatccatctggctgtcgccttttttgatgacgatgccttccggagcgacgccttcgaccttgcccagcatttccagctgtccatcggtttgcgcgatggcatagcccgcaaccggcgaatcggcatagaacacgtcggccttgccggtgacaacgttcgtggtcacatcggtctgcagcttgctggagatcacttcaagcttatccttgccgtcggcctcgcattgcttggctatcttgttcgcttcggtctcctgcatggtggcggtctgcacggccaccttcttgccgcacagatcggacgtgtcgatcttgttcggattgcccttcttcacggcccatgccgatccggcatcaaaatggcttacgaaatcaaccgcttccaaacgttccttggtcacggtgaacgacgaaatgccgatatcgtacttggatccgaccgatggaatgatcgaatcgaaattcgcggtttccggatccgcttcaaggccgaacacctgcgccaaagccttggcgatatcgacatcgaagccaaccggggtcttgccgtcctccgcaaggaattcggcgggagcgtacgacgtgtccatgccgatggtgagcttgccgtccttcgtcacataatcgggcaacagtttggcgatgtcatcgtctttctgcaccgacgaaacgtcataacccgtcagttcgctcgctttcgaaccgctatcggacgaagccgcatcgtcgcttccatcactggtgccgcatgccgctccagcaaacagcatcgcaacgctcagcgcacacgcggcaaccgccttcagacttttcttcgcttccatatccttctcctatgtctcgctcggtctattcgaccgaatctgaaccatacactagagagggcaagctacaaaaagattacggccaccgctgtatatcagtatgtgaaaccggaaattttccggttaccacttatcgcacctgcttgttggcatatcgcatggcacgcaaggcctcacgcttgtcttgctcctcgcgcaatgcctgacgcttgtcgaattccttcttgcctcgtgccaatgcgatttccgccttgactcgaccgtctttgaaatacaggctcagcggaatgatggtgaaacccttggcttggctttgacgagccagcttgtcgatctgcgccgcgtgaagcaacagcttacgcttgcgcttaggggcatgattgttccacgttccgttgagatattcgggaatattggctccctcaagccacatttcaccgcgacggtcgatggtaatgaacgattcggccagcgatgcgcggccttctcgaagcgacttcacctcagtgccggtcaacaccagaccggcttcatacttgtcttcaatggcatagtcgtggcgtgccttcttgttttgcgcaatcggcttcacgccttgctccttagccatgtcggacctcctttccggttcttcaaagaagtgttctgcaacgcaacaatcgacaatatcatgggagcgcgccgcccaacgattcaggcggcgcgctcccgcgacacaacgctcaaggaaagctcaaacgctccttgatgaatcagtgcacataccagaactgggacgcgttgtacagtgtgcggtacgacaccacatatgggccaccagccacgttcatttcggaaatggtgatggtgttgccattcaccgcttccaccacacccacatgaccgtagaagccatcggcaccagcctgaccgggcaggaaggagattgccgcaccgacctgcgggctatgatccacgcgaagaccatacgacggtgcggtagcgtaccactggccaccgttacccaagtacgagggggttccgatacccatctgtctacgacgttcgtacgcccaccacgtgcactggccggccacgtagccattgccgtaatcgccattggaggttccctgaccggaattgttattggtactcggcgcgggagcaggcgtaggagtaggcgtaggcgtgggagcaggcgtaggcgtgggagcaggcgtcacattgttgccgccactattggtattgttgttgcctggccgggtctgcccttgattgccaccattgttttgattagctgctgcggcctgctcggctgcatactggcggttgaaggaatcgacctgtgactgcaacataaccgtttgcgccgcctgtttggccacgctgccattcagctgcgactgttggctttccaattcggcacggcgggtttcgccttctgcacgcaactggtcaagcgagtcgcgctgggtctgtgcggaagcagcagcctgctgtgcggaagcggctttttcgtcagctgcggttttcagattggcgatctgcttctcgattgcagaaagacgctcgctgcggttcatcgacgtgttcaacgtattcgccgcatcacttgccgcattggcttcggtacggctcaacgcatcacgagactgcatggaattaatgaattcctgagtgctcgtggaacctgtcaccacgctcatcacagtggatgcatcggaaccatgcaggtcttcacgagccatctgtgccacggccgcatgcgcgtcatcataatccttgccggtctgttcgatctgcgcttcgaggttttccttatctttttgcgcggcctccaaacgggaagccgcagcatcagcttcactctgtgccgaagcggcagtagcatttgcctcatcgactgcagcttgagctgcaggaattttcgtatttgtcaattcatccagctcgacgatcttgtcggccaaatcagacttcacaccggaaagctgtgaacgcaactgggcttcacgctgagagctggcagccttcttattctgggcattcaccagattgctgtatgtattggcttgcgcctgcggaaccgcagacgagaacggggcaatcgccatcgtggcgcacaaagcccccgttgcaaacaccgcgacggccggttttagagctttcttgcttgtcattcggtcacttgcctcccatcattggttccataccatagcatcccatgcttaaaacgcgacacagataaacgtatccaatccgtacaaaacggaatgttctcaggctttcaaatatctatgcaacgacactgtggatgcaatcaccgacaacagcaccgctcctgcaaccaaaatcggcgaaatccacaataccgtcatctgattcacatatggaatccatttcacggaggctgcaagccaatcagtgataaataccttcaccaatgccgataaagtgacgcaggaaagcaaggagccgaccattgatgcgatcgccccttcaagaatgaatggcagccgaatggtccaattcgaagcacccaccaaacgcatgatctccgtttcggttcgacgtgacgcagcagacatgcgaattgtggtaccggtcagcataatggcgacgaccaccatcaccgcggccaatgcggcggttgcaatggtcgcacgattcagcactgcgaacaccggctcaaaaatctgccgttgatcactgacagtatcgacgccctccttgccagaaagcacttcggaaacgacttgatatttctcaggattcttcagtttcagccacaatgaatcctgcatatcgtcggcagtgagcgtacgcccctgatattcaccgttcggatattgtttgaggaaagtgtcgttgtagaaatcttccttgcttacaaaagtgatttgcgatacatcatcggcaagctcgttgcgaatggttttctgcaagtcattgatctgagtctgcgttgccgcggttcccgcggtgcagttcacggattggctggtgccatcgggacacatccacaccaccacttcaaccttggaataccaatcgcctttggctttggtgatctgcgcctgagtgagcaccgatgcgccgataaacagaaacgagatgaatgtaacgagcatcactgaaagcaacatgggcacgttgcgcttgaggctgctccaggtttcggaaagaatgaaacgcaaacgcatcagtcgttctccttgctttcggacgtttcatgctgttcatcggattgttcgacggatttcgcctcgccaccggcagtcgcggcgggcgctgccggaggagccggaggcgcgggcggagcgggaggcatcggcagtgccggaggagcgggaaccgttggctccgcggattgctcgttttcagccgctttgcttgattccatgcctgtatcaggcgaagagccagtcgcgtcggcattggcttcggtctgcgaacgtgcagccgaatcggcatgctcctgttcggcaagatcctcaagtttcagtcccttgccccaggtcagcgtagtctccaccggagcgaacgcctcgccataacgaccggtgcgaccggaatgcacggaattggcgagacgcgcgatgcccgcatcaccattgccgctgtggatggccgcagctacggcatcaaccgcgttcgccgcggtttcggctcgcgtcgcgccttctacgtccaccgcctcatcggaaaaatcagacatttcaagcgcgcccggcgcacgatatttcgagtcgacgtcgccgccgttcaacgcctgatgcgatttggattcgacttcggcatccgggaagtacagtgcggaatcgtaggatccctgctgctcgtcacgcacgattttgccggtatgcagttcgaccacacgcttgcgcatggagttgacgatttcctcgttatgcgttgccatgacgatggtggtgccagtgcggttgatggcgtccagcacttccatgatgcccagcgatgtggtcggatcgagatttccagtaggctcgtcggccagcagaatctgcggatggttcacatacgctcgcgcaatggccacacgctgtgcctcaccgccggaaagctcgtgcggatagttgttttccttaccggtgagaccgacagtctgcagcactttcggcactaacgatttgacggtggaacggcttgtgccaatcacttcaagcgcgaacgccacattctcccataccgttttgttgttgaggagtttgtaatcctggaagataaaaccgatggaacgacggtaatgcggcacctgccttgacgacaggcgcctcaaatcattacctgcgacgcgaatctcgccatccgtgacctcctcctcgcgcagcaacaggctcagcaatgtggttttgccggaacctgaagcgcccacgaggaacacgaaatcccctcgatcaatgtcgagattgatgtcatccaaggcaggcctggtgcctttcggatacaccttgctcacatgttcaagcgaaatcagcgccatcgtcgtacccctccactatgtgctgttctgattacggtaatcgtggtttttaggcgtccgcctcttcggccgccgcgcgacgctgctcatgacgccaacggatgccggcctcaatgaacgcgtcgatatcgccgtcgaacacggcctgggtctgcgaagtctcatagccggtgcgcagatccttgaccatctggtacggatgcagcacgtaggaacgcatctggtcaccccagctggccttgatatcgccggcgagctccttcttcttcttggcttcctcttcgtggcgcagcaccaacagtcgggactgcagcacggccatggcagcggcacggttctggatctgcgagcgctcgtcctgcatggtcaccacgatgccggtcggaatgtgggtgatacgcaccgcggaatacgtggtgttcacgccctgaccgccagggccggaggagcagtaggtgtcaacgcggatttcggaatcgggcacgtcgatgtgatcggtcgcctcaacgagcggcaccacttccactgccgcgaagctggtttggcgacggccttggttgtcgaacggggagatacgcaccaaacggtgggtgccgccttccacgctcatgcgaccatacgcataaggggcatccacctggaaggtggcggacttgatgcccgcctcttcggcgtaggaggtgtccatgaccttggccttatacccattgcgctccgcccaacgcaggtacatgcgcagcagcatctgagcgaagtcggcggcatccacaccgcccgcgccggagcggatggtcaccactgcggaacgttcgtcatattcgccgtcgagcagggtctggatttccatgtcggccagatcgttctgaatgctttcgacttcggactgcgcttccgccaacgtgtcggcgtcttcttcctcctgacccaattccaccaacgtttcgacgtcgtcgatgcgctggcttgcggaagcgagacgcttcagctgggactgcactgccgacagtttgctggtcactttctgcgcgttttcgggattgtcccacaatcccggttcggccgcctgaacttcaagatctttggcctgcgcggtcagtcggtcgacgtcaagcgccttggaaatcgactcgtatttggcgcgcgcctcgccgattgcctgggaaaaatcaaattctgccatcgtttacaccatacatttctttatgcgttctttatattctgtcatggagcctcatacggctttcgcacaatcctcaacttcttccacgtacccacatactcgttcccatcctgccgagccgcgaaccagtctcgttacgtatgggattgcaggtccggggaggatcataccggaccaaaggcgtcaaagacctgcgtagatagcaggaataaccagactcagcagcatcgccgcagcgatgacgatgcacaccgcccgcaccatggtgcggcgacggcgttctcgctgctcgcgttcgcttctgtagtcactcatggggtactagtataggcaaggccttctacttattatctttcggcgatctcaccatattttgccgcatcgcaatcctgccatatcatattcgcggaacctgtgtacgcattacgcgacattgattgcatgtcatttatgatacggttcgccggcattgattttgtatgcacgatacagctgttcaagcaaaataacgcgcattaattgatgaggaaaagtcattttggaaaaactcagcaggtagtcggcccgtttcacaatcgttgggtcaagtccgagcgatccgccgatgatgagttggatatggctggtgccatgcactccaagaccgtcgattttctgcgcaagttcttcactggtcagctgctggccttcgatggcgagcgcgatgacgaacgcatcgtcgcgaatatgcttggcgatgcgttcgccttccttggctttgattcgccgttccactccctcactggcatgctcgggtgttttctcgtcggccacttcgacgatgtcaagcttgcagtatcggctgagtcgtttcgaatattcggcgatggcgtcgcgcagatattgttccttgactttgccgacggtaatgagggagattttcatatttgatatttagttcttgtgcagtttttcgttcaattcgatgccggtcttgcgatagcgcgcttcgatacggccggacacggaattacggatgaacaggatgttgtctttgccggaaagatcggcgcccttgacggtttcgagcggttcgcccgccgcgaccttggccttgtcgtagatggtcaccttggtgccggcggtcacatacagaccggcttcaaccacgcagttgtcgccgagggagatgccgatgcccgcgttcgcgccaagcagggagtgctcgccgatggagttcttaagcttgccgccaccggacagggtgcccatgatggatgcgccgccgccgatatcggaaccgttgccgaccacaacaccctgggaaacacggccttccaccatggaaacgccgagcgtgccggcgttgaagttcacgaagccggcatgcatgacggtggtgccttcggaaaggtgggcacccaaacgcacgcggtcggcgtcgccgatacgcacgccggtcggcaccacatagtcgaccatgcgcgggaacttgtcgatcgacagcacgttcacgtcagccttcggcagtcccggaacgcactggttggccgcggccatcacgtcaagcttgcgcagcgcgaaatcctcgaccgcgaacgggccataattggtccataccacattgttgagggctgcgaaaatgccgtccagattcagggtgttcggcttggcgagacgcatgctcagcagatgcagacgcaggtatgcgtcggctgcgtcttcgatcggttcgtcaagcttcgacaccgtgaacaccggaatgcggcgcacgccacgcgcatcgacgccctcatgggcgagattgccaaaattatggttcgggcgtgccacctcctccggagcctcgccaagcttcagttccgggtaccatacgtccaaagtgttgccggccgcatccacgctggacagaccccaaccccacgcagtgcgctgatcggtcattcttcgctccttcacaacagtgattgcattacttgcatgtttccgtgcaatactttagccgcagggcttggcgaacagcatcacaagtccatgaaacagcgaaaaagcaactatcgacggtcgatcggagtgtaatcacgttcggtataaccggtgtacacctgacgcggacgaccgatcttggtgttcggatcggcaagcatctcacgatactgcgcgatccaaccgggaatacgccccaatgcaaacaatgtggtgaacatggacggatcgaacccgatcgcgcgatagatcaatcctgtgtagaagtcgacattcggatacaggtgacgcgacacgaaatactcgtcgttcagcgcgattttctccaattccgtggcgacgtcgaacagcgcacgctcgtcggcaggcaatttcaacgtgtccgcgcgttccatgatcttctgcagatacttcttggcgatcgcggcacgcggatcgtacgacttgtacacgcggtggccgagtccggaaatacgctgaccgctggttttggcgtcttccacgaattccttgacggttttgcctgaatcgcgaatggctttgagctgacggagcaccgcttcattcgcgccaccatgcaatgggcccgacagcgcgttgatgcccgccgcaaccgcggaatacaggttggcgtgggcggaaccggcgatacgtaccacggaagtggagcagttctgctcatgatcggcatgaatgatcagcaggcgtccgagcgcatgcacgtacagcgggtcggaatcgaacggctcgtacggcaccgcaaagcacatgcgcaggaaatcgtcgacatagccgcgcgaataatccggatacagcatcggctcatcgcggcgacggcggaaaatgtagctgacgatggttcgtgcctttgccataatgatggtcgcagcctcgtcaagctggtcggaatcattgatatcagtagtgtccggatagaaggtggcgagcgcgttgaccgcggatgccatcacgctcatcggatgcgcggtgcgtgggaaagaacccatgaaggtacggaaatcctcacccaccatcgtgcgatggttgatgtcggaaatgaaccggtcgtactgctcctgattcggcagttcgccatgacgcagcaaccaggcgatctcaaggaaatcggattgctcacacaactgctcgatcgggtatccgcggtagcgcaggatcgagttcttgccgtcgatgtacgtgattttcgattcgcattgcgcagtcgtcaggaaaccagggtcgagtgtgacccagccgtcgttgcgcagcgtggacaccacgatgccgtccgcacccgccgtggcttcaaccaccggcagggtgaagtctttggattccacactcagattggctgtggccatacttgcacgctccttaaccgttcggaagtatcgaacactatatggcatgcgcgtttccaagcatggtttcgtctcaaaatcaatcgattgacatccgatacttcattcctgcaaggcaaataattcgactatttccgcgcgaaattacgcatataaaaggccgatgcccgaataatcgtgggcatcggccttcttttcgtacgcttcgctccgtcgtattggagctttgccgcgttttacgctaccgtctgatcacttgtcgcgaacggtgaggatcaccggaccgttgtcggtgatggcgatggtgtgttcgctatgcgcgccacgggaaccgtcggagctcttcagcgtccaaccatctttcggatcctggtagatttcgtcggtggtcttgaggaaccacggttcgatggcgatgaccaggcccggacgcagcttgtagccgtggtgcgcgcggccatcgttcggcacatgcggatcgccgtgcataatacggccgacgccatggccgccgaattcaagattgatcggatagccgtattcgcgggccacatcgccgactgccgcggaaacatcacccaaacggttgcccggctgcgcagcggcaataccggccgcgagcgcctcttcggtgcacttgatcaggcgcagatcctcaggatccttatgctcgccgaccacgaagctgatggcggaatcggcaacccagccatcgacgttgatcgccagatcgaggctgaccaaatcgccgtccttcaggttgtaatcgaacggaacgccgtgcagtacggcatcgttcacggaaacgcaaatatagtgcgcgaacgggccggtgccgaaatccggagcatagtcgacatagcaggattcggcacccttgcgatcgacgatgcgcttgtgcacgaattcatcgatttccagcagattggtaccaactttggtaaattccttgagatcgcgcagaatgccgccgacaaaacggccggcaggcttcatctcttcgatctctttcggtgttttcagttcaatcatgcctctaaccctacttcgtacgccctacagtgcttggctctccctggcttttcttacgattatgcaaatctcaccttatgcatgccgttgcggaatgatgattattcgtttcagatacactgttttgtcaccaaagatggatagtgtgaagccatgagtaccactttgaattcgggtatcgatccggcatcgttctccgctgtgaccggccctgcgcaagatctgttccgctatgtcaacggcccatggatcgacatgtatcgtcttcctgatgatcgttcccgttatggttcgttcgataagctcgctgaagatgccgaaaaccagattcgtgagattctcgaagacgacgactgccctgccgagaagtcccacgccctgtatgcgagtttccttgacgtcgacgccatcaacgcttccggactcgcggccattgaagaccagttgaaggctattgacgtcgctgccgacaaggctgaactcacccgctctttgggcgcgatgaacccggctggcggccctgacctgatcggcattgccgtgtatggcgatccgggcgctcccgaaaccaacatcatccatattgaacagtctggcttgggactgcccgatgaggcgtattaccgtgaagaccattatgcgccgattcgtgaagcatacgtcgatatggtggccaagcagttgaagaacgcgaagctcgccaccgatgacgagcaggccgaagctcaagcccagcgtttcctcgacgtggagacacgtatcgccgcgaaccattgggacaatgtggcaacccgtgattcggtgaagacctataatcccaccgattatgcggaattaagcggaatgctcgccgattacgatctcgacacgtggatcgacgcttggcagaccgcatacgaccagacttccgccgctcaggtgcagccgcttgatttccgaggcattttcaaccatgtggtggtgcatgagcccagcttcctcaccggtcttaacgcattctggaaggccgcggatcttgacgatctcaagctgtgggcacgcgtgcatgtgatcatcggctccaccttggagctgccgcacgaattcgatgagacgaatttcgagttctatggcaagacgttgtctggtcagaagcagcagcgcgtgcgttggaagcgcggcgtttcgctggtcaacggcatctgcggcgaggatgtcggccgcgaatatgtgaagaggcacttccccgagtcgtcgaagcagcgtatggaacagctggtcggcaatctgatcgacgcctaccgcgtgtccatttccaactccgtctggcttggcgaagaaaccaagcagaaggcgttggagaagctctccaagttcgtgccgaagatcggctatacgaaccattggcgtgactattccgcgcttgatgtgcacgagaatgccggttttgccgagaacatgcgtgccgccaacttgtatgagaccggctatcagctggccaaagtcggcaagagcgtcgacaaggacgaatggctgatgaatccgcagacggtgaacgcctattatgagccgaccatgaacgtgatcgtgttcccggccgccattctgcagccgccgttcttcgacccgaacgccgaagacgccgcgaactatggcggtatcggagcggtgatcggccatgagatcggccacggcttcgacgatcagggtgcccagtacgacggcgacggcaagctcaacgactggtggaccgaagaagacaaggccaatttcgagcagctcacgcagaaactcatcgaccagtacgacgcattcgtgccgacccagctcgccgaaaaatacgccgacgatccagctcaggctccacatgtgaacggcgctttgaccatcggcgagaacatcggcgacctgagtggcgtgaacattgcgctcaaagcatatgcgttcgctcttgacgaggtggcaggccgtgagaagaacggttccatggagtccattgaagcttcgctggctgaggcgccggaaatcgatggtttcaccggtttgcagcgtttcttcctcagctacgcgtccatctggcgcaccaagaatcgtgacgagctggcggagcagtatctgcagatcgacccgcactcccccgccgaatgccgcacgaacggcatcgcacgcaacgtggatctgttctataaggcgttcgacgtgaagccggaggatggcatgtggctcgaccccgatcagcgcgtgcgcatctggtagcgagccgcatcatcagtaggcaatcatcgcccatcgtgcgaagcatcggtgcctcctagtatatgtcgccgccgaattcttcggggtttcccgagaattcggcggcttcgtcatcttcgggaaccactatctcaaccggagccacgctgctgtgccttgcgaacgggtcgactcccacttgaggttccgtgcccttcgtttccggttgggcttggtcgtttggcttgacgaacttacgcaacgtggtgactccccggttaaggtcgtgccctgcggcgctggcttccagcactatgcgtgactgcggtttgccgttctgatcggcccacgtttccgtggcgagcgcgcccgtcacgataaccggctcgcctttcttcagagattggcagatgtgctcggataggttccggtacgctttcaccgtgatccatgtggtgggaagatccttccattgctgcgtgcgattgtcgaaataccgtctggtgctcgccattctgaacgaactggcatggggcatgccatccctgttgaattgcgtgggattggcgcccacatatccggtgatggtgatgagagcttgctgttgtgccatgatcggccctttctgtcgcattggtaataaaggggccgcggaaagcaccgatgaaggtgcgaaagcaacgtgcagtcggagaaatgggttgcgagagaggggttctgcacgcctttccgcttccttgcgtttccgcggtagaaccactatccccgattcgaccatactggtacaagcgcaaccggcaaatgtggataaaggacgccgtttcgggcgagtcgtggatagtcggtggataaatctcacttatccaccgcaaggcactgccgatatatgcatggtttttcgtttgttttccccataaatgttttcctcacaatcatgcttcctcctacctgtttccagataaaaaaacggaagattatggcatatccataatcttccgtttatatggtgaaataatcagaaaaaatacgattattacttcagcagcgcggcgacacgatcggcaatcacccgggctgcgtcggcgacaggcacggcttcggcgttctcgccattgcggtcacgcacttcaatggtgccattgttgacagtgtcgcggcctgcgacggcgatcagcggcacgccgataagctcggcatccttgaacttgacgcccggggaaaccttcttacggtcatcgaagatcacttcgatgcccttggcttccagatcggcaatcagttgctcggcggcttcgaatgcggccgcatccttgccggtggccaccacatgcacctgggcgggagcgatgatggccggccatgccaagcccttctcgtcatggtgggtttcagcgatacaagccatcacacgagacacgccaatgccgtaggagcccatccacaccggcacggtcttgccgttctggtcgagcaccttcaggccaagcgcgttggaatacttcaaaccgagctggaacacctggccgatttccacaccgcgttcgaagctcagcgggccggaaccgtccgggctcatgtcgccatggcgaacctgcacggcttccaccacgccgtcggcttcgaagtcacgaccgtacacgagatcgtagtagtcgactccggcttcatcggcaccggtgaaccatgcggaaccgcgggcgatatgcgcgtcaatgaggtaacgcaacgcttcgccggtttcgttggcgttttcagccttttcaccgccgcgagcctgcgggccaaacgccatcgggccaatatagcccttgacgagttccggatgcttcttcagatcctcgtcggtggcctcttcgatttcagccggagtgaactgcgcttcaagacgcttcatgtcaacggtacgatcgccaggcacgccgacgaccaccagttcgcgccacggctcgtcatgctcgtcatcctgcggatgcatcacggcgatcaccacgttcttcagaatgtcggaggcctcccacgcgcggccatcggaacgcggatggttggcattggcaaattcaaccatctgatcgatggtttcagcattcggcgtcggacgcttttcagcggccggagtgttgctgaagtcgatggcttccggttccggagtggtcagcgcctcaacattccaagccttaccgctcggcgactgtgcgaaggtatcttcaccgatttccatcggggcaaggaactcttcggattcgaaaccgcccatcggacctgccatggcgtgcaccggcacatacttcaaatcgagacggttgaaaatacgctcgtaggcgccacgctcgtccatatacgccttgacaaggccttccttgtcaagcgtgaaggagtaggcatccttcatgatgaattcacggccacgaatcaggcctgcacgcggacggaattcgtcacgatacttggtctgaatctggtagagggtaaccggcagatccttgtaggaggagtacaggtccttgaccagcagggtgaacatttcctcatgggtcggcgccagcaggtagtcggcctcatggcgatccttcaaacggaagatgttgtcgccatactcttcccaacgatgggtggcctcatacggctcacgcggcagcagaccggaaaaatggacttcctgggcgtcgatcgaagccatttcctcacggatgatgttttcgatcttgttcagaacattcaggcccagcggcagccaggtccaaatacccggagcggccttgcgcaggtagcaggcgcgctgcagaagcttatccgatacgacatcggcatcggcgggatcctcacgcagagtgcgcaggaacatggtggacatacgaagtgctttagtcatatgcccaaaactactcaggcaaggggacgtaagcccaatccaaccacccgttcaccgacgtatggcaacgcacggacggaacacaacagtcatatccgtcgaatcccaaaaatcatcatacatgtcaaacaaggcaatcgccatactagaacagcgcgtcctgcgcgaactcgtcatcgtcgggaacagcgatgttctgccggaacgcggcgatgccatcatgagccaacatatcggatgcctgtgccgaggcgagacgcaactcaccatccaatcgcaccgcatcgggcgaaaccaagaacatgcgttcgttcacaccgttcaaatacaggccttgcagaccttccacacgagacagcgccacatatcccatgccgggcgcgaaagtgcgccgcaaatccatcaccgcacgctcgagcgtcataccttgcgatttgtggatggtgatcgcccacgcgcagcgcaacggcacttggttgacgctggcgagcactgtgtcgccgtccatcatttcccagcaattcggcttcatggtaacgatattgccgttttcaaattcaacgatcggccatccgcccttgttttcggcggcaaatccgcgcacggtacccaatgatccgttcacgaattggtggtcggtgtcgttgcgtacggccatcaccgcagccccggttttgagctgcaaacgttcgggggcaagcatgttcttcttcaaacgttccaccagattgactggccctgcggcttcggcgaaatattcgtgcggctcctcgttgatttcgaacaggcgcatgtcgttgagcgtgtccgcctgcttgttgacgggaaacagattgacggcctgttgaccaggttcggggattgtgcccagtctggtgaggagcacattgcgatcgtcgtcgttcacgcaaccgttgcgaatatcggttaatacggtgagcagactgccgtcatcctgacgatgctgttcggtcaggtaacagattgcgggattcaattcccgccataccaatgattcggtgacgaaaccatctggattgagtcccgctttcgcatactgttcgcgggaagccacgaattccgggcttggtgtgaccaaatcgtggttgcgcccacccacactcactggcggaagctggaagaaatcgccggacagcaccacttgaagccctccgaacgggcgttggtcacgtcgaatgatgcggcacacctgatcgaccatgtcgaacagccacgcatgcaacatggaaacctcgtcgatgatgagaatgtcagcgccctgcagcttacgtttgcgtcgggtacgtatggttttgatcagattgtcggtgagcgcgttggcaagtccgacaccgctccatgaatgaatggtctgcccgttgatatgcgtggccgcgataccggtggacgccgtcaccgacaccgccgcaccttcggcacgggcctgacgcacgaactcattgagcacgtaggtcttgccagcacccggcgcacccgtcaggaagacgctcgcgccactttgcagaatcgccaatgcctcagcctgccgcatgccgcaccgcctttcctgttcaatcgaccatcaatttcgaagaaacggcttccttacgcaatcagcttgtcgacaacctgaagaaccccgtgatcggcattggatggagccacaaaatgcgcggcttgtttcaacgcggggtgcgcattgcccatggcgaacgaccactgccctgccgagagcatctgcaaatcattgagataatcgccaaataccgccgtttgagccgcagtgacgccaagcacgcgctgcaacgcttcgacgccctgtttcttattggttgtagcattcatgatgtcgacccacagtttgccggaaaccaccacctgataatcgttcttcagtggcgtcagcttttccgcggccatcgcttcggcatcgtcgaaatcgagaatcgccagtttgagtatggtgtcgctttcgccgtttgatgcgatcacatcttcaagcacgctatgcagatcgtccacaatctccagtgccgcataatatttgccgacttcgtcaaggaacggcttgtccgtgcgctgcacgtatgccgtgcgcagaccacaaagcaccaatcccatattggattcgccagccgcggcagaagcgttcaccgtgtcgatggtccagcgggtcacatcggtatcgacgccgtgcacttcggcgatattaccgtcaatggccacgacattgccgttttccgcgatatacgaaagttcgccgccgtcaagcacctgcgccgccttatcggcgaacatggcacgcaaggtagcgtactggcgtccggatgccggcacgaattcaacgcttcgtgagcgcaaccgggcaagcatcggccagaaaccttgcggaatctcgctatgctcatcaagcagggtgccgtccatatcggcaaccaccaagcgaatgtcttgcgggatttcgatgctggtccaatcggctgcgctcactggagtcctttccatgttttcgttggaatatcagattttccaacgattgtgcgatatgcagaatcagttgttgttcagaatgctggttgccacgatctgatcggcgatcgccttggcttcggctgcgtcaggaccgggcgccgctgccatgaacgccttacggtagtagcgcagttcgtccaaggattcgatgatgtcggcgagcgcgcgatgtccaccattcttcggcggacggttgttgtatacggcaggataccagcggcgggcaagctctttgaacgtgctcacgtcgattacacggtagtgcaggtgttccatgaggttcggcatgtaacggtcgaggaattttttgtctgatccgatggagttgcctgcgagcagcggcttgacgccgtccggggtgaagcgggccacgtattcggtgactttccgttcggcctcttcgacgctcaggccgttctcccattcgttgatgagtccggaacgggtgtgcatggcacgcacgaaatcgttcatattggcaacggccgcattagacggcttgatcacgaaatcaataccctcgtcgagcacattgaggtcgaagtccgtcggtaccacggagatctcgcacagttcatcgtggaaaatatccaagccggtcatttcgcaatcgatccagatcaggcgtgaatccttcgccgtatacgtttcgccgtcatgtgcgtcaaccattttgcctcgtttcctttgcgtgtgcgcgtgccgcttggcacgcttcagctgaacattcaaagataccgcgaggtagggagattggaaggcctacgcaccgggaagtcacacttgttttagcgatttgcttcgtacatcaaacaccgctacttggcgatagggcgacgttcggttataaatattcacgttgcagatatgagtaaagcctcttactttcggtcttttccgagaagtaagaggcttttaccgattttgattactggaattcagcaatcactggcggccggagtagttcggagcttcggcggtcatgacgatgtcatgcggatgggattcgcgcaagccagcgtcggtgatacggatgaaacggccacgttccggcatttcggcgatgttgtgagcgccgatgtagaacatggactggtgcaggccaccgatcatctggtacagcactgcgttcagcggtccgcggtacggcacttcgccttcaacgccttccggaacgaccttgtcgttagaggtgacgtcggcctggaagtagcgatccttggagtaggacttcttgccacgcggagccatggcgccgagggagcccatgccacggtacagcttgtactgcttgccgtgcagcagcaccttctcacccggagcttcctcgcagcctgcgagggtgccgccgagcatgacggtggaggcaccggcaaccagagccttggcgatgtcgccggagtagtgaatgccaccgtcggcgatgcacggcacgccagcggcacggcaggcctgagcggcctcgtacactgcggtgagctgcggcacaccgacaccggccaccacgcgggtggtgcagatggagcctgggcccacgccgaccttgactgcgtcaacaccggcgtcgatcatggcctgagcgccctgacgggtggccacgttaccgccgatgatgtcaacgcccttgaacgcggaatcggacttcagacggcgaatcatgtcgagagccagcttggcctcaccgttggcggtgtcgaccacgagcacgtccacgccggcttccatcagagcggaagcacggttgtaggcgtcacccaggaagccgatgccggcggcaacgcgcagacgaccctgttcgtccttggtggcgtccggatactgctcggtcttcacgaagtccttcacggtgatcaagccggtgaggtggccttcatcgtcaaccagcggcagcttctcgaccttgtgcttggccagcaggtcgtgggcgtcttccttggagatgttggacgggccggtgatgaggttctcgcgggtcatgacctcggaaaccttgagccggtcgtaatcctcggaggcgatgaaacgcatgtcgcggttggtgatgatgccgacgagcttgttgtcgttgtcaacgaccggcagaccggagatatggaaacggccgcacagcttgtcgagatcagccagcgtcacatccgggctgacggtcaacggatcgttgatcataccggattcggagcgcttgacgatgtcaacctgagcggcttggtcgtcgatggaaagattgcggtgcagcacgccgatgccgccattgcgagccatggcaatggccatgtcggactcggtgacggtgtccattgcggcggagatcgccgggaccttcatcgtgatgttgcgggtcagatgggtggtggtgtccacttcggacggaatgacatccgtctcgttcggcagcagcagcacatcgtcataggcgaggccaagctgtgcgaaaatcggaggaagtggagcgtacgtggaatctgcattcatatcaggaattgtagccatagacccactatatgaacgcgggctgacttaccgcgacacggcagaacaagcggcaaacaagggtgttatgaaagttaactaataccgcaaggcaaagcgtttaatcagtttttccgacgcttcgacgaccgcaccgacgcatgtctgccgccatccgcagcgtcctcctccagcatctcgggaatcctatgcttcacatacggatacatggtggcgacggtcagcaccacggccgcaatcaggaatccaacaagcacgtattgggccttgaaaaacagcgtcataatcgagccgaatgcgatcagtgccgcccaaccccacagaatcagcacagccccctgcacggaatggccgatgcgcagcatgcgatgatgcaagtgcatgcggtccggatgcatcggagactgtcccttgcgcaagcggcgcacaatcgcaagacacatgtcgagaatcggcaggaacaataccagaatcggcagcagaatcggcatgaacaccggcaagtaaatgctggcatgaatactggccgggtcaaggcggcccgtcatcacaatcgacgcgcacgtgatcaaatagccgagcagcatggaaccggagtctcccatgaacagcttcgccggatgccagttgtgcatcaaaaagcccacgcacatgccgaccatggcaatgtcgatcaatgtcgccatcgaagcgtacgaaggcgagttgcgggcgatgatgtatgaataaatggcgaatgcgatgccgccgatcgccacaatgcccgacgacagaccgtccaacccatccacgaaattgaccgcattgatggacgcgacgatcaaaaacgcggtgatggccatcgacaggctcggcgacgccgtcaccaacgagccaagcggaagcgaaatgatctgcagaccgccccatgccacgaacacggaaatcaacagctgaccggcaagcttgagcatccaatcaagatcccacaagtcgtcggccatgccaagcagactgatcataatggcgccggcgagaatcacccacgcctgttgcgattgcgcgaacaatccttgaatgaacggaatgcgggatgcgaacagcatcgacacggtgaaaccgatcagcatgcccaaaccacccagtcgcggtgtcggaatggtatgcacgtctcgcgcacgcacttcgccgacggcgccgatctcaatggcgatatggcgaatcaacggcgtgatcaaataggtgacgccgccagcaatcgcagcaatgaacagatagattctcatacgcccaaagcaccgccattcaacgtcaaggcctttcggataaccggctcgtgaatcactccctctcgaagaatcgcaatgccatcacgcccatgagggtcagccgccacaaccgtggaagccacatgaccgggagtcgctcccccgtccaaatacaaatcaaccgcatcgccaagcgcctgcacggcctcgtcaacggtttgcgcactttcatcgccggaacggttggcactggtggcggccaacggtccggtagcgcgcagcacacgcaaggcggccgcggaattcggaatgcgcacgccctgcgtgaccttgccggtggcgggatcggtacgtaccgtggcgagcgtgcaatcgtcatcggccacggcgatcggagagaacgcgcccggcatgaacatggcggacaggcggttcagcggatcacgaacacgaacacgaacaccaacgcgaacggccacatgaacttccaaccgcgccaatccgcacggtgacggttgacgcgaatctggtccgcaggcgtatgcagcgcatccgccgcgactgctgcttgctgagacatgctttcttctttctgtatgctttttgctctattgatcgcacaaccatgtgcaattgttaatccgcaaaatcttttattgtttgaattacaggattgctatttttttgaaatctttttctattgtaagatttcgtttttaaaattatttttgcgaagtgaggcaggcgggtcacgtcagacgattcccacctgccgtcgatcttcatggttgcgatggtgcgttgcgtatgtcggatcgcattatcgcgtttttcgttgtgccgcacggcagcggctgggcgccgtcagtccttgctggtgacggtgtagccctgctggttgccgtgatcggtgagcgccttgctgtagttgacgaaggcttcctccagagtgatgtcctcgctgtaggccttggagatctgatcgccgaaggtggactgcgcgtacgggttgtacggcaggtactggaaggcggagaccttgcgctgggcggcttcggagagaatctcgttcacgttctggccgccgaagtagtcgttgaccttcttgttggcttcagtgttcggatcggtgaaggagtcggaggagaggatcttcttcaggctcgggaaggtgccggtgtcggccatggtctgggcgccgtcgccgtgggtcaagtattcgacgaacttgtaggccgcggcctgctgcttggactgggagacgaccgcgagtgcggagccgccgtcttcagcggagacctcgtcaccttcgttccactgcgggagctgggccacgcgccagttgccggcctggtcaggagcgccgttcatgaggttaaccggcatccatgcgccgatggtgagagtggcgatgtcgccttcgttgagcgcacggttccagtcgtcggaccagttggcgatcttggtgtcgacgaggtcttcgtcgatgagcttctgctggaattcgatgtacttcttcatgccggaatccttggtcatgtcaatggtgatgttctcgccatcgaccttccacggctgcgcaccggcctgccatgcctgggcggtgaagggctggtattccatggaggagccggaattgttggtcatgtaggcgccgatggccttgaccttcttggctgcctcgtaataatcgtcccaagtcttgatctgggagccgtcgacgccggccttcttgagcacggcatcgttgtagaagaagacttccgggccggaatcaatcggcagcgcatacggcttgccatcatactgtagcttgctccacgggcctgcggaaaagtcgtcttcgagcttgtcgacaccgtaggcggtgaggtcaacgaggtcgccggtaaccgcgaactgggtgacggtcgggtcttccagcatgaccacgtcgggggcacccttgcctgccgcgacggcgttgctcagtgcggtctgggtgtcggatgcggtgccggtgttgttgaatttgacggtgattccgggattggccttttcgaagtcggcgatcagggccttcatggtgttgccggtgtcccagccccagaaaacgagatccgccttgtctgcgtctccggcgttggccttggcgtcgttgccgccgtcgctgccaccgcaggccgcgaggctggcgagggttgccactgctgctaccgctgcgagagccttcttcatgttgcgcatgttcttttccctttctgccatccgcttcgcatgctgattgcatgtcggtcgcatatgtttcggaacatccgccgcggaatgcacatgccgtgctttccacttggtgatgtttgtatgttcgcgacctgccaaacaatacccccgtggtgatgtttggactggtaggatggctttgtttcctttctgatacaaccgtgtaccattagctccgatgatacacggttgtatcaaggtgtcaagcaaaccggttcgatagcccccccctgcaactgttgtgcgctattgaagcgccaacgaaatcatcggcgtttcgcacaaacagaatgacatcgtttgcacaataatctgcgattgtccgcgcatctcaaccaaaaaatggatcgcaagaaagctacctcacaagagaaaacatataaagaacatatacaaaggaggtctgcgaatcgcaaacctcccaaaacaacacatacgacgaagagacggactccgcaccgctcgatgtaagcctacaaactgaggaacagctcgtgaatgcgggtatcgtcggtcagttcggggtggaacgccgtagcgagaatcttgccctgacgcaaaccgaccacattgccgtcgaccgacgtttcgaccgtggcccgctcgccgacctcggcaacgaacggtccgcgaatgaacaccagagggaaatccttgagcaccaccgacgtatccgaagcctcggaagccccctcctcaccagcagccgcggaaatcgcagaagagacagactcccccgacgcaaccaccacagcatccgcatcgtcggaagcgccgaaatcggcggacgcagcgaacgaaccaagctgacgtccatacgcattgcggcgcacgaccgcatccaacgcgccaaaatagacgttctcgtcgttatcgagacgacgagcgagcaaaatcatgcccgcgcaggtgccgaataccggctttccagcggcgatatgcgcggcgatcggctcgaacaagccggtcgaacgcagcaatttgccttgcgtggtgctttcgccgccaggcagaatcacgcggtcgatcgaatcgtcgaaatcctcggcggcacgcagcagtttccacggcgcaccaagccgatccagcatcgccgcatgctcggcgaacgcgccttgcaccgcaaggatgccggtcacgccatgctgcgcggaagccgcaccttcggcaacgtcagtcgattcttccttcgaaatgtattcaacggcaacaaccatcggatctccttacccgaaccatcgcgaatcatgcgaaacgggctgcgcgcggcgcatcgaacagacatgccgacagccgcacgcagcgcacagcgcacgaaatcacagcgaaatcactcgccgcgagcggccatgatggtttcgatctcgtcttcgttgatgccgaccatggcctcgccgaggttctcggaaaggcgtgcgagcaggtcggcgtcctgccaattggcggtggcctgcacgatggcggcggcacgcttggccgggtctccggacttgaagatgccggaaccgacgaacacaccttcggcacccagttccatcatgagcgcggcatcggccggagtggccacgccaccggcggcgaagttgacgaccggcagacgaccgttgtcgtgcacatacttggcgagatcgtacggcacggccagctgcttggcggcctcatacacctcgtcgtcgcgcagggagacgagctcgcggatctgcttgttcatggtgcgcatgtggcgcacggcctggatcacgtcgccggtgcccggctcgcccttggtgcggatcatggaagcgccctcggcgatacggcgcagcgcctcgcccaggttcttcgcgccgcacacgaacggcacgtcgaactggttcttgtcgatgtggtacacgtcgtcggcggggctcagcacttcggattcgtcgatgtagtcgatttcgatggcctgcagaatgcgggcttcggcaacatggccgatacgaacctttgccatgaccggaatggacacggcttcctgaatgcccttgatcatggccggatcgctcatgcgggaaacgccgccggcagcacgaatatcggccggaatacgctcgagagccatcaccgcgcatgcgcccgcgtcctgtgcgatcttcgcctgctccggggtggtgacgtccatgatcacgccacccttgagcatctgcgccagattcttgttcagttcgttcctgttgttggccatcgccagcctttcgtcgaatcgtattccaccctgctgcagagcggatatctcttgacacagatactaacgatttttcgttacaaaatcatgtgaactgaatatttgcacgtcttaaaaagttgcttttcttaaattctgactatcattttcatgattgtttcattttcttacgatttcgattctgccgacgattccgcaatttcattcgcttttcttgcctgatatgcgccattcgctttcgattcgcgcgcactgctcctttcgaccgcactttcgatgcacgctataagaaatacgaatgacgcatgattttcatacgaccacattgcggacgggggcgcagatggattcgcgtattgcgcactacatacgcaatatgcgatcggcgacgcgcatggtggaatcgcggtgcgacaccagcacgacggcactcccccgctcggcgagattgttgaccgatccgaggatcaccgactcgttataggcgtcaagacggctcgtcggctcgtcgaacagcaccaaatcggcgtcgcgaaggaacatgcgggccaatccgatacgttgcttctcaccctccgaaaggcggccacccagctcgccgacctgcgtatccaagccgttcggcagcgcatcgaccagttcgagcgcggacgccttggcgagagcttcgcgcaatacggaatcgggaatgtcgtgcgcgagatccgaatcggaggaatcagcggaatcaccaccagcattactgctggaattactacagaaattactgccagaattactgtcagaatccgaaaaatcggcgtcattgcaggcaatagcgagattttcgcgaatcgttccgtcgaacagatacgtctcctgccccatcatcgtctgcacgcgccgacgccatccggcgtcaacctgcggcaatggaacatccgacagcgaaatcgtgccggaatccggatcccagtagcgcatcagcagtttcaacatcgttgattttccacgcccggacgggccttgaataccgagaatgccctgccgtgaaacatcgagtgaaacatggtcgagcaccggttgcgaggcgatgccggcaccttgttcgccggaggattgcgcttccgcggggagtgccggactcatgccagtcgcatgctccgaccgcccgtttggcgtgcgttcgccggaaatacgggcgccggatccatagccgaatgtgacatcgcgcattgtcatgccctgatattccgggcgttcgctcccctgctcgaccacagcgggagcctcatccatcaacgcgaacaggcggcgtgccgaagcaaacgtttgcgtcagattcgccggcaacgcactcaacgcaagcgtcggcccaaacgagctggcgagcagcacgaaagccgcaaccaacgctggggcgttcgatcccacggaacccatccacatcaggccttccgacatatcggcggcagtggaaaccgcagtgcacaacgtcatcgcaaggaaagccgcaatcgccgtgaacagcatcaccaataccgcgccaaatcctgcaaaatcgccatttttcacgctcagacgcacacgtttgacccacagcgagcgcgtgcaacgctgaatgaacgcaagccgggcatcgccttggccgaagcggatgatttcgccgatgccacgcatgtcgtcaagcatttcgtcatcgagggcggacgactccttgcgcagttccggaccgatgccgcgcaccgcggatgcaaagagtttcggcagtatgacgccgataatgaggtgcgcgatgatgagcgtcgccgcgaggggcgaactgagggtgagtagcgcgagcgcgtagacgacggtagtcacgatggcgatgacgaccgggctgatggtgtgtgcgaagaagatttccagcagttccacgtcggtggtgaccagtgcgatcaggtcgcctttgcctttgcctgcaagcttggcgggggcgagacggcgcagggccgcgaaggctttcgcacggaataacgcaagcagacggaacgccacgttatggttcatgaactgttcggcgtaacgcatgccgccgcggatcagcgcgcatacggccatggctgcgagcgccgcgggaacgctgaggttccagaccggcgagccgactgcagcgaaggccgccgcgatgccgaacaccggcaggaaagtggcggcgagatggccgagcgtgccgcagacgcacgcgacgatcatgtacttgcgctgcggcccaacttccttcaacaggcgcgcaataaggcgagacgtgggtattgtcttcgcgtccgattctgccgaatcggacatccgaacgcccgttttcgcaccctgtgcgtccgtttctgcagaatcggacattcgagacgtagtttcggcacgctgcgtgaccgattcgggagaatcggacaactgagcggtgtttttagtgagttggttgtccgtttctgcagaatcggacacttggagacccatttccgcacgctgcgtgactgattctgcagaatcggacgctttaagtgcgtgggatgcagaggtggaatgggttgcgttattgcgtagacctatgttttccacggtttgttgggcgtggaacagtttggcgtatgttccgttggcacgcatgagttccgcatgcgtgccttgttccgacacgcgcccgtgttcgaataccaccacatggtcggcgtcggctgcattcgccatgcggtgcgtcaccatgatcacggttttgccccgatccgcaagcgcccgaatggtttgcagaatcagggtttcgctttccacatcgacgctgctggtggcttcgtcgaaaatgtagacggcaggctcccgcagcaatgcgcgcgcaatggcgatgcgctgtttttggccgccagacaggttgcttgcgccctgttcgatggccaggccaagttcttgcgattgcgcacgcacgaaatcgctgatatgcgccgcttccagcgcttgccacagttcgctttcggtggcatccggcttggccatcagcagattgtcacgcaacgttcctgcaaaaaggtggctttgcgccgccactatggcgatttccctcgtaagggattcgatggaaagatcgttgatttggtaccgttgcgtcgagttgtttcctgtgtttccggattgcagccacatacatccttcatatccggaaagatttccggagagcagttcgacggcggtggatttgccggatccggagggaccgacgatggcggtcacctgcccgcgccgcgcagtgaaagagacgccatgcaatgcgacgaccgaaccatcatcatctttcgacatgcctgtttttccagcaccaaccacaccggactttcccccgatttgtccagtttttccagtttccatatccgccgtcacagccgtatccgcagccacactcacagccgccgcagcgtccgtattcacgtccacatatcggaacgacacgtcatcaaagcacacgtccacaccgttatcggaagcgccgaattccggcatttcctgcatcccatgcgcaggaatcggcgtatcaagcaatgcgaaaatacgcttggtcgaagtcatgccgttcatcgcaacatggaagaacgaccccaattggcgcagcggaatgaagaaatccgcggaaagaagcactatcagcagcacgccggcaagcggcaatgcggcaccactcgcatactgccagatcgatacgcccacgccggccgcggcacccccgtatgcgacgacgtccatggcggtgagcgagcgcagctgaatttgcagaacattcatggtcattacgcggaattgttccgcttgctcgcccattttcttggcggcatgcgcatccgcgtcaaaagttttcagcgtttcaagaccttgtacattgtcaagaaacacagatcccatgtcggtgtattttccccaatattttttgaatactcgggctgcgcgcattgcgaccatgccaacaatcaatacaatcaaaggcgcgcatacaagcaatgtaacagccgtcggcatattaatcggcgcaactataaaaaataatgttaccggtgcgagaatcgcataaaacagttgcggtaggaataactcgaagaagctttggatttgttcgatgccttcaccggcagattgcaccacgtcggcagtgctgatatgttgcgaatatgatggtccgatcgcaagcattttattaaaaagctgttcacgtaacgcgagtttgacacgctcagccgcttccgcgccgaaataggccgctgcgcgcatcatcagaaaacgcagtaccgcacagaccacgatcgccagtacgcatccgacgtatgtttccgcactgaatccgccgtagccaaaaccgatgaataggcgggaaatcaggccactatcacccatggagaacatggggtcgaacgccgattccaccacggcaagcgccggcgaaagcatgaccaccaccgtcaccacgaacacgacgttggccagcagtccgacccattggcagagcactttcgccgcaaccaaccgccccacgccgggagcgagggaaaacagcctcttgtcaaacataaacaccttccgtccaatgagcgcactcgcgttgccagctcgcctacggcccaaagcgcaatcgccatgcatccaacaaacgaatcgcaacaggccaatacgggaaaaccggtgcgtggcaaaccgttttcagcctatccaaggcagctcgcaatcgtcaagggcgcattgcatacaacgaaccgtcgcaatcgaattgccataatcgacctcaaatcagcaacgttgaaaagagaaaggctggatgttcgccgttgagcaggcagccctctgacgcaaggggtaaattgcgtcactcgtgagtgtactcgataaaaaacgctcgcaccaccatttcttcgcatttcgctggttttacggtcctttcggggatatatgggaagcatggcggctcccccgcaaccgttacgtcaagcctttttttcgaacggatacagcgcgacaccaaacacttgatttttgacggaatagcaccatttgtcagttcatacaaagttgatgaaatatttcttgtcgcttctcacaatgcagacttacggccccgtaacttagaatgtgcaaggtgcgcaaggggtaggaaacgcggacacacggtttgtatcgctcccgcacgcatcacaagcagaaatacgcggaaacaacgcaaaaaccgcgagaaagagaacgcttcatgctcaccgagtacaccaccccgggcgaatccgttgaggtgcgcgacgacgaatccatctattccctgcttactggacgcatagcgcgcactggcgaagataccgtgatcgcggaacgcaaaaccgcccccggccaatggacgaaggtcactaccggcgaattccacaatgccgtgctcgccgctgcaaaaggcctcatcgcattcggcatcaacaagggcgatgccgtcaccatcttctccaccacccgctacgagtggggcgtgctcgacttcgcactggccgccatcggcgcggtgaacgtgccgatctacgacaccgattccgcggcgcaggccgagcgtatcctcaacgattcggatgtgaaactggccatcgccgacaatcgcgagcgcttcgaccgtctcgactccgtaatcgaccgctgcccgtctctcaagcacattctgatgctcgattccaacgccatgggcgcgttggaaggcttgggcgtcaccgtgtccgacgaggagctggaagcgcgcatcgattcggtgcatgcagacgatctggccaccatcgtgtacacgtccggttcgacgggagctccaaagggtgccgagctttcgcaccgcaatttcatatcgatcacgcgcgcaggcagtctggcgttgcatgagatcgttctcgaagatcatccgcgactgcttctcttcctgccgctcgcccactgtttcgcacggttcatccagtacgcgtcgattgcttccgacgacggcgtggttggttatctgccggacacaaagacgctgctgcccgatttgcgttccttcgaaccgacatatctgctgggcgtaccacgagtgttcgagaaggtgtataacgcggcctcccgcaaggccggcacgggttggaagggacgcctgttcctcaaggctgccgaagccgcacgcgattggtcgcgcatgcagcaggccggcgaacgcccgaccgccaagcagatcgcgcagcatctttcgtatgaggcttccgtataccgtaccgtgcgtagcgctctcggcccgcgcatccgctacgtggcatgcggtggtgctcctctggacgtgtctctggcgcatttcttcaacggtatcggcctgccgatgattcagggttacggtatgacggaaaccgctgcgccgttcgccgcgacccgcgtcaccgacaatgtgatcggcactgtcggccaaccggctccgggatcgtctgtgcgcatttccgatgatggcgaacttcaggtgaagggcccgaacgtgttcaggggctaccacaacctgcctgagaagacggcggaagcgttcaccgaggatgggtggctgaaaacgggtgatttggcgtcgattgacgacgagggacgtattacgatcaccggccgtaagaaggacatcatcatcaccgccggcggcaagaacgtttctccgattccgatggagcaggagattgtgaaatgtccgattgtggagcatgtggtagttgtcggcgacaatcgtccgttcatcggtgcgctgatcacgttggatccggaaggattggaggcttggctgccttccattggactgtctgccgatacgccgttggatcgcgtggctgcgaccgccgccgttcacgacgaaatccagaagtacgtcgacaaggcgaacgcgaccgtttcccgcgccgaatccgtacgtaagttcgtagtgctggatacccagttcacgcaggaaaacaagtgcctgaccccgtcgctgaaagtggtgcgtccggcagtgaaccgcgtgttcgcacaggtgatcgatcagcagctgtactccggcaagcgctgaatcgcataatacataaaagcgtggggtgcgagagaatacaaacgttctctcgcaccccacgcttttgttctgtccgtacaactttcaaggaatgcaaacgagcgccggtgatcggaagcgatccgacccgccggcgctcatatggcagagattagtgatgaatccagaatgtctaacgacgctccatcagccattgtcagtaaagcgacaatcagtgacggttccgtcagtgcataacgcgtgcggtaacggtgcggcagaaggcgaaggcgtacgagggtacgtcgagtcttctgccgtgccgttaacgctccgttatgtcagtgacggttgttgaggcggtggtacatttcggagatctcaaggtcgcgctcgaattctgcggccttggtgttcgcgtcgatggtggcgagttcgacaccggcgatgcgggcgaagtcttcccaagcctcgcggccgacggaggtggtcatgcaggtgtggtgggatgcgccggaacgcagccagcactcggcggaggtcttgaggtccggctgcggcttccacaggccacgggcgcacggcaactgcttgagctctccgagcggctcgaccacgtcgaccaggttcatggtcaggcggaaacgttcgcgcacgtcagacatggacacgacgacggcgtccttcttcggggcgacggtgaagaccaggcgcaccggatcggccttgccgccgatgccgagcgggtggatttccagcttcggcttggcgatggtgccgacggacggggagacttcgagcatgtgggagcccatgatcatctcgttgcccggggtgaagttgtaggaatagtcctccatgagggaagcgccaccttcgaggccgtagcccatcactgcgccgatgcgcacgagcactgcggtcttccagtcgccttcggcggagaagccgaagccgtactcggacgggaagcgctgagggccaacgcccggcagctgcgggagggcgcccaagtcttcgaagttgtcgacgccggcggtgcagccattggcgcgcatcatgttgaccatggcggcttcttccttggccgcgatgaacagggaatcgtacttggcgtcaagcagagtcggatcaacgtcgtacttggccttgtagtcttcgatgatgctcttgacctgatcgtccttgacggcttcgtaggctgcgacgagctcgttgacggcccaagtgttgatggatgcgccgaacacgcgctcggcttcggtcttgtcgccttcggtgacggccacgttgcgcatgttgtcgccccaacgcatgaccttcatgttgttggaagcatcccagccggcgcaggcgcgtgcccaggtgccgatttcttcggcaacggccggatcggtgtagtggccgaccacgatcttgcggttgatgcccagacgggtcaggatgtaaccgaactcacggtcgccgtgtgcggcctggttcaggttcatgaagtccatgtcgatggtttcccacgggatttcgaagtggtgctgcgtgttgagctgcagcagcggcttggtgagcacttcgaggccgcggatccacatcttggccggggagaaggtgtggcaccaggtgatcacgccgatgacgttcgggttggcggaggcttcgaccatgaaggccttgacgccgtcggaggacttcagggtcggcttaagcaccaccttgaccgggatcttgccggttgcgttgagcgcgtcgacgatttcgccggactgctcggccacctgacgcagcgcttcctcgccgtacagatcctgggatccgacgccgaaccagacttccttgccttcaaacgggttttccattgccatgtgattgttcctttacttcgttgtttatggagtttttaattatttattgcgattgcgatcgctgatttgcagctcagtgttgtccgtagacgttggtgtaacgatcgttcaacttcgcgatatcctcatccgaaatcggaatgatctcacccaactgcctcgccgcccacatcgtatgggccacctcctccgtcatcgccgccgccttcaccgcggcctccgcgtccttgccgaccgtgaacggaccatggttctgcatcagcacagccggggacttcggatactccttgagcgtctcgaccacgccctcgccgatcgcctcggaaccgatcagacggaacggccccaccggaaccggacctccgaactcgtcgcccatcatcgtcagaccgcacggaatgttctggcccgtcgccgcccacgccgtcgcgtacgtcgaatgcgtgtgcaccacgccgtacacgtccggcatgtgacggtagatgtacgcgtgcgaagcagtatccgagctgggcgactccgagccgtccaccacgttgccgtccaagtcgcacaccaccatgctcgacggggtcaggtactcgtaacgcaggcccgacggcttgatcaccatcagatccgcagtgcgcagacgctgcgacacgttgccagccgtccacaccaccaggttccacttgaccagctgctcgtgcaaggtcgccacgacctcacgcacctgcttgacctccgcacgcacctcgggaccataatcagccaaagtagccataatcatttcctttcaaattgaaataagtttttaaaatatttatttacttggtttccagcggaatgctttcgattgcaacatgctcgatcggcagtcccttgcggaagcgatcgaagaattcctcgaatcctgcgacgtcgttttcgtccggattttccgtggtggaagctgcatctgcgaatacgcgagcgtcaaggaattcgtcgagcggctgatcggcgtgccacaggtagtcggcgagcacggccatgccccatgcgccgccttcggcagcggtggacatcaccttgatcggcgtatcgaatgcggctgcgaggatcttctgggcaaccttcggggtggtgaagatgccaccgtggccgacgagggagtcaacggcaacaccttcgtctttggtcatcacgtccatgccgatcttcaccggggaaaaggcgctgaacagctgggcgcgcatgaagttgccgaggctcatgcgggcttccggaccgcgcgcgaacagcgggcggccttcgggcagtcctgcgaggaattcgccggagcggaacgggtagttgatgagtccgccgcagttggagtcaacgtcgtccgcgatggcggcgcggaacagcgtgccgtacagggtgccggcgtcgaccggagtgccgattgcagctgcgaactgtccgaacagaccaacccatgcgttgaggtcggaggtgaagttgttggcgtggctcatgcctgcgagatcgcctgccggagtggtgacgaggtccacttccgggtgcaggcgttccagcttgcgttcgagtacaaccatggcgaagatggaggtgccggcggaaacgttgccggtgcgcacgcgtacggagttggtggccaccataccggtgccagcatcgccctccggcggggcgaaggtaatgcccggctgcagcgtgccggtcggatcgagtagcttggcgccctcttcggtcagcgtgcccgcaggagtgcctgcaaccagcggttccggcagcaggtcggcaagcttccacggctgggctgcgacttccggaatcgcattgaacttctcaatgaattcggtttcgtaggtgtgcgtggtagggtcgatcgggaacatgccggatgcgtcgccaacgccgagcaccttcttgccggtgagcttccagtgcacgtagccggcgagggtggtgaagaagtcgaccttgccgatgtgctcttcgttgttgagcacggcctggtacaggtgtgcgatggaccagcgttccggaatgttgtactggaacagttcggaaagcttctcatgtgcttcggaagtgttggtgttctgccaggtgcggaacggcaccagcagttcgccatctttgccgaaggcgagatagccgtgcatcatggcggagaagccgatgcgtcccacgcgggtgagcttttcgccgtaagcgttttcgacatcttcggcgagcgccgcgtatgcggtctgcagcccggtccagatttcttcctgcgaatagctccacaggccgtcttccaagtggctggcccagccgtagtcgccggctgcgatggtggtgtacgtgtcgtcgatgagcacggccttgattcgggtggagccgaattcgatgcccagactcgtcttgccagcgcggattttctcggcggtcagcgcgatgcgatcgtcaagtccctgctcttgcgccatagtttcaaactccttgcatccgagcgcctcacaaccacattgtcgacggaatgttagcgctcactgttaacgctcactattctaaacagaaagtggcgactatacaagttcgacgtgtcacgcaatcgtcaacgtactaccggcagatcgtcagccgattttcttgatataccggcattacgaaatccggcaatcgcagcacatgcggcaaaaagagatacgagaatcacaagaaatacaaaaatcgcaggaaatattcagcgacggctggcggtgcccaaagaagtgcggccgatcaccttcgcgggaatcaggccgacgccatgctgcgacgaggcgaacgaattctcatcgccctcccccagcaaaaacagcgtctcacgcatggcggcaacgccaagctgttcaaaatccgggcgaaccgtggccagcggcgggtacatgttgtccatggcgggcatgtcgtcgaaaccgaccaagctcacatcctgcggaatacgcatgccatgttcatgcagcgcacgagacacaccaaccgcctggctgtcgttcgcacacaccatgcacgtcggcagatttccgccggtacgaccgatgttttcgagaatatggttcatcttgccatacgcttcggtcgattcccaggtttcgcattgcacggtgacggaactcaccgcattggccgcgcacagcttattccacgccatcaaacgcgtggcggcgtcacgccattccttcggacctgcgaaataaagcacggaacgatgcccatgctcgaccaccaaatgcatcacgtcggccatggccgaccattggtccactcccactacggatactcggcgacggtcggccggtttcatcaagcgcaaaccatcctgcacgctgatgctgccgtgcgtggaggtgacgatgacgcgcggctgcgtgatctgcgcacggcaggcggcggaaaacataacatccgtcggcgtgaggaaaatgaacgcgtccacgttcatctcatcgaacgttgagcacaattcgtcgaattccgtctgcgagcagagcgcctcgtgcaccatgctcaccgacatgaacagtccatgctgcctcgccatcgcctcaatcgaggaaatcgcggaaatcggaccataaaagcgttgcccgcccgcaaccaagccgatggtgcgggagcgatgcgaagcgagggcacgcgcggaattgctgggacggtatccaagcgcgtcgatggctttctgtactttttcgcgggtggcatcagacacgtcgggggaatgattgatgacgcgcgacaccgtttgatggctgacaccagccattttcgccacttcgaacatcgaggggcgtttgtttgccgcattgcgcttgcctgccatgctccgtcgccttccgcacactaccgttggtactttcgactattctacacgcaacttcggttagcgctaacagacgctatttttcagccatttgagcgagtcgcgcagcgaaattcggccagtcggtacgcatggcggtcaacagtttacgattggggacttcctcaatcggcacccattcgatttccatgctttcgtcgtcgttggccttcggctccacgcggtgccccggcttttcgaaagcgaacacggtggtgtaggcccacggtccgtggtcttcgcagtatgatccgaccacgtcgatatcttccggcgtgatgttggcttcctcgtacgattcgcgcagcgcgccctcgatcgggctttcaccgtcggcggtggcacctcctggaatgccccatgtgccaccttccgcgctccacaccgcgcgatgttgcatgacaacgtgcgtcacttcgccggtctgttcgcttcggcgggccaagagcacgccggacgcgccgttcgtgccccaatgcttgcggccgcaatcgcaatcaatccaaccatcacccggctgatgcacgttttccttgggaggaagcggcttcgcggcaccggttcgcgaatcgtgttcgacgttcggttcttgatcggctcgcgtcacattccacagatcagtccattccacgccgagctcggcggccaaacggcgcgccagcggaaggctcaggccgataatgccgtgcggatcgccttcgatggagtcgatgaatgctccgccgaagccctcaagcgtgaaggaaccagccacttccaacggttctccggtggcgatgtaccgttcgatatcggtgtcggaatattcgcagaagtgcagcgttgccctgctcgcgcctcgcgcgatacgcccggtggcgaagtcgatcaggcaatggcccgtccacaattcaccggtggcgccacgcatggcacgcagtcgttcccgagccacctcagcgctatgcggcttgccgtaacattcgccgtcaagcaggaacatggaatcgcagccaagaatcagcggaccgactttcgcacgggtcaggctcggcttgccatcaacgaaatcagcaatcgattcggtgatcgtaggaatggtgactcccgaaaaatcacgggtcttcacatcggaggcggactgcacttcgtccgcacgcaacgtaacacgatgatgttctaaagatgcggaatccccagtattttcagcattatccgaatgttcggaagattcggcaacggctttcagcggaaatccgaccacacgatcgccgtgcgccgccgcagcggtggcggcaacgttccgatacgcctgatgtacggcttcggctttggccgtagcgagaatcatcacccgctgttccacgttcagatcgcttacggcaacgcccatggcggccgcctcacgttcgagcgccgccggctcgtccacgttcgatacgcgaatcgtggggcaaatgcccgccgagaaaagcacgtcacggcgaggcttggatttggaagcgagaatcagcggaatggagttgttcatgcgcgttccacctgcacacccttggtgtcgacgcccaaatgcagcacacgccaatgaccggaagcgagctcttcggaagcaagctgtcccagctgttcgcgagcgtcgccatgatgcagcacgagcacgcatgggccagcgccggaaaccatggaagcaaaaccatgggaacgcagcttttcgatcaacgtccacgacggttccatcaaaggagcgcgatacggctgatgcagacgatcctgcgtggcggcgaacagcaacgcgttgacgtcctgacgctgaccagtcgccagcatcgcaggattcatggcggccggcagcaggctcacgcgagacacattgtgcacggcatccttgaacgccagctggcccggcagcgcctggcgtgccttttcggtggacagctcataatccggcacgaacacggcggcggtcagatcgtcggcaacgcgatagttgatggtatggaagcccttatgcagcggttcgccgcccggaatcggcacggaaccgacaccttcgggggtttccatgtcccaagacatggtgagcccgccgtacacggccggagccacgttgtccggatggccttcgatggccgcagcaagctcaaacacggcatcacggttgagttcgtcgtcctgcgcgaaggcggccgcggctgcgatgcccgccacaatggcctctgcggaagagcccatgcctcgtgcctgaggaatgttgttgtgagcctgaagaatgaagcccacacggcccagaccaaaggtctggcatgcgcggcggaacgtggaaaccaccaagtgggtttcgtcacgcgggagagtatcggcgccttcgccttcgatcatcacctgagccgcagtgttcaccggatcggcgctcagcgtgaattcaagttcgtcgtggtagtccagagcaagtccgaccgtatcaaagccagaaccaagattggcgctggtagccggaacacgcacacgcactttacgagtaactggagtcatatctcgtcgtccttcgtcacatcttctttacaaatgtagcaccgtatacccgaaagggtacaagagtcaaattcaagcccataatcagcgggcgattgagtaaacaatcggcaagcaattgcccaacacagcagccggaatatgaataaagagacggccgcccaatcgcaacgatttgagcagccgtctcataactgttagttgagcacgcggaggatggaaggctcgccaaccacgcagtcgagtgcgcacacgtctttcacggtttcacgcagggtaagctcgtcggtcatgtgcgtgacaaggcgcagctgctgcagttcgccgtcgtagcccggatccttcagcgtgggcttgagatcctggttcacaccattgatggacacgccatgctcggcgaacctggccgcaatggccgcaagtacgcccggattgtcgtgaatcacgaaacgcaccgcgaactcggccttggaagcctcgatcggagccttcttcaaatccttatacaacggaatggtcgggccagtgcagccctgtgcgatgtgacgcgcctcggtcaccacatcgccgaccactgcggaagcggtcggagcgccgccagcgccacgaccgtagaacatcagatcgtcagccgcttcggccttcacaaacaccgcgttaaaggaaccatgcacggaagccagcggatgctcgttggaaatcagcgccggatacacgcgggcagacacaccggcctcgccattctccaccacggccagcagcttgatgaccttgttttcggcggttgcggcagcaatatcgtcggcggtgatcttggtgatgccctcaacggacacatcatcgatggtcacgttggtgtggaagccgagcgtggccatgatggccgccttgttggccgcatcgtagccttcgatgtccccggtcggatccgcttcggcgtatcccttggcctgagcgtccttcagcacgtcgtcgaaatcaagacccttggtggtcatttcgtcgagaatgtagttcgtggtgccgttgacgatgccgagcatgctcgtcaccttgtctccgacgagggattcacgcagtggcttgaggaacggaatagcaccgcccacggaagcctcgaagtagatatcgacgcccttggcttcggcggcggcatagatttctggaccatacttggccaacagcgccttgttggcggtaaccacggaagcgccggattcgatggccgcaagcacgaacttgcgggccacgccggttccaccgatcagttcgaccacaatgtcagcattggtggccacgctcatggtgtcggtggtcaccacggacttgtcgatccacgggaacgggtcggtttccgacggatcaaggcaggcgacgccggtcagttcgatcggtcgtccgatgcgtgcggcgagctcatccttctgctccaccagcaggcgtgcggtctgagagccgaccgtgcccgcgcccaacaatccaacgcgaatcggcgcaacatcttcctgtaccaaggcatcctcccttgaatgtgaagtattggtgtaaccctgcctattgtacggtcccgatatgacgtaagaccgcgaaatcatacgaaaatggacggtttccgagctttgccccgaaaaccgcccatactgcatccacgctgcatccgtaatttgagacgaatcgccatgaacaatacgaaacacgagcgaaacgccacgaatcgctattcgctcacatcccaatccagcagatcatcgaccgtctgacggcgaatcatcacatgcgcgtcttgctcggatacggcaacaaccgcaggaatcagcgcctgattgtagttgctggccatcgtgcgaccgtatgcacccgtaacaggcaccgccagcacgtcaccacgctgaatatcggcaggaagacgcacctcgttgacgatgatatcgcccgattcgcagtgcatgccgaccacacggcacagcttggtttcgctggaaccctcacgattggcgattctcgcagtgtaatccgatccatacaatgccggacgaatattgtcgctcatgccgccgtcgacagacacgtacacgcgttccgtaaccggattgccagccttgtctttcgcggttccggcaagctgcaccggcttgaccgtgcccacacgatacagggtgacgccggtcggggcgaccgtccaacggcccggctcgaacgagatgaccggagcgggcatgccgagcgcacggttcacggtggtgaccgcatcggcaaggcgggcaagttccgtatcgagatccatggaatcctcgccatcggtgtaggccacggaatagccgccgcccaagtcgacctccggcagggtgtatgcgtcggtggcgtagaaggtcttgcgcagcagcatcatgcgcttcgcggcctggataaaggcgtccgcatcgtgaatgttcgatccgatatgcgaatgcacgccgaccagttcgagcacgtcctgatggcggtagatctccttcaatacggcgagcgcggggccatcagccaccatggtcatggcttcggcgagtttgcggtcgccttcggaaaccttctcgtggctcatgtcgtacgggtatttgatgtcgtactgcagttggcgttctgcgctttcgcccggagtggcttcgctttcgcctaggcgtgcgttcgaccctgcgggggtcacgtcagccaaatcgtcgagcacgttcagcttgcttgcatcggcaccaaccggcagcaaggcgacaccgaacttctggtcctcatgcgcagtagacacgaattcgtggccgcccgcatgaatgccggacgtaacacgcaacatcacgcgagcgcgcttgccgagacgcttggcgatttcggcgatgcgggccggctcgttcggctcgtccaccacgattttggcgaagccttcggtaatggcgagttcgatttccgcatcggacttgttgttgccgtgcagcacgagtcgccgtccgggaacgcccgcggcgagcgcgatgcgcatctcgcccatggtgcaggtgtcgatcagcatgccggattcggtgacgatacggcagatttccttggaaagcaaggcttttccagcgaaactgacgtgggttacggtgttgttgaacgcatttgccgcggatttgacgaatttggcggcgcgggctcgcacgtcatcggtgtcgatgacgtagagcggcgaaccaaattcgttcagcaggctttcggcagtgcggccatggaacgtgatttcaccttgctcgttcacgttggagccggccggccagatgggggtgactgccatggcgatcacatcctgtctggggctgcaacgccaagcaggtcaaggccttcggcgataaccgtcttaacggcgtcattgagcttcaaacgtgcggctgcacgagccggttccggagccttggcgatgcgcagagcttcagcctgttcgccacgagcttccggatcggtgagctccatgggaaccacgcgttccacgttgtaccacttgtggtaggtggcggcgaggtcttccaagtaatgggctacgcgatgcggggcgcgcaggtctccggcttcgcgcagcagggccggccactgggcgagcgcggcaagcacttcgccgtcggcggcggtgtcgagcaggctcacgtcggcaccctcgtaggtgatgccggcagcagccgcattgcgatccacattgcaggagcgggcgtgcgcgtactgcacgtagtacaccggattctcgttggaatgcgaagcgagcaggttcaggtcgatgtcgaccggggaattgtagtcggtgcgtgccaacgaataacgggaggcatccacgccgatagcgtcggtcagatcgtcgatggtcaccacattgccggcgcgcttcgacatgcgcactgccttgccgtccttcagcacgttgacgagctggccgataagaatctgcatgttttcgccaggttcgtcgccgaatgcggcgcacatggccatcatgcggccgatatagccgtgatggtcggcacccagcatgtaaatggcgatgtccgccggatcgttgtcacgatggcgcttgttgcgatagtaagcaatatcagctgcgaaatacgcgtagttgccgtcggacttgatgatcacacgatccttgtcgtcaccatgcttggtggattcgaaccaggttgcgccatccttttcgtaaatgtcgccgcgttcacgcagatcggtgatcgccttgtcgacttcgccatcggaatacaggctgttctcatggaaccacacgtcgaagttcacacggaaatccttcatggatttgcggatttcgtcgaacatcatcggcactgcacgcttgcggaattcctcacgctgttcggaatcgccctcacccagcggattgccatcgttgtcaacgccaccgtcgacgcgcggcaggtcgagaatcgcaataccgtcggcttttgcctcatcgatgacgcgacgtgcgatctcatcgatataagcgcccttgtaaccgtcgatcggggtttcctcaccgtgggctgccgcgaccagcgacttggcgaaacggttgatctgctcgccgtgatcgttgaaatagtattcgcgcaccaccttggcaccgttcgcctcaagcacgcgggccatggagtcgccgaccgcggcccaacgggtgccgccgatatggatcggaccggtcggattggcggacacgaattcaagattcagggttttgccggaaagatggtcgttcttgccgtagttcgcaccctcgttaagcacagtgtcaaccacggctgcggcggacgcggaatcaagcacaatgttaatgaagccggggccggccacttccacggacttgatgccatcggcattggcgagttccgcggcgaacagttcggcgaaatcgtgaggcttcatgccggccttcttggccagctgcatggccgcgttcgatgcccaatcgccgtgtgcgcggtccttcggacgcatgacggcgaatttggcctgcggagggatgagatcggtggtcagggtgccagccttgccttcattcacaaggttgttggcaatattgaaaatcagttcactaagcgcttctggactcattcctccaagtctaccgattatgcagacagaatcagccttgcgtatcgccccgcgtatcatcctgcagttcgccatgcttcctgcgccaagccaccgaagcgtaatagccgatatagcagatcgcaacgaacggaatcatatacagcaatgtggaacgctgcgacgaatcgcaaatcaccaaaaccaacgcgccgatgcacatcacaatcgcagcaatcggcacgaacgggaaaccgggggcacgatacttcaaatcgtcagccgaatgcccttgatcaagccactgcttgcggaaacgcaagtggcagacggaaaccgacgcccacaccaccagtgtggccaagccggaaaccgcaaccaacgccaaatacaccgtcgaagcggcaaccacggaagacaacaacgccaacagcgatccagccatgctgaacagcaccgcgaacacgggcacaccatggaaattcgtcttgccgagcacgcgcgggatcataccctcctgcgcaagcgaccagaccatgcgcgagcacacgtacaagccggaattcgcagcggaaagcactgccgtcaacaccacgaaattcatcacatcgccggcaaacggcatgccgatcgactggaacacgagcacaaacggactcgtgtcgacgcctgaccgatgccacggaatcagcgcggacatcaccgcaatcgaaccgatgaaaaaaatcgcaagacgcaacaccgtggtatgcacggccttcggaatcgcctgcgccggatccttcgtctcccccgccgcaacgccaacaacctcagtgccggaaaacgcgaacaccaccgtcagcagcgtcgaaaaaatcggcagcacaccattggggaaccagccgtcattatagaaattctcaaacagcggtgcgtgatcgtaaccggcaatcggaatcgcaccaaacatggcaagcaagccgatcacaatgaacacgataatcgcaaacaccttaatggatgcgaaccagaattccgactcgccatacagcctcaccgacagaatattgagcatgaacaccaccgcaatgaaggcggcggaccaaatccacgcgggcgaatcaggaaaccaacgttgcatcagcagaccggctgccgtgaattccgaagcgagcgccaccgcccaattcagccagtacagcacggcgatggtgaacgcggtgccggggccgatgaaacgcttcgcatacaggtgaaagctgcccgcatacggcatggccaccgacagttcgccaaggctgagcatcacaaaatacacaagcatggatccgatgccatacgcgatgatcgcgccaagagggccggcttggtgaatcgtgtagccggagctgaggaacaagcccgtaccgatcacaccacctagcgaaatcatggtcagatggcgggtttccatcttgcgttcaagaccgccctgctcggcttcagcggattcagcggcgtcagtgtctgcagtggatgcgttgacttgcgattcggccatgcgcgactgctccttcatatttggatgggcgcgttcttgcgttcttgcgtttgcatgcgtttgcacaatacccaatcgcattactatacggaaatcggtggaatcatgttgcctgccgttcacttttagcggcaatcctgagattgcataaacaaaaaacaggctcgcatgcagcgtaagaaaccgcatacgagcctgaaaaaggattttctggagatttgcaatcagcgcactgaaatcagagcacggcgatggcgtcgatctcaacgagagcgcccttcggaatgttgttgccgccgaacgcgacgcgggccggcttcacggagccgatgaaggtctgcgcatacacgtcgtcgatctcgtggaagtcttcgacgttcttcatgtagatggtggcgcggcagacgtgttcgatgccggtgcctgcggcgtcaagaatatgcttgatgttcttcagtgcctgggctgcctgctcgccggcggtttcgccagctagttcgccggtgactgggtcgatgcccagctggccggagacgaacacgaaaccgttggccttcacggcctggctgtatgcgcccagcgccgccggggcttcagaagtcgcaaccgcttccatcttctcgctcataatgttctcctttgaagaatgtgttatgcatgttgcttgcgttcaggccgcggcaaaccacgacaacgcaatctcaagcaatcactgtacccatggaatcgacacgcattgtcccatgttccaaataccggctccctgccccggcccttcacttgtctttgtggtgggcttgatggggatcgaacccacgaccttctgttccggagacagacgctctatccactgagctacaaacccgtgcgtcaaactactttacactgccttgagatgaaagcgacactttttacggaaaaacgatcttcgaatctcggatcattattgcgaaaacatagctacggcgggtctttcgacagcacgcccaaccctagaggggaaataacgggcatagaacggggaaggaacgagagatagcgtgcgccacaacgaaatttgtagcaacataacaccatttgaagcgtcttttccactaaactgaaaatatggttgaggattcaggcagaaatataggcgatttcgaatacacgcgccgttttttctgccgtgccctgccgacgcagttggatgataacgacagtccgacgctgatcatacaaagttattacgtgcatcaggataattacgcgctgcgcgtgcgattgaaaacaaagtccgtccgcattgccatgactccggacctcgacccgctggctgtgctcgaaaagtatcgcgacgaattccggcttggatcagtcaccgtgaaagggccgtccgtgggaggcacgcgatatgaggcgagccgcgatttggattcgcgcatcgcaggggagctcatcaaacgcggcggacacgtgaccatcaaaaaccgtttcaccgactggatcgatgaggacggctggaacatcgacgtgttcggaggcaccaacgctcccctgatcattgcggaagcggaacgtatcgggccggtcaccaatctggtgatcccgaaattctgcaccaccgaaatcaccgaccaatcgcggttcagcaatgaagggcttgccgcgaatccatattcacgatggaaatccgaattcgaagacgaactggaagcagacggaccgcaattcctcgactatttcggcaccaaccgtatggaataagtctttttttaaaaaaaaacaaccgtaggccgtaaagaacgatgtagttgcgcagcctacggttgagcggtacctaaacggtacctaaagtcaataaacgagtcagtacatgagcgtggcgagacgacggcgggcgcgcttcaaacgctcgtcggtcggctcaggaatcgtgaaatattccagcagacgcttgcgcaccggttcaatatcggccttatggccggccgcaacgaaatccagcaaacgatcgaacgcatcctgaatctgaccgccgatcatatcaatgtcagcgacggcaagctgtgcttcaacatcatcgggattgtcggcagcggcggcacgcacctcacgcacgttcgcattggcggaacgggccaacagcaacgccttcgcacgctcgcgggcggcacgcgcatcgttcggatcggcttcaagcaccttctcgtacgcggctgcggcgccagcgtaatcgccctgctgtgccagcatatacgcctcctgatgctccggaggcacctgctcctgggcgctggcagcggaagccgagtttgccgcatcggaattcggatcgccggaatacggcgcggaaccggtcacaccggcctgctgcgcggctgcgaccagattcggaatcaccgtatccacgatctgctgcatttcctcagcggacggcaagccctgcaaaatcggcatcggacggccgttgatcaacgcgaacaatgcaggcgcgccctgcacttggaacgcctgcgcgatcgaaggattcgacgcgatatcgatacgagacagctgaatctggccgttcaactggttcacggcattgcccagctggcgtgccatatcgaacaggcggtcatcggtcggcacccacagcagcaacaggatcgggaacgtggccgacgtctgcaccatggcctggaacgtgttctccgtggtgtcgatcacataaccgccggcggccggagcaccaccagcctgccccggttcggccttcacctgatgcttcaacgcttcaagatcgacggctcccgccaaggaaactcccggattaaacggcctttgacctgccatgcttgcctcctagatatcaacaatcaacaacattaagcgcccagcgcaacacacattgcaaacgttcgccccaagcttacgcgcattcgtgcgactgtcacgatcacagtgcctcaacacgaaccggctggcgctcggaaccgactgcagtgatcttcgcgtcagaatttgccggaggcacgtacagcgcgaccacattcacatacgtggttttcatggtgctggtggcctgaccgtcgccaaacagcgctttttccgcatcggaagcaggctgcgactcacggccggagccagctgaacgcgtccattcggaattgatctgcgccaccaccagatcgccaccatccgcggaacgcataacgctgatggcaccgtcaaccggtgtgaacacctgctgctgcgatccctcgttcaactccatggccttctgcacctgttcggtcagatcggcaagcttcgtacgcaaatcgtcgtcggcaaacttctgcgcatactggctggacgcaccattctgcaacacgtcggcatacgcggcgaccgcatccttcggagtcatgaccagaccggtgtctttttccgttccctgctcgctaccggttttggaaatctcgaaactcggcatcttcacgcccgaaaacagtcgtgccacaccccacaacttgtagttctgacgtgcggaatcctggcggaacaccagcagacgcttggactgctggtcatccgtggtggaagtgatggaaaacaccgaacgcggccatccactgtccgtggaaatcacggcctgcgcaagatcagttggaatcgtggtcttgcggtcaagattgcccgtgacctgcgccacatgaagttcgctagtgcgaatctcaagttccggcccctccaaaatcgaaccgagggcgtcgatattgcgatcgttattgcactggtcaagcgttttgagaatattcgtacggatggttttctcttgcttggcggtcagattcggcgcatcttgacgttgcgtggttttcggctgcggcagctgcccctcgcatccgcacatgccaacgaccattcccaatgcgagcacggccgccgcgattacgttgaaacgcttcttcatcacttggcctcctcgttgtcaggttcgtcggacttgtcgttgtcggattcgtcgttttcggatgtttcgttggatccgaccgactcggtcgttacggccatttcgtcaacttcgttgggcacgttgatttcatcggataccgcgaattctacagatcccgaggccgctgcggccgcactgctttcctcttgtgcgagacgtgcgaaatatgcggcaagctcatcttgcgaaatcacggaagtctgttcgaaatcgtcgttttcttcaacaccatcagcggcagcgttctgctgatcggcaacgagattgcgcgcgccgggatcgacaatcgtaggctgcgcaacttcgttttggctattttccgaaccactcgcgcgatgcccagcatgacggcgacgcttacgcttcggcccgctcttttcgctacgggcggcactcgcttcggcgttcttcacccatgcggcaacctcgtcatcgtcaccctgcgtggaaccgatgccgtcaaccatggcaaacgcgcgcttgttgcgacgcttatgcggaggcatggcaaacacggaagccgaaagcaccgcaagtatcgccagcaatccgccggaaagatagaacggcatggcgaaattcagcatcgaacgacggttccaatcaagcgcgaccgagcctcccttgcgattgccataatcgataatcgcaacggaatcctcggcattattcgtattagcacccttgaactgcatatcaacggaaccggcattgcatttgacggtgcgccacatgtcggaatcctggaaggcgacctggccttcggaattatcggcggtgccctgagccgtggtcttcagcgtggacagggtggaccagtcggacagtccggtgacgcgcgtgtatttggatcccgcgatccatccggcgatatcgcgggcggaaccgatggcgatgcacacgttcgcggatttgtcgcgcgacttcgccgaaatggtgacgcgatcgtcaaccaattgcagcacattcggatcggtgaccacatactgtgatcccgtgaccgaggcggacgccgtgacctgtgccgagggcttccaaatcgtcgcgttcaagacgccaagcacgatgcaagcaatggcaagcaagccgaaaataggcgtgacaatgccgcgcataatcttggcgtgtcgcgtgggacccgccttggactgcggcttttcctgttcttcctgcaataaagtcatagcattcactattctacattgcctctctgcaaaagcctgaaaaaactatgaaaatcaacgattgccactaaagtggaacctatgcgcaaatctactcttttcaaagccgtcgcagccgcctgcacaacgatcatgtgcttgggtttcgcggcatgcggaagttccgacacgaagtctgattcctcctccgattcatcttcgtcttcttccgattcctcgtcgaagatgaatcagatcgccggtgtgaccgccacgggcaagcccggtgagaagccgactgtctccttcaaaacccctatgacggtggaagacaacagctacgtcgtattgcagaaaggcaatggcgaccagattgaagacggcgaccgcatatgcacgcagggtatcgccatcaatgtcaaggatggttccgaactcatgagcacctgggagaaaaacacccccgattgctctacggtggtcacctccgacaccagtcagatgactgaggattattacaacattttcaaggatcagaagcttaacgccacgcttgcgttcggtgtgaacgattcgaattccgctggcacctcctatttgatggtgctcacgatcgtgtcgaagtcgaaggatctgacgaaggcaacgggcacgaaggtgcttgacgttcctgccgatctgccgaaggtgacgcttgcgaaggatggcaagccgtcgatcgatatgaacggatacaagggttccgacacgttgatctcgcaggatttgatcaggggcgaaggcgccgaggtcaaggatacgcagaccgtgatcgcgcactataccggctggctgcttgacggcacacagttcgattcctcgtgggatcgcggtgcttcgtcgagcttctcgcttgatgaggtgatcaccggttggaagcagggcttggcagggcataccgtcggctcgcaggtgctgctggtcgtgccgccggaccttggctatggagacaaggattccggcaagattccagcgaactctacgttggtcttcgtagtcgacatcctcgccgcctactgatctacatcacgattcgcttataaaaaactccctgcataacaacagggagttttttataagctagaagagtcgtagggagtcgtcttcggcacctttcatttcgtcatagtcgaggatcaggcagtcgaagccgcggtcctgagcgagcacgcgggcttgcggcgtgatggtctgcgcggcgaaaatgccacgcacgggggccaacagcgggtctcggttcaacaactcgcagtaacgggtgagctgctccacgccatcgatgccgccgttacgtttgatttcgatggcaacatgcttgccactgccgtcgatggccataatgtcgaccggtccgatggcggtcgggtattcgcggcgcaccaatgtcgcaccttccccgatgcgttcgatctgttcggccagatacttctgcagatggtcttcgacaccgtctttgatcagccccggatcttcgcccaaatcgtatgtttcgtcggaataaatatgctgcaatgtcacttcgagcacgtcattggatttatccgccgaagcacgaatgactttctgcggaacctccgtagtcacgtcgtcgtcggcatgttccggagtgatgtctttgatggtgcagggcgccgccatccagttgagtggcttgtacgaaccaagttcggagaaaatcagcagactgttatcggctttgataagcaacacacgcttggcgagcggcaaggacgcattcaaacgcccggaatattcggcagagcaatcagcaacaataattcgcacgaggcactaccctaccatgattgtcgtaagccatgaatcccacgatatgtacaatcctatttttgttttgattaatcttttttttaaaaaaaacagtccgtctgctgcaactacagaatcgcaatcatatgcaattgctgcaatcgcaacagacggaccgtcagaagtatgctaccgagtgctactctgccatcttgacgtcacgtccacgctcaaccgcaacggtgagcttgttcgaatcgaaggagatgaaaccgtcggtcacttcgaaggagcgacggctgccatccggatccaccacaacgatggttccttccttgattacggtcaatacaggctcgtggttgggcaggatgcccattccgccttcagaggcaggaatggtgacggacttcgccgtaccgtgccacacggggtggtcggcggcgacgatgttcacctgcattgtcaatccggccatcacgcaccgtattccttctgcatgtcgtgccacttcttctcgagatcgtcgatgccgccgataccggagaatgcctgctccggaacgtcgtcgtacacgccgtcgcaaatgcgggtgaacgcttcgatggtctcatcggccggcacgtaggagcccggacgaccggtgaacttttcagcgacgtagaagttctggccgaggaactgctcgatcttacgagcgcggttcacggtggtcttgtcttcttcgccgagttcgtcgataccgatcagagcgatgatgtcctgcagctccttgttacgctgcagaatcgccttgacgcggttcgcgcaatcgtagtgagcctggcccacgtaacgcggatcaaggattcgcgaggtggagctcagcgggtccactgccggatagatacccttggaagcgatgtcacgggaaagctcggtggttgcatccaagtgggcgaaggtcgttgcaggagccgggtcggtgtaatcatcggccggcacatagatggcctgcagcgaggtgatggagtgaccgcgggtcgaagtgatgcgctcctgcagggcacccatttcgtcagccaggttcggctggtagcccactgcggacggcatacggccgagcagggtggacacctcggaaccagcctgggtgaaacggaagatgttatcgatgaacagcagcacgtcctgattttgcacgtcacggaagtactctgccatggtcagtgcggtcagcggcacgcgcagacgggtacccggctgctcatccatctggccgaagaccagtgcggtcttctcaagaacgccagcctcatccatttcgccgatcagatcgttaccctcacgggtacgctcgccgacgcctgcgaacacggacacaccgccgtggttctgggcgactcgctggatcatttcctgaataagcacggtcttgccgacgcctgcgccaccgaacagaccgatcttgccgccctgcacgtacggggtcagcaaatcgatgaccttgataccggtttcgaacatctgggtcttggattccagctgatcgaatgccggcgggttgcggtggataggccaacgctcggtgaccgtgatggtttcgtcatccttcttgttgaggatgttgccggacacgtcgaacacgtgacccttggtgacatcgccaacaggaacggagatcggaccgccggtgtcgagcacggtggcgccacgaacgaggccgtcggtcggcttcagcgccacggtacgcacggtagagtcgccaaggtgctgttcgacctcaagcgtgatcttcttcgtggtttcgccctcttcgttggcggtgttggtcagctcaacggtaagtgcgttgtaaatgtcgggcaggtggcccaccgggaattcgacgtcgataaccgaaccctggatacgcgtgacgcgtccagtggtcggctctgcagccgtctcgggagccgctgtggtctgattctcagccatatgcgttcctactcttccttcttattcagcgcgtcggcgctgccgatgatttcggtaagttcctgggtaatcgaagcctgtcgcgaagcgttgagcttgcgggtcaggtcgtcgatcaggctgcgggcgttgtctgtagccgtatgcatggcgttctgtcggcttgcagtctcggatgccgccgcggtgagcaggcattcatgaatacgggactggatgtacttcggcagaatcgcgtcaagcacttcgtcgacgctcggctcgaacgcataaagcggggtcgcggcatcggcatcggattcgggcacagggccggagtcctgctgttccggaagcacgagttcaacgggcagcatacgcagcacgcgcaccttctgaacgaccatattcacgaattcggtgaacacaatgtagagttcggaaactccaccttcgctcgccggcttcatgtaggcgtccatcagtgccttcgagatggactctgcgacttccacgccgggctggtcggtatcaccttcccaagtaccggcaacatcacgattgcggtacttgtagtacgtcacaccgcgacgaccatacacatacagttccggctgcttgcctgccgcatcgaggcgggccagcagcgattccgtttcgcggatgatcgaggaggtgtacggacccgccataccacgatccgaggtgagggcgaggacagccacgcgagggttgtcctcgtccttcttcacgatcggatggtcgatatgggtgtgggccaccagcgcttgcacggcgtcgaaaatcgcatcggtatacggcttcgcgttcaaggcgacgtcacgtgccttggcgatatgcgaagacgcgatcatctcctgcgcgttgaagattttctccaacgacgcggtggaggcgatcctagatttcaatgcgagttgcgagcccatggatcacttctctcctgcgacgatcttttcctgctcgaccggggtggcgttcttgacgttaggcttcttctcgaccagcggcttgcccgcgctggtcacgaaagtctcacggaacgcttccacagccttgtcgagggcagcctcggtgtcggcggtgaaatcttcggtctcgcggatggtcttgagaatatcggtgttgtggtccaggtagtccagcatggccttctcgaacggcagcacgtcgttcagcggcagatcatccatcttgccatgggtgccggcccacacggagacgacttcctgttccatggaatacggggagaactgcggctgcttgagcagctcggtcaagtgggaaccacggttcagctgggccttcgaagccgcatccagatcggaagcgaacatggcgaaggattccagggaacggtactgggccaaggagatcttcagcgtgccggagaccttcttcaacgccttggtctgtgccgcgccaccaactcgggacacggagatgccgacgtcgacagccggacgctggttcgcgttgaacaggtcggactgcaggaagatctgaccgtcggtgatggagatcacgttggtcggaatgtatgcggacacgtcgtttgccttggtttcgacgatcggcaggccggtcatcgaaccgccgccgaggtcatcggaaaccttggcgcagcgttcgagcagacgggaatgcaggtagaacacatcgcccgggtatgcctcacgtcccggcgggcggcgcagcagcagggagatcgaacggtaggcttcagcctgcttcgacagatcgtcgaagacgatgagcacgtgcttgccgttgtacatccagtgctgtccgatggcggaaccggtgtacggtgcgatgtacttgaagcctgcggaatcggaagccggggaggccacgatagtggtgtactccatggcgccggactcttcgagggactgcttcaccgatgcgatggtggagcccttctggccgatggccacgtagatgcagcggacctgcttcttcggatcaccggattcccaattacgcttctggttgatgatcgtatcgattgcgatagcggtcttaccggtctggcggtcgccaatgatgagctggcgctggccacggccgataggcgtcattgcgtcgatggccttcagaccggtggacattggctcgtcaaccggatgacgatgcataacgtcaggtgcctgggcctcgagaatacgacggccttcggtcttgatctcgccaagaccatcaatcgggttgcctagcgggtccacgacgcggccaaggtagccgtcgccgacgggcacggagagcacttcgccggtacgacgcacttcctggccttcctcgatacctgcgaagtcgccgagaataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcagtcgcgacataaccgacttcctgagtcggggtatccgacggcttgtacgactcgacgaactcatcgagcgccttgcgtatcgtggtgggatcaatggtaagttctgccatgatcactccttattgttgtttataaattcagtcaagtcttgtttcaggcttgttcaccgtgcggcgaaccgtcaggcggttgccttcaccgtgcgctgaagatgctgcagctgtgcgaccaccgtgttgtcggtgacctcgtcgcccacctggatgcgcatgccacccatgacggtcggatcgaccaccgagttgatgtgcaccggatgaccggtcttcgccgagtaaatggcgatgagcttttccacctgctccttgctcaacggcgttgccgtggtaacagtgaccatcgattcgcccatatggcgggagaatttgttgatcagccactgaatggtctgcaagtagcggcgattgcgcagattgcaggtcgcgtgttcggccagacgcttggtcaccttggtgaaatccgcgtctccaatcaggctgtacagcagcttgacacgggcttcactggaaacggttgcgtcatacagcttggtacgcacgaccggaaggttgagcagtgcggaatgcaactctgcgagctcgatggagacttgcaaagtcgtattggtgtaatccgcgtagtacatcatgccatcaacgccgaaatcctcaacggcattggcgatatcagacacgcggctccaacggcgagacaccagatcggacatgatctccatcacgagcggatgggcctggtctccgatcagagtcttgactaccgcaaccttgtcttcgactgggcgcgacgggtcggtgagggcacgttcaagctggatattgtggtcaagcgcgctggtgatcgtgaacagttcgttcccgatacgccatgcgtcctcaccgctgtcacgcagcttgggggccagcgagtcacgcgatacgcggtctgcgatacgcgatgcttctcctcgcattggtcacctccctttcttgaaggtttcgatcacttcttgtcgctgtccaagtcggcgatcatctggtcgatcatcgacgactgcacatcgtcattctcgagcttgctacccaggatcttgccggccagtgccgttgccagcacgccgacctcacccttgaggctcaccagagcctgctgctgctgcgattcgatggaacgctgggcggtggcggtgatctgcgccgcatcgttttcggcacgagtgcgcgcgtcagcgatgatatgcgatgcctccgtacgtgcgtcgtcacggatcttggatgcctcgacgcgagctttgctcagctgagcctcatacttcgccttggcttcatcggcatctttctgggcctgttcggccttggcgatgccaccttcgatcttggcagcgcgctcatcgaacacggcctggaacttcggcaggaagaacttgtagaagaacacggcgacgatgatcagaatgaccaacgaccagaaaatgtcgtagcttttcggaaggaacaattccatttcgctagctgcggtcaccatagtgtcttcctcctttcatgttcgtttgcgtcttcggtgttaccttgaatcaagtcttacttgatgaaggcgagcacgaagccgagcagtgccagcacctcgacgaatgccagacccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacaattaaaaagccggcggtcagtcgatctccggatagctcatattgatgtatgcggtggtcaggatggcgaagatgtaagcctgcaggcaagcgaccagcgcttcgaacaggaacatgaacatgccagccgcgaaggtgacgacgccgaatggcatgaacaccttgttcaccacatcaatgaggaagtactgcgtggccgaaaggcacagcgcaagaatcaagtggcccgaaaccatgttggcgaacagtcggatcgtcaacgagaacggacggataatcagcagctcaagcagctgaatcggggacagcagaatgtagatcggggccggaacacccttcgggaagatctcatccctcaggaagtggccgaggcccttttcacgaatgcctgcaatccagtattggcagaagcaccacatggcgaataccagcggcagcgtaatggttgcgcttgccgcgatattgaagcctgggatgatgccacacagattgaagaccaacaacgtgcagaacacggtggtgatcatcggcacataacgcttgccgcgcagctcgcccatcacctgatagacgatgttgtcacggacgaattcgatcaaccattcgactgctccctgccaacggctggggatgagctttgcacggcttgccgtaattccgagaaccagcaacatgatgacggtcgcaaggatgcgaacgaggatgatgcggttgatggcgaacggcgtgccctgaaaaacgaacggatcgggaaggaagtcatcgacactgggcatttcgggaccatcagcgatggtcagcatgccctttcccaatgcaccaatcattcacgcctcctgctcttgtgtcagctgttagtttaacccaacaaccgagtcgaatgtgacgttctggttacttaaccaaagcgtacttcgaagtgcgcgtcgacgcgaacggagtcccgtgcgacgcattcgactccgaatggctggataggattattagcccgtgtctagacaacatccacacacttgggcttttccatactcccatttggttttcccggcgtttcgcagcaagctgtactaactagacacagctttgtgaatcgtcggatagccgacgcaaccaatagtttgttttacgaaaacagcatattgataaaacgtttcaccaagtatatcacatataacacaggtgttgcatataaagaaagaggggccgcatacgcaagcccccaccagtaaacagccgtaaagtcacgcgccaatcacggccgcacgtcaatcacatcaatacgcggatcaatccacaaatcaatcgtgaatcacgccataaccgtcacgcacgaacggcgcaaacgcgtcgacacgcggcgaacccggctgatgacgaatcgaacgatccgtgccaagacgcttctgcgcacgaagctgcggaacctcgctcaaatcgtatggcgtggtctgatacacccaattcagccaattgcgccacaggagattggcatgggcgcgccacgcgaacaccggctccaactgcggatcatcatgcgggaaatagttttcggggaacggcacattcgtcatgcccttcttcatatcacgctcatactcctcggccaaggtgtacttgccgtactcccaatggccaagcgcgaacacttccgaaaaatcacgggtggcgatcagcccaggaccggacttcggaccccacgtgagcacctgcaactccggattgcgcgcgatatcaccctcgtccacccccgcaaggcgagaatgcggctgcaggcaaatctcatcgaagccgttcgtcaaaaagcagtattcatcctgcaaatactgcggaaacacgccaaaaatcttctctggcaaattctctttacgcacgttatagcgataattgagcgcacccatcgcaccccagcacaaatacatagtggagaacacatgcgcggaagcccagtcaagaatctgcttgaactcatcccaataatcgacctgttcgaaatcaagatgctcaacaggggcacccgtcaccacgaagccgtcgtaatagttgtcttggaacgcctcaatggtctcatagaacttcaccagatggtcggcgctcacatgcgtaccctcgtgcgtggaggtcttcatgaaatcgatctccacctgcagcggacttttcgagatcaaacgcagcagctgcgtttccgtctcgattttcttcggcatgagatttaagatcaccagcttgagcggacgcacgcgctggcgctccgcttcaggcttttcaagcgcgaaaatacgctcggagtcgagaatgtctctggccggaaggccgctggggatcttgataggcatgcttctattatggtgcgggctcggatatggcgcacttccctgcccccacgatcagccgaaaccgttataggaaaaatgaataacgcgctatttgcaacgcggttttgcatggccggactgatgcgacacgccgatttgacatatttggaagtaatcgtaaagttaatagagctgtcttaaagacaagccgacgcggggtggagcagctcggtagctcgctgggctcataacccagaggtccatggttcaaatccatgccccgctaccaacgcctcgggcttcacatgaaagaagtccgaggctttttctatatcctcaaggctccatgccactcgcctagtcatcttctgtgaaatcgaagacctatcgacaccaagagcgttcgccagatccttttgtttgacattgcgaagagtcatggccactttcatatttcgagtgactatatcctgcaaactgacagattcggcctgagctgcgaccttagggctgattattgctgttgtcatagcacataagtttagcgaaactaacaaaaagatagaacacgacacgccgaacgagcaggtctaactatattcgtggttagatgtgagtgtgacaaacattttagtagattcgcccactgtaggtgaaaaggtcaaacgccttatgggactcaatggcctgacacaggcagaagtcgctgaaatattgcgctgctcacggtccacggtctcgcagaaatgcactggccgaatcgctttcagcgcgaatgagataaacgagcttgccgaactcttgcatgtcagcgccgatgtactccttgggcgagctccgttggaggtgaaatgatggattggcaccttgttttgtcgtcgtcggcatttgccatttctgttgcttcgctcttggtgtcgcggcacgcttggacgatcgcagaggaagcgaagggcaaggcccgtcactcgttgagagtgtccgtctattcggtcgaagttaaccgcaagcggcttggtattccctatgaccatgatgtggttgaacagtacgaggccaatgagggcatttttgccagcatgggtgtcggttcctataaaggcaggcgatgcaaggattcggacggtatcgtgcagtccgacgacgccgtacaggtgttctcggacggcacgtatcggattgttcctaggacagaatctttctctgttctaaagcccgttttctgtcgagttcatggaacctgcgatgacccttcctgtccctatgccatctccgcagtcgttccaagggtccgcacttccatggttctatgcccagcaacgggaactgtctatatcgacaccggcgcagacgagttggagatgatacccaatgcacgccaagctctagtttcgtcagatcgggttcaatgtcgcgactcgaatcgcggggcggtgtgatggtgacccagaatcgcattgtttcgttggtcaactcgactattcgaccggtgttgttcatgatccatttggtttgttcgcccagcaccgtttcgcctatctgccggcagtcccacacctcggcatcgcagtttatgccaatggctttgacgttgagtgcccgtccatccccgcagttggccagccatccgatgaaaaccgggtcaccgtcggcgcgtttgaactcgggaaacaggagcatgtcgccttgcacctgcacgaaggcgggttcggcctcggaacgccaccgccatgcgcgacggtatgtggccaacgatacaaggaacgccagcacggcgataaccacgctcgccactggcgcgttggctttcagtgcgtcgatggcgttcctcagtagctcgaaccgtgtcaggtccacgtccatttattcttccttccttcgttgtttgaaaggtttggtttgtgcgattacaagcctatcgctgcggaggaaggagcctaaccgtccatccatgaatcaaggagcagtgaaatgagcgttttcaatccggaatgcgccagcaattacttccaggtgcaggacatcgacccgtcggaatgcaccggcggcaacccctacgccttcaagtgccgcatcaaggtggccggaagcacgttcgggttcgatggcttggacatgggcgaccttcagacgatgaagggcgcgatcaaccaggcgatgacgcacgcgcgtcgagctcgccgtgaatgggaaggagcccaggaatgagcgtcacagtcaaacgtgtggacaggaaaagcagtcagcgtttttacgagctgatcgttgagacggcagaagtcaccgtgcgcgtcccgttcaacggctacgagcttgacgatcttgagaaacagatcgaccgatgcttcaacgaggattgacgtgaaacgtttcatcaagttcgttcttctgattctgctcagccccttcgtgttgttcatgctggggctggtgctcgcgatcgtccgtctgggtgatttcctcaccgacgacgactgacaaaaacgaacggcatatggggcgtatggcgtacccctgccaccgctgagccgggttagcgaccggtaacgccaggcgcgtggctatcgcgccatttgcgagacgaaatttagctcccgaccctctcaggccgtcgattaaggcggaatcgggcgaccatagacggcttcggccgtggcctgattggggaccattcccggcggcttcggccgctcttgttatcgacggcgcggctccgaccgaaacgttctgcgagacctttggaatctgttgacggcccggccggggaatctcggccgagcgttttcatcagcagattctaggtcttgacctctcaagcgctcaccaaccgaaagctacgaatgaatggagattgagaaatgagcagggcaacgttccccgacaagttgaggacgcagatgcggatggctctcccgatgatcgataagaacatcaggtgcaaggccaacacctcgcggcagtctttgatgcaggcgtccggattgaacgacaaccagctacaggccgctctaagaatggcctacggggagaagggcgtgccgagtcccgtctaccgctcacccaccgcaggcaagatgtacgattccgagtcgctgctccgggtgctggcgaaatggtgcgggatgtgggcctatgtcatcgaggattgaaccatctctgcacgaggtgctgaactatccggacgaatcacgcaggatgctcatgcagggattcgccgacaaggttgaccggatcgcaagcaacaaccggcgcaccgacatcgaactgttccaggtctgccgggcgctcggggagccgaacgtaccggccctgctcagtctgtgcgatgacggcctaccggcgtacaaggccggcgcatggcgcatcgactgccgcagtttccgcaaatgggcaaccgcctacacgccataccggccgcagacgaaaccacaaaccgcatatgaaggtgagccactgttttgaaaccgcagattcacatctcgcttgacgtcgaggaccacgacctgccgcagcccggcgatgtggagataggccagaacatcatctgcccggactggccgcgcatggtctggtcggacatctcgaaggccgactggccgattgtcgccgcgaagctggaacagatcgcgctgctgctcagggacaaggccacggcatgacccgcatcagcatgctgaccaccaccgaggccgcgaccagactaaacgtcagcaaacgcacgctgatccggtggcggcagtccatcccgatcatcggaccgccgccaatccgcatcggcaactcgatcatgtacgccgaaccggacgtgaacggctggatactcacccaacgagagaaaggcaaagcatgagaagacagaccgtagatccacgcatcagagcgaaggtcatcgccacatacggcaaccggtgctggctcggcatgccgggctgctccatcaccgcgaccgaggacgaccacatcgtaccgtacagccacggaggcagggacaccgtggccaacctgcgccgcgcatgcaagcattgcaacgcgatgcgccaggaccgcgtgctgtccggatacggcgcgaccctgcacgcggtcatcggacctccacgcgcagacttcggcatggccatgcagtccatgctccgccgtgacagcatcgtggtcagcttcgacagtctgctgcgcgacctgtgcccgacgcaatccaaagcgaccgacgggctgcgcctcgccgccgcgatggcatgggacggcgcggcccgcacgctggccaagagctcggagccgttggacgtgtggctggtgcgcacgctgccacgctcccgccgccatcccgacatgctggccgaatggctggcattggactacgatgtgcacgtcatcgagacaccggccgattccacgttcgctctcgacctcacgccgcaggagtatcggacggcgcagcagtggtacgcgctgcatctcacacagcaggccgtggacgcccgcctcgccgccagacgacaacgcctcgccgctctcggactccgccgcgactctccggccgctcggccgcgatggtgacccgcttttttaaacagtcgacgcccaaaagaccccgcgccaagtcttttctccccccagaaccatgcaaaaaagcatgaaaacgttggaaaaccaaggaaaacacatcatgaatcaaggaacgttggaaggtttcgaggaatacacgcatccctacggcatcagcggccttcaggagcaggcgaccatgaatctcatcaaaagcttcgtggatggcaagacgttgacgccggaagcaacctacatctgcaagtcgatgctctcgatagccaggaacatcgacatccagaacagcaagggacgcgagatcagccgcaacatgacatcactgctcacatggttccaggaactcaaggcgatgtatccggaacagccgcagctcgacccgacgctgaccgacttcatctccgacgcgaaggccggactgtgaccatgctcatgcgcggcggcacgaaacgcgacgaaacgcggccgaccgacggcgcgatcgtcgcacggactgccgagatgctcggcaagccgctgctgccatggcaacgctacgtggccgacgtggccggggaaatcgacccggccaccggaacgtactattacgaccgcgtggtgctttccactccgcgccagtgcggcaagagcacgctgatcgacaccgaggacacacgcaacgctctgctcggcccagaccggaagatctattacctcgcgcagaccggcaaggacgccgagaagcatttcaaggacttcgtgcagcagctctcaaaatcgaagctcgcgccgttcgccctcaagccgaggctttccaacggcgggatggagcagcgtttccgcaacggcagcttcatctgcccattggccgtgaccaaagtggccggccatggcacgcagatggacaaattcaccatcgacgaggcattcagcctggacgacgagaccggcaaactgatcctcgacggcatggcaccgaccatgaacacgagactgcacttcaccggcgtccagccccagatctggataacctcgaccgaaggcacggcagattccacgttcctcaacggcctgctcgactccttccgcgccggtaacgtgccgaaacgcacctgctggttcgatttcggcatccccgacgacgccgaccccgaggacttccagacgatcctgaaatggcatcccgccgccggcctgctctgggacatccgccaattgcgcgacttccgcgagcagttcgccggcaacgaggccggttgggcgcgcgccttcggcaaccggcgcgacaacggagtggccgagcgcgtcatccccgaccagctctggcaatccacgttggccacgccgatcacgccggaccggatcgacggccgacccgtggtgatcgccgccgccgtggacgtggacgccacgaacacgtcagtctccgccgcgatcgtcaacacggacggcaccgtgaccgtgcaactgctcgaagtcctggacggcaccggcatggcacccgccgagatcacgagaatctgcgacacctaccacgctcccctggtcatggactgcaagggaccaaacgccgacctgcacgaccggctcgcatccatgaccgacgaagccggcgatccgcttatcgacttcatcgccatgcaatcatccgactacctcgcggtcggccaggcattcgtcagcggcctgcggaacaagctgatccgccacgccgccgataccgagctcgacgcaagcgcggccaactgcgcgaggacgtggagcggcgacgcatggcgcgtcacacggcgcggcagcaccgggctgacctcaccgatcgaatcatgcatgctggccgcgtggggcgcgcatcacctgccatctgactgcacgttgcaaatcttctgacgtgtcaccgtttgtcaccgtttgtcaccgtttgtcaccgtttttttggcagtgacggaaccacggccatatcctcggcgtcatgaatctttgggaacgcatgaggctcgcaggccgcgtgctcacgcgcggcgcggacggcacggacatgccggacggcatcaagccgccgaaacgggggccggccaccgaaccgttgcaactctcaaccgtgttccgtggcgtgcaggtgcttcagaccgccatcaccggcctgccgatcgtggaacagcgcggcggccgtgacctgccggacgtgagccccatggtgttgcagccggacgtgagccgttcccgccgtgatttcatcgccgacatcgtggcctctctcgtgctcgacggcaacgccttcacgcgcatcgtgcgcgattggaaaggcgagatcgtcacctgcgagatgctgccgccgcaatacgtgaccgtcaccgacgaaagcgacgacccggcacgccccgacttgcggttctcctatctcggccatgcctacaccgccgatgacgtcgtgcacagcaaattcctcaacgtgcccggccgactgcgcgggctcggccccatctcggcggcacgcgaggagatcgatgccgcgcagctcgcccgcgactacaaggcgaggttcttcacggacggctcgaacctcaagggctatctgcgcaccaccgagaacgtcacgaaggaaaccgcgcagatagcgaaggacgcatggaagagcgacggcacagccggagacatcaaggtggtcggcaaagccctggaatatgtgccactcgacatgaaacccgccgacctgcaattccttgagacccagaagttcgacaccacgcagatcgcccgtctgctcggcatcccggcaagcatcatgctcgccgccgtcgatggctcgaacctcacctacagcaacatcgaacagtcgtggatagagttcgccgactacacgctggccgcctataccggcgagatcgaggagatcttcaaccggctcctgccgcgcggccggaccgcgaagttcgactgggacagctcgcagcgcgcgaacatgagcgaccgctacacggcctacaagaccgccatcgaggccggtttcctcaccgtcgatgacgtgaggcgcaaggaagggctgccggcactcggaaaggaagaagaccaatgaacatcgagaaacgcgaaatcgcctggaagggcctgacgctccgctcggccgatgactccggcacctcgaccgtggaaggcgtcgccgtgccgttcggcgacatcatcgacacatgggacggtgcggagaccttcgaccgtgattgctctttcgagggacttgacgaggcgaaactgtgcttcgagcacggcgagaccatcggccgcatcaccaaagcggaaagcacggacgacggactgcacatcaccgcgcggatcagcgacacggcacgcggccgcgacgccatgaccctgatacgtgacggcgtgctcgacagcttctcggtcggtttcattccgctcgaatcgcagaaggaccgcgacggcatcacccaccgccgcaaggtccgtctgcttgagaccagcatcgtgagctggccggcctaccagaacgcgaaaatgaccaaatcagcggcaccagccgtggaacaaaggaaggaaaccatggagaacaacaacgaactgatggacctgatccagtccatgcaggaggagcagcgcggcatcaaggccgagatcagcaagatgggcgcgaaaccggcaccggctgccatcggcgcggcgtaccggagccacggcgaatacatgcaggccctcgcgcgaggcgacgaacaggccatgaccgtgatgaaggaatgccgcgacctgatttccaccaaggacaccggcaacaccgccacctggatcgccgacgacctcaaactgatcgaggaccgccgcaaggtctcacagctcctgacccatgacacgctcccggcgaccggcatgagcatggaataccatgtcgtgacctccgacaccacagccgtcggcaaacaggagacggaaggctcagagctttccttcggaaaagtcgccttcggcaccaagaccgccgacatcaacacctacggcggctacacttctttgagccgccagaccatcgaacgcagcaccacgccgatgctcaacaccgcgatcaccgcattgcagaacgcctacgcgaaggccaccgagaaggcagtgcgcgaccacctgtacgcggagatcaaggcgcagcgcgacgcatcctctgacgccaacaagatcgacgcgccacagttggccaacatgaccatcgacgattgggtgtcgctcatcatcgacgcgtccgaactggccgacgaccgcaacgtgtcgctgacgcgcctcgcggtctccaaggacgtgctcaaggcactggtgaaactcaaggataccggtgaccggttcttcaacctcagcggcgacgggtcggacaccatcggaagtttcgacctgaccggcgtggccggcacgttcatgcgcgtccctgtcgtgctgctgccgaacgccgatgccggattggccagtttcatcgatcccgccgccgtgaccgtctgggagtccggcggcccggcgcagttgaccgacgggaacgtgaccggcctgaccaacagctacagcgtctacgggtatatggcggtggccacgacccatgcggacggcctgattccggtgaagttcgccgcggcatgatgatcgatgacaacatcctgctgcaacggctccgcgacgaggttggagtgccggccggagaggacgaacggctcacggtcaaactcgcggcggcgaagcgatacgtcgcgcacgcggtcggcaccgccaccgtcgatgacgatctgctggccgattgcatcgtctcctgcgcggcggacctgttcaacatgcgtgacgcgcgcctgggcgtgatggacgtgggcgattcgactgtggaaccgttcaggatctccaccgacccgctccgctcggtctggccgaaactccgcgccgccggcgtgctcaccgggggcatggtgattgcatgaacatccaggaacaacgagccgcgctgatgaacacgctcaccgacatgctcgatggactggtcagcagcgtcagcatcgacgcccaactgatccgcccggcggccggcaaagtcgcggtgttcatcgaaccgccaaccgtggaatggccatcatggggcccgccggaaccggtctggacgttggacgtcatcgccggcacgccggccacgcagccatccgcagtcgatgacatcctcacagcgctcgaccggctcgccgaacgtggcctgaacatccagaaggccacgcccgcgacttggaacctcgcaggagccggcacgctggcggcctaccaggtcgtgctgaacgctctggaaaccgaataagacaaggaaaggaaaaaatcatggctggaaagatccgcacgctcggaccaggcatcttcaaaatcaccgacaccgaaaacggcagggacttcagcgccgacctgaccaaggcgcagctaaacccgtcgaacagcagcgacgacccgaccacctacctcgacggatcagaggagacgaacaccacgacaacatggacgttcgagggcaccgtgggcgacgacttcagcgaggacggtctggccgtctggctcttcgaccacaagggcgagacgctgccggcccagttcgtcccgaacaataccggcaagatccagtggaccttcaacgtcaccatcgcgccaatcgccatcggcggcgacgtcaaatcgaagaacacgaacgatctgagcttcgccgtcacgaacgtcgcccacgcaccgtacacgggcaagtgatgagtgatggctgacaaggcattgatggtcgtcggccagaaacgcttcgttcagacgatgcgcaaggccggcgcggacatggacgacctgaaggaagtgaaccgcgcggcagcgcagatcgcactgcccgccgtccgcaacctcgccccacgaggcaaaaccggccggctggccggcagcctgcgtgtcggagcgacgaaacgcgccggcgtcatccgcgccggccgcaaggccgtgccctacgcaggaccagtcaactacgggtggcccgcccgccacatcaagccacgtctcttcgtcaacaacggcgtcgcctccaccgagagccaatggcaaaaggtctacaaggacttcatcgacgagacactggagcaagtgaaaggaaaataatggcaaccacgagaatcacctacacggacggtaccagcgagaccgtgccgatcacgatgcgcgcgacatgcaaggccgaggcgcacgccatcgacatgggctgggggccaatcacccagtcacccgtccgttccggcgcatacgcggcctacgcggccctgcgcatggccggccgcaatctgccagacttcgagcattggctggacaccgtggcctcattcgacctcgctgccgcgaaggaggaaccggaagagggaaaccctacggactagccgcgtggccccaagactcgcttggccgtctctcattcctcctggcgagccgtttcggcggcacgccatggcagtggaggaacgaggccgacgaattggattggggcaccggactggccgaactgctcaaagaagccgaatcacggaaggagtgaaccatggcgcacagcgcgatcatgagcgtgcgcatcaccggcaacgccgatgatgccgtcaaggcgttcgagaagaccactacgaaggcggccgctttcggcagcgccatcggcggattggccgtcaagggcgtgaccgcgctgtgggacacggtaaagggcttcgccggcgatgtggtgaacatgtcggacagcaccgacaagttcatgaacaccatgagcttcgccggcatcgacaccaaagccgtgcaggcagccgcgaaggaaacccgcaaatacgccgacgacaccgtgtacgggctcgatgacatccagaacaccaccgcgcagctcgcggcaaacggcatcggcaactacatggaactgaccgaggcggccggcaacctcaacgcggtggccggaggcaacgccgacagtttcaagagcgtcgcgatgatgctcacccagacggccggcgcgggaaaattgaccacggagaactggaaccagcttgccgacgccattccgggcgcgtccggcaaactccaggaggcgctgctgaagaacggcgcgtatacgggcaacttccgcgacgccatgtccaagggcgagatcaccgcagacgagttcaacaaggcgctcatggacctcggcatgaccgacgtggcgaaacaggccgcgacatcgaccagcaccatcgagggagccatgggaaacctcgaagccgccgtgaccggcggtctgaccgacgcgttcaacctgttcaaaccggccgtgacgggcggcatcaacgccgcatcggccgccgtgaccagcctcgctaccaccggtgtccagggattgcagacgttcttcggccaggtcaaggacaccggagcgttcacctcgctgcagtcgtccgcgcagtcggtcggcggtggactccaatcactgtggaccggcatcatggccgtcgtgaacgcgatgaccggaggacagcccgccggaaccgcgttcggcaacgcactcaacaccgtcgcaaccgccgcgcagacggtcggcggctggctgaagaccgcaggcaactggatcagccagaatctggatcttgtgaccccgctcgtcgccgcgatcggcggcgcagtggcagccgtcaccgccgtgaccaccgcaatgcaggtcgccgccgtcgctcaggcggtgctcaacgcggtcatggccgcgaacccgatcatgctggtcatcacgctcatcgccgcgctcacggccggactcacctacttctttacctgcaccaacaccggccgggccgtgtggtcgagcttcacgagtttcctgggctcctgcgtgcagggcatcaccggtttcttctccggcctcggctccaccatcgtcggcatcttcagctcggcggcgaacggtgccaggaacgcgtggaacggcgtggtcggctggttccgaggcctgccgggcaccattggcggtttcttctccaacgccggcagcatcctcgtcaacgcaggcgcaagcatcatcaacggcttctgggacggcctcaaaggcgcctggaacaacgtgaccggctggatcagcggcatcggcgactggatcaaggcccacaaaggcccgatcagctacgaccgtcgcctgctcatccccgccggccaggccatcatgaccggcttcgcccagggcctcaacaccgggttcgacagcaacgtcgaaaccgccatcggccgcgccaaccgcagactagcggccatgccactcaacctctccgcccaaggcaacacggccacgccagccgtgatcaacacctggaacgtggaaatcaacggcgaggtcatcgacaaggacggcaccgccaaggccatcaaacggctcctggccgactacgacgcaaggaggtcatgatgcagcagtgcttcatgttcatcgacaccggcaacggcaccggctggacaccggtgaacgattccaccaaggatgtagcggccctggactctttcaccatcgattggggaagtgacggcatcgacgaacaacccgaacctgccgtgatgtcgttcaccctccgcgaccgcaccggacggctcgcaggccaggcattgacactggccggcatgaaagtggtcgtccaattctccaaccagcctcgatggatggacctgacgccagcgatgggctgctggcgcgatctgcgcatccccatcgactcgctccacaagatgtattcgccagactcgccagactcgccagactcgccatccgaaacaatgttcgccggcagcgtgtccaccggcggcagcatcgaaccggccagcgacggcggatggctgctcaaactctccgccacatcgaggatggccatatggaaacgcctgcaatcccaaggaccgacagacacggccgcgaaatggaacggcgcgcactggataggcacgccatccgcacgcctcaaggagatgaaccgcagggcctcggcgcagggagcgccggaagcccaactggacgggctcgccctgccgtcaagcgtcgcaccatacacgccatccgaccacccatcgcagctcgacctgctgcaccggctcaccgtcgggccacgactccctcaatggcacgaagtctacgacggcgcggcatccaccatcaggccgctgttcctcgccgacccaatcgccgtgcatctgtcaaccgatggccgactcaacgtcctcaccgacggagagacacgatacgcactctcggcggccgacatcgaggcatcgacggatctgagcatcaccgaacctttgacacaggtcgtcatcaacgcgaaacgcgtcaaatcggacaacggcaagctctctttcgacgacgtggagatcacgatgggagaccaggaccgtctgccaccacaattgaccgtcatgcagaagagcctcaccgtcgattccgacatgctcgccgtggacgactcgggcggtgtatggaacagcggcggcacctcgaacgtcagcgccacggaccgcgccaacatcgcgcaatggctcgaatcgcacgacctgcgcatggtaccggagacagtgacgttcaacagcacgcgaatcgacccggcacgccggccatggctgtacaaggcaagcccatccggcccattcatcatcgtcaaggccaaatcgtcggccctgaccggctcagacggccgaccgtccttcaccggccccatcacgaccatcggcgggacgctctcataccggtggcgttcgggcaagcccacactcacccaggaagcgacgctggccgcgctccggccgctgctgacggaacggatcacatgggccgacctgcccaccctcagctggcagcagctcgacctgcacatctgcgacctctcgatgatccagatcatcgacacttcttcgcccaccgccgaaaaggaaggaacacaatgacagcaacaacacccatctacgggctctcatatccggaaggctccgacctcgtgtcatctgcggcggggtcgttcaaggccatggccgacaccttcgagaccgcgctggacaccgtcgacagacgctccaccccagccggtgcgacacctgtgatcgccaccacgctcgaatcgctgaaggcacagacggccacggtcggccagaccggcttcgtcacctcggacggcgacaacaccggcccgtacatctgggacgggaccagctggcatcacgcacactggtacaccgccgatgacaaagccaaaacaacgctcgtcaacaaatcaggctggaaatgcgaatacatgatgaaacatggattcgtttacgtcacggttaatctttcggacagtggcaccaaaggatggagcgaaagccaaatgccaggcacactccccgaagaagcacgaccgccgctcgaactgaatttcgcaccgatgtgctccaacaacaattcaatcggtgtattcatcgtcaaacccaccggagtcatcgtctactcgcgtcgcggaggcgggcaaatctccgacaatcgttatgcaaccatgatgtggccggccgcatgacggatctcatcatcgccatcgtcggcgcggtcggcgcggtcgtcggcgcactggtctccaccctctcggccgccgccaagaacaagatggaagcctacaggctcgcacagaagatgcaggccgacaaccaacgcctctggcaatggaaccggcaactcatcgaccacatctaccgccgcgccccaccaccaccgccggaaccacctgaagaccttttcaactaagaacggagccaacatgagcgacatcatctggaaaggaagcccgaaccactacgtgggacgcaacggctacggcgtcacccacatcactttgcacatcatggtcggatacctagccggcaccgatgccacgttcgccaaccagtcaagccgcgcctcggcccactacggcatcggcgcgaccggagagatccaccaatacgtgtcggaactcgacggcagttattccgacgcgaactacgcgtctaacaattcgaccatcagcatcgagcatgagggaggaatgtccaacggcgcggtctgcacccaggcgtgcatcgacgcaagcgcgcgcctctgcgccgacatcgcgctcaggtacgggtggacgaaactgtggcacgacgggctgaaaggcaacgtatggctacaccgggagatcccaggcacagaccacctcgcctgccccgacctcgcacccaacggcctgccatacaagcagatcatcgacaaagcaaatcagatactcgaaggaggctccatgtcaaacgcaggagacgaagtatggaactgggcctacaagcccaacgggaagaacgccacaccgggcggcaacatgtacaacctgctcgcctacgagctgccgcagcgtgtccgtgacagcatcatgcaatacagctacaagggctcagcaccgggcggcaacatctacaacacaatctgcttcgagatcccaggaatgctgaaacagctcaccaaaaccatcgagacgcagcagcagcagatcagcgaactgtccgaaaaaatcagcaagctggaagggaccacgaaatgaccgacacgacggaaaaccgactaccgacggccaacacaacggaatatgacgcaatgccagtctcggcgcagatcatggccgccaccgatgacgacgccgaggcatcgacgccgagaatcgacggcggcacaatatccagattcctcgtgctgctccttgcgcttgtcaaccaggcactgaccatgttcggccatccggtgctcaacatcgatgacacgaccatcacgcagctcgtgagcctcgcatggacagccggcagcgccatctggtgctactggaaggacaacgacgtgaccacgaaggctcgcgtcaaaaaggcgaggctatcggcacgtcacgcggcctaaataagacggacggccgccatggcttctctcagacggccgtccggcatcgccacgtaatgctccgtggtctcaaccgattcatggccgagcagttccgcgaccacgaacaggtcgtgtgtggcggcgtatgccgtggtggcaaaacggtgccgcaacgtgtgcgcggcgtacccgtccggcagcaggcggctgatgtggtccccgatataggactcctcgacgtggccgccgaaccggccagggaacaggtagccccgcgcgtccatgatgatgccggccagatcgtccggcaacggcactatgcgctgcttgtcgcctttgccgcgcacgatcaatgaccggccggcgctgtctgccaccacgtcatcgctgtgaacccgcgcaatctcgccacgccgcagtccgcactccgcgcccagccggatcatgagtctttccgacgtcgtggccatcttcatcgccgcagcgatgtaacggtccgggcatggtctgggatgcgcgtgcggcttcttcacccttggcacgtccagactcggatcatccgaccgtctgccgcttttatgcagccatcggaagaacgacgatatggtgttcctgtacgctttgcgcgtctcgggtttccattgctgccgtgcgaacgcctgcacgatctgctccgtggtcacgtcttcgggacctgatggcatgagcaatgtcgcgagatgcaccatcttgtatcgacggcttttgattgtctgtgctgataggccggccgccctaagggtgtcagtccacccgttgatgcttttgcgccatgggaccggtgcgctgatcttgtttctcatgattcatcatgcacccctagctttaagcgactaaactgagcttggataagctcagaagccccatggatttgaaccttggacctctggtgtccccagaggtccaaggttcaaatccatgccccgctactgatgaaagctaggaattgcaacaattcctagcttttttgttttccgtcaaatctcaccaaaaccaatttccggacaaaatctggacaaaatccgacaaaaaccgggtatatcagccgagttcatcaatcgcatgtgccgaaagtatggagaaaatgcgccggatccgccaatcgcatgtgccgaaagcgaagattgccgctcaaggctgaaaatccaacgttctccaaggttgcacgcgctacgttgacctcgccaaccacatatcaccagatataaggagaacaaggcaatgcattatatgaatcaagcgaacgcgcacaacgcgacgcaggacaccacaatgcaagacagcgcaacgcacgatacggcaacaaaggcaacgcaggacaccgcgccgctgaaaggcatcaccgtgattgactggacgcaggtgcagtccggcccgtcgtgcacgcagatgctcgcatggatgggcgccgacgtcatcaaggtggagaaggtgcagggcggagatccgacacgtaatgaaatgaacgacgtggatggctcgtactccctgtacttccttcagctcaatgccaacaagaaatccatcacgctgaacatgagagatccggaaggcaagaaaatcctcgccgaactcctgaagaaagccgacgtgttcgtagagaatatcggcccgggagacgtggaaaagcttggtttcggatggaatgacgtacatgcgatcaatccgcgtctgatcatggcgtcgctgaagggcttcaacaagggcagccggttcgagcatgtcaaggcgttcgagccggtcgcgcagtccgcgggcggtgccgcttccaccaccggctggtatgacggcgagcgcaatgtgcccacgcagtccggcgccgcattgggcgattccaacagcggaatgcatctgctgatcgccattctttcggcgctgttgcagcgcgagcataccggtgagggttgctatgtgtaccagtcgatgcagaatgcggtgctgaacttgtgccgtgtcaagctgcgcgaccagttgattctcgaccgtttgggcaagctttcctactatgactgctacccgaattatgagtggggcaagcaaggcaaagccattccgcgcgcagcgaatgcggagggtggtttggtgcttggctggtgctaccgcgcgaaaggctgggagcatgacccgaacgcttacgtatatatagtggttcaacagtccaagaagggcttcgagaatttctgccatgcgatgggattcgaggattggctgaccgacccgcgtttcaataccgccaatgcgcgtgacgagcataaaaccgaggtgtaccagcgtgttgaggcgtacaccatgcagttcgacaagtacacgctgaccaaggaattgggtgcgaagggcgtgccggtcggcccggtgctggattggtatgagttggagaacgatcctgatttgaatggggatggcacgattgtgaccattgaccagcaggatgcgcgcggcgatttcaagacgatcggcatgccgtttacgatgagtaatttcgtgccggattaccagcgtgcgccgaagctgggcgagcataaccgtgagattctgcatgcgttgggatatgacgacgatcagatcgcttcgctgcgcgattccggtgtgatcggcggtaacgatggcgtgcaggctgatttgaagtaacgcaagttagcgcgcactggcgcacgaataagggcggatcacaagattcgcccttattcgttatgcgtcacatccattgcagttcacgccccgcacttccgcacacaatcccatgtcttacgtcttacggtttaccgtcacaaaaagcgcatgcagtaacggaacgttggaatttcaacgttccgttactatatgcgcttcgtgagctacagtgaggatactgaatcagcccacgcagaaggggacgagccagatccacagcagacaggtggccgcgaatgccaccgtggcgacggccgtggtcgaggcgccttcttttacataaatgttgtaacggctggaaataatgatgcctgagaacgccggcggcaacgcgaccgccatcaccagcatcgaaatcttgttcatgtcaccgcccatgccacacaacagcgccacgccaaggaacactgcaggcgtcagaatcaggcggaagaacgtgttccagatggtttcccaaccgagcgagaatttcaccgtggaaagcgcgaggcccgcggaaagcacggccacaccggaattcgctttggcgatcagatcgaaggtcggcgccacctggcttggcacatgaatgcccaccaacactaggaaaatggccaataacgacgcccagcagatcggttgcttcagtgcgtcgagcaacgcctgcagattgccgttgcggttctttcccgtattcgacgtgccatgcaccataagttcggcggttttgtcggttgcggcatctcgcgccgggtcaagcgtgatatcgccttttgcattggcctttgcattgaccgcgttttcggcctgcacgctaaacttcgctcggtctttggcctggccgaggttgatcagatacatgccgatcggaatggtcaccacgttgaccacgatggaaataatggctatgacgagattcgtgctgacggtgttgccgtaaatcggatcaagcacagcgaatccaaggaaaccaatcgtcggagatcctgcgatcagagcacagacggccgcctcctgaatgctgcggtggaacagcaaccggcacagataatagctcaccataaacatgacgatgacgccgatgaaactgatggcggtcaatgttgcgtctttcgcaagcattgcacgggtcgatttgatgatggacacaaataacgccgcaggaagcgcgatattcaacacaagtttattaagtccctgccgctgatcgtcatcaaaataactgaattttccacaaatataccctaatgccataatgacaataattggcacgatgtcgtcaacaagtatgtttatcactgtcgttctttctttatattttttctatctgcaatcttctgcaatattgtttgattgctgatattgcagatacgttgatcggatcattggttttcaggcagaaaaagtgggcgcacgcattccaccgttcgcacgcccacatgtcataccgacaaccgatgcgctacatgcgagcgccggtcgcgtagtcgtacatggtgacttcggaatcaacgagggctccgaccaccggcttcggattcaacgctccgatattgccggattccttgcccgcatactgcgcgatctgcacatgcacgaagcttggcttgcctgattcgaccgcctcgccgaccatgcgttcgacttcttccggagtgctggcatagtaacctttacccccgaacgcttcgaggaccttctcgtaatgcgcgttgtaagtaagcgtcagcggcgacggatcaccgtccgctccaaggttttcgaagtcgccgcggtagataccgccgttgttgagcaccacgaaggtgatgggcagctggtagcggcaggccacctccacttccataccatcgaagccgaatgcggaatcgccgccgatgtacagcactttcttgccagtggaaagcgccgcgccaatcgcatagccggtgccgcagcccatcacaccccacgtgccgcagtccaaacgatggcgcggttcgagcatgtcgatgatgttgcggcaatcatcgagcgaattggctccctcattggtgagaatgagatcttcatggtgtttgttgtacacctttttgatggctcccaaggcgttgaaatggctcatgggcagctgatcggattgttcgcgggtttcaaatttcgccacgtttttcgcgctggcttccttcagcatgttcagccaggtttcgtcagctttgaacgggtattcttccagagatccgttgagcagcgtcatggcggaacgaatatcccccacgattggtacgtcgatactgcgcgtgttttcgatttcttccggattgatgtcgatttggatgaatttcacatgttcgttccacgttttgccctggccgaacgacagcatccagttgagtcgcgcgccgaccagcaataccacgtcggcgttgcgtagcgcgatggaacggcagcttgccgtgctgtgtgggtcggtatcgggcactacgcctttggccatggacattggctggaatggaatatccgttttcttgacgaattcgcggatttcctcttcggcgcgggcgattgcggcgcctttgccgatcaccatgagcggacgttcggcctgccgcagcaatgcgagcgccgcgtcgatggatttgcgtgccggcaccatggcgggggccgggtcggttgccgtccacatcaggcggtcggcttcgctttggctcagggtctgtgccacggtgtcatcggggaaatcgatgtacaccgcgcctgggcgtcctgaagaggcgatatgcatggcacgggccaccgcgagcggaatatcttcgatgcggtcgatgcgcagcgaagccttgcagaactgcttggcgtagttcatctggtcgaggccttcgtattcgccttcctcaaggtcgaccacatggcgggttgaggagccgccgatcatgatgaccggatagccgttcaccgtggcttccagcagtgccggtagaccgttgaggaatcctggagcggataccgtcaacgtgacagccggccgaccggtgatgaatccgtcggccgcggccgcgttcacagcgtcctcctcatggcgcatgcccacgaatcgcatacccatgccctgcgcgatgcgcgcgaaatcggtgacgggaatgccgaccacgccatacatgtttcgtatgccgttggccatcagcacccgcgccagataatgcggcgcatcggtgaccttccgatcatcggctccctgccgttcggcatccgcacgcatgctcgcgaccatcgtttcatctgcatgttcttctgtcatcgcaacctccattcgtatcgacgacgccatgattgtagatacgtgaaaatgggagttcgtcagcagaaaaatatgttcgtctgcggcttaatttcaacgttttcagcatgatatagccgtattctcacgcacatgcggaatatattgcagctgaaatatcgcaactctcatcgagaagcatcacctccgcgagacgacatcatcgccgcatatcatcgtcgccgtaccgcatacagcatgaacgccccgcagcacatcacggcagccgccaaacccaacaccagccccatcggacttcctgtctgcggcatttcctgctcgggggcataaaggttgtcgacattgaacgtcagcaggctatcctcacgttccaccacatcgttcagcaccatcattttctgcgcggtgacggcctcatccaatcccacggactggtatccgaccttgatattgacctcgccggcacccgttgcatgccaatacacggtggttccctccagttcggcccagccgactgccgtgggctcgtcgtcctcgtcgaacacggccggaccttcgatcgtcgccgtgaatacgccctcgatcggctgtccactcgaatccagcaactgcacgaacaggcttccggaccgcaatccctgccgatcatcacgcgtcaccctcgaagaaaccggcagcttgttcgcggcctcctcccaaagctcgttgaccttgctttccagcccgtccatcaccgagaagaggtattgctcatgcctgacccacaccttttggtcgtcatagttgcggtgcaccagcacgccgatcgcagcatacgtgagcaccggttccccgtcatgttgatattcggacagcagccatgcgaggcgccgcgccgcttccgtattttccacggtggtggtttcggtgaccttatagtcggtcatgctttcgatttgccggcaataatagaatttgcccgatctcgattccgcgttcaccccgatcacatacggttttccatcgagaaaatagttgtaatgcttgccgttcgcgcgcagcagctgttcggcggccagcgcggccgggcaggtcattcccacgattatgatgcaggccgccaataccgcggccagaatcgcaagcgtatgtcgtttcatcgcattcatcgcatcgtcctttcgatatgcacatcgttgttgtcgtaattcaacaggcttgcatacttgcgattgccacatggcctttttcaagggttgtggtcggaggacgttctttttgccgtttttgtggacaacttcgcttgtcagcaaacgtaacttatccacaaaaaacgttttaccaatcgtaggtaaacaagttatccacaaagggtggaaatcgctggtcggaagatagttcacccaaatccaccttttctcctctataatcggcggtatggcagaagaagataagagcgcggaaccgcgcaccaccgcaaccaagcaaccagccgtcaagaagacgaccgccaaaagcgcggccgccaaaacggcatcggcaacgtctcagacgcctagcaagcgcaccgccgcagccaaaaagtccacggcatccaccgctcgcaagcgcaccaccaaagcgaaggccgccgcaccgcaaacggtcggcgaagccccagcccccgtcatcgaacgcaccagccccgaacagttcggccgcgtgaacgtgctcgacatcaccccgaacgttgagaacggcctgttcccggcacgcgtggagctcggcgaagcattcaacgtcaccgcccaagtgttcatcgaaggccgcaccaaggcaggagcgaccgtgtccgtgcgtaacgcacgcggccgcgaggttgaacgtttcgccatgacctgcaccaatccgggcctcgaccgctgggaagccatggtcaagatcggcgaacacagcgatctgaagccgtgggatgccgattatgccgccgtcaagcgtcagctgggcgaatggcagatcgtggtcgaaggctgggaagacacctaccagtcttggctgcacgacgccgccatcaaggttgaagtgaatgacgacgtggagaatgcgctggaatccggcgcacagctgctcgcacgttgggctgacgcgaaggattccaagctttccgcagccgacaagaaggtgctgcgcgacgccgccaagaccatggaaaacaagtcgctgagcgccgaagagcgtctcgccgcagtccagagcagcgacatcgagcagctgcacgaaaccaacccgttgcgcgacggcctgtccgaatcgaatccgcagcgtttccgtgtggaacgcccgaagtccagcttcgcctcctggtatcagttcttcccacgttccgaaggagcctactacggtgaagacggcaagatcgttcccggcaacctcaagacgtcgatcgccggcttggaacgcgccgcagccgaaggcttcaatattgtgtatttgccgccgatcttcccaattggcgtgaccaaccgcaagggacgcaacaattccctggtagccggcccgaacgatccgggctccccgttcggcatcggctccgaactgggtggccacgacaccgttgacccgcagcttggcaccatggacgatttcaaggcattctgcgagcgcgcccacgagctgggcttggaaatcgcgcttgatttcgctttgcagtgctcgcctgaccatccgtgggtcaaggcgcatccgaactggttccgcaccaagccggacggcaccatcgcattcgcagagaatccaccgaagaagtatcaggacatttacccgatcgacttcaatgccgacatggaaggcatcgaaaaggaagtcgaacgcattatggatctgtgggtcaaggcgggtgtgacgatcttccgcgttgacaatcctcacaccaagccggtgcgtttctggcaggatgtgattgccgccgttacgaagaagcatccggaagtgctgttccttgccgaggcgttcacccgcccgggcatgatgcgcgcgctgagctatgtgggcttcacgcagtcgcactgctacttcccgtggcgtaacaccaaggaagagctcgaagagtacctcgaagagaccaacggcaatggcggcttctaccagcacaacacgttctggcccaccactccggatattctcaccgcctacgtgcgcgacaacggcattgccggccatgcggtgcgtgcggtgctcgccgctatgggcagcccgagctggggtatttacaacggctacgagctgatcgaaaacaagcagcgtccgggcttcgaagagcagatcgacaacgagaagtacgaagtcaaggtgcgcgattgggacagcaccgaaaagtacggcatcgccgaactgctgacctcgctcaacaagatccgtgacactcacccggcttgccgcagctaccacaacctgcacattctgccgagcgacgacgcgggcgtgatcgcattcctgcgtcagactccggccgaactgaccggtaccggcaaggcagatacgatgatcgtgatcgtgaacctcgacggacacaacgcgcaccagtccattgtgcacatcgagcttggcgacttcggtttcgccaccgacaagccgctcaaggtgcatgatgagctgaccggccgcgacttcgaatggggttacgacaactacgtttcgctcgccccttgggccgacgtggcacacgtgctcaccgtagtcgaagactgattgagtctcaatcgatctgattaatctcggtcagctcgactagaaattcgtttcgattcataccacaataccggttccacttcggtggaaagcggtattgtggttactgataatgcaaactgcccaatctcaaggagaaatgacatggcagaaaccttcaacgtcgtggtggaaattccgcgcggctccaagaacaagtacgaagtggaccacgagaccggccgcgtgttcctggaccgcaccctgttcacttccatgggttacccggatgactatggctacatcgacggcactctgggcgaggatggcgatccgctcgacgcgctcgtcatgatcccgaactccgtgttcccgggctgcgtggtggaatgccgcgccgttggcctgtaccacatggtcgacgaggctggcggagatgacaaggtactgtgcgtgccggctgacgtacgtttcgacgacatcaaggatgtcgaagacgtttccgagtaccacaaggctgaaatcaagcacttcttcgagcagtacaaggctctggagccgggcaaggaagtgctgccgggcgattactggaccggtgccgccaaggccgaggaagaaatcgtggccgcccgcaagcgcctcgaagaatccgagaagtgatttccacgcctttctagatagctttaggtagcaatccaaggaaagcccgttgacgtacgcactcgcacacgtcaacgggcttttgcataccttccaacgtccagattccgccagtcactggaagaatcctcccgcaaaccagcccctcagcgggcaaaaacctccactcactggaacaatcaccccactaacacggcttccagcggacaaattcccccagtcactggaagaaaatgcccgcaaatcaacttctcagcgggcagattcctccaccgattggaggaaaacggacaaaaccataccctccaagtgtccagattcctccagcgagtggaagaaacagcccgcagacgggatacactcatactgcacgcgcatattcgccggggccgctatagtggaacacgtaattcacggcatgcgaacagtattcgcagaattcaaagcccgctggctggcgcggcagttctatgtcggtacccctaggcgtaggcggacgtgagactccgtcgaggcccatcccgtgggaaaccggcgggatgaacctatataccagctatgttgattcaaacattacttattgccgtttccgtatcgatggacacattcgccgtttccatcggcaaaggtctcaccgtcaaaaaactacgcggcctcgacgcgttcaaaaccgccctctggttcggcggatttcaggcgcttttcccactgctcggctatttcgccgcctccacgttcagcaaatacgtgaccgccgtcgaccattggatcattttcggcctgctcgccctcatcggcggcaacatggtgcgtgaagcattcgaagaggatgaagagaacgccaaggaaaccgctgatttcgattggaagcacatgcttccgctcgccgtggcctgcagcatcgacgcattcgccgtcggcgtcagtttcgcattcatgtcgttgaacatttggatttcagtgatcatcatcggcatcaccaccggcctgttctccgcagccggtctgtatatcggtcgcgcgttcggctcgcgctggcagaagcccgcacagatcgcaggtggcgtcgtgcttattctgatcggcgtgaaagtattgctggaacatctcggattcctcgtataataatcgcaaatcagatatacaaataaatatacaaacttacagtaaaagcccgtaatcgcacatgattatgggcttttacattaccgcttaccgcaaatacttgattattttcctgcgctttcgcgttttctcgcgattgcaggaatcacactattagaacatgacggtcgcgtacgatgcgataccgaccacaattccggaaatcataaccggcagcagcgcaatgccgatccacggattcttggattgcggatcgggatcggcatcacgattccaccaatacgaacacgcgtcaagcgcgataatcagcagcaacgccacaatcaccgcaacagcccacaccgtcgtcgagccataatcggtggaagccgcgttttcgccggaacgaatcggcagcagcgtcgataggaagcaccagcccgcgctgccaatcatggcaacgccttccacaacattgtgcgacagcgaacgaatcagatgcgtacggttctcacgcgccatctgacgcccgaacgaaaccacaatcagcaggatcagcagaccgccgacgccggcgatccagccttcctgcatccaaaacgtgtcttcgtcacccaaaccggcagggaaaatcgcacgtccgagcatcatcgtcgtggcacacaccacggaaagcaagcccgcaatcacggaaatcgcatgccccgcaacaccatcgcggaacgggttgaacacggcaagcagcgcaatcatcgccacggaagccacaaccgtgaacgacacgattgcgggctcttccgcattcccataggaaatgccgggaatcagagcaagcacaaccagcaccacatatgcggcgatttggacggcaaacaccttgccgaacgaggctttctgagccgacttgacggcaactttttcagaggcggtcatttcgtccccttttcatgattttccataatgtggtcattacgtatgcgataccattaaatgtagccgcaagtgtccacatagttcagataaaattaatgaaacgccgacaacacacaacaagagtacaatcgcggcaacgatacaaaaccagtacaagagacaaagggagctaacgtgacggatctgacgcttatgacgttcgctagcgacccagctaccgtgcttccttctctggcgctgctttcccaccgcgtacgcgtgctaccaatggacgcggcaagtctggtgaaaatgccggaaaacaccattctttttctggatgcgcgagatgatctggccacggcgaaaacattgtgccgcctgattcatgcatccggactgtccacgccgatcgtgctcgtcctcaccgagggtggcttcaccgtggtcaattcgcagtggggcatcgccgacgtggtggtggcgtccgcttccccggccgaagttgaggggcgtcttcgcttggtatccgagcgcggcaactcgccggtcaatgcggtttccggttccggagaatcgggcgtgcagaacgaagacggcatgatccactccggcgacctggtggtggacaccaacggctatacggcaagtctgcatgggcatccgatcgacttggcatacaaggagttcgagcttctcaagtacctcgtgcagcatccgggacgcgtgttcacccgcgcgcagctgctgcaggaagtgtggggctacgactattacggcggcacccgcaccgtcgacgtgcatatccgtcgtcttcgcgccaagctgggcggcgaatacgagcatgtgatcggtaccgtgcgcaatgtcggctatcgttttgatcctccggaagaagaggaaggcgaggcggcagccaaggacgccgcagcccacaacgcttcgagcgaaaactgattgtcgcactattcgcattgctggcattgcctgcgatttgcgatgcttgcgattgccacgatacttgcgatctgactgtcggctatctcactttcgtacgcgcgattgcatattcatgcgacggtagactggtgccatgccccgggaatcgaaacaagcgcgactgtcacgcatgcatcaggaatacgccgtattgtgcgaggagattccgcatccgaaatgcgcgctgaatttttcaaacccgtttgagctgctggtggcgaccgtgctaagcgcgcaaaccaccgacaaacgcgtgaatatggtcacaccggaattattcggcgaatatccgggaccggccgcacttgcgagcgccaatcccgaacacgtggaaagcatcattcattccatcggatttcatcatacgaaggcaaagaacatcatcggactttcttacgcattgtgcgaacggttcgacggcgaggtgccgcaaaccatggatgctttgacaagtctgcccggggtcgggcgcaaaaccgcgaacgtggtgcttggcaatgcttttggcgtgccgggattccctgtcgacacgcatgtgatccgtgtgaccgggcggctgcgctggcgttcggactgggcgagcggctcccccgaccccaaagccatcgaacgagagatcaccgcctgcttcccgcccgaagagtggacggacctgtctcacaggctgatattgcatggtcgtgccatatgccatgcgcgcaagcccgactgcctcaactgcccccttaacgacacctgtccgagcgcattcgcagcgtaacgcgcatgcccgctgtagcctgtgccaactagactcagcaccatggaagacaccatggaagaagaaaacgggcgggaagccaagctgaaagccgaaatcacgcgatggctgatctttttcggcgtcgccatcatgctcagcgtcatgacctggctgggctggtcgctgacgaaccgcaaaaatccgattacctccttcaccacgctcgtttccgactcctccgtggccatcggcattcagggcagcgcgccggaatcgctcgacatccgcaccgaacagggcaccgcgctggagcaggcgctgctcgaaaacgtgtacgaaaccctggtgtcacgcagcgaaaccaacaaactgcagccgtcaatcgcgaaatcatggcagatttccgacgacggactgacctacacgttcacgctcaacagcaacatgaccttcgccaacggccataaactcgactcgtccgacgtggtctggtcgctgcaaaacgtcatcaacaacaattacgtgggatccgaccaacttggtagtctcaaggaaatcaccaatcccgacgaaaaaacggtggtcatcaccctcaatcagccgaatccgtgcctgctgcgcgcgttgagcgggcgtgccggcattgtttacgatgaggaaagcacggcgaattacggcaagaaagccgtgggatcgggaccgttcaccgtggaagcctcgtcgaaaacacagatcgtgctgcagcgcaacgactcgtattggggcaccaaagccgccgcatcgcaaataacgctgtattactacgcttccgaagattcgctggtcagcgccatggaagccaagaaaatcagcatggcattgccgttgagcgcgtctgccgccgatgagctcaaccagcaaagcggcatcaactccgacagcggcatcagcttcgacaaagtgatgctcgccttcaataacggcaccgaaagcccgttctccgacgagcagatccgcaaaatgacgagatacgccatcgacgcgcagaccatcgccaaagacgctccggacgcctattcgccgctcggaggcccgataagcccgctggaagacgggtatgaggatctgagcgaactgttcccctacgatcttgagcagggccagcagatgcgcagctatttcggcgcatactatatcgccgatatcgatctgctggtgcccaaggaatatgagcagatcggcaacaccgtgaaatcggcgatcgaacagctcaatatcggcgtcaatctggaagtgctcgattccgcggcgcaagtcacggaacgcatgaacgcgggcacctacaatatcgcgctcaccaccatgagcggcgaaaacgatgcgagcgtattcaccgacggccagagcgtgttccattatgagaacggcgatgcgcagcaggcatatgcggacgcgatggcggccaccaatgatgacgattatcaggcacgcatgcgcacgtatgcacgcgccgtcagcgaaaacgcggcaagcgactggctgtacacgcgcaagaatttcatggcggtaagcgaccaattgcagggatatccgaaaaatctgaccgaccgtctgctgccgttgagcagagtgaagttgcagtgattttcccgcgattgtcaatcaatcgccgaacactgcggacaatccgtgtgttgcgctgattttcttgcgatttcggcattcggctgcagttccgtaagttgtcacattcgctttctagactagcgtttatgactgaaagccaagataataccatcaacgcgaacctcgcgccgctgcccgacaaggtcggcgtggacggtctcgaagacaagtggcgcgaagtctgggacgaaagcgaagtctacaagttccagggcacccgcgaccgcaaggccgtgtattccatcgacaccccgccgcccaccgtttccggccacctgcacgtgggccacgtgttctcgtacacgcataccgatgtgatcgcgcgattcaagcgcatgaacggctacgacgtgttctacccgatgggctgggatgacaacggcctgccaaccgaacgccgtgtgcagaactattacggcgtgcgtgtggacacctccctcaagtacgatcctgatttcgtgccgccgttcgaaggcaccgatggcaagaagatcgacgccaaggatcaggttccgatctcccgtaagaacttcatcgaactgtgcgagaagctcaccgcccaggatgagaagcagttcgaggcgctgtggcgttccctcggcctgtccatcgactggacgcagacctaccacaccatcggcgagcacccgcagcgcgtggcccagaaggcgttcctgcgcaatctggcccgcggcgaagcgtatcagaaagacgctccgggcctgtgggatgtgaccttccagaccgcagtggcccaggccgagctggaatcccgcgaatatccgggcttctaccacaaggtggcgttccgcttcgaagacggcactccgatctacatcgaaaccacccgtccggaactgctggcagcctgcggcgcactgatcgcgcacccggatgacgagcgttacaagccgtatttcggccagtacgtctactccccgctgttccacgtgaaggtgccgattctggcgcacaaggccgcggaaatggacaagggcgcaggtatcgccatgtgctgtacgttcggtgacgtgaccgacgttgagtggtggcgtgatctgaacctgccgctgcgttccatcatccagcgcaacggacgcatcgtgatggacaccccggactggatcgaagacgaggaaggcaagcgcgtcttccaggaaaccgccggcaagacgacattctccgcacgcaaaatcatcgtcgacgcactgcgcgaatccggcgatcttgacggcgaaccgacttcgaccaagcgtatgacgaacttctacgagaagggtgacaagccgctcgaaatcgtcacttcccgccagtggtacctcaagaacggcggcaccgatcagaagctgaacgccgaactgatcgaacgcggtcgcgaactgaacttccatcctgatttcatgcgcgtgcgttacgaaaactgggtgaacggcctgaatggcgattggctgatctcccgtcagcgcttcttcggcgtgccgttcccgctgtggtatccggtgaaggaagatggcaccgccgattacgatcatccgatcgtgccgagcgaggaccgcttgccgatcgatccgaccgacgatgtgccggaaggctacagcgaggaccagcgcgacgtgcccggtggcttcaccgccgaacctgacatcatggatacgtgggcgacctcgtcgctcaccccgcagatcgtgacccgctgggaagagccaggcgaagagaaccaggcgattttcaacgccaccttcccgatggatctgcgtccgcagggtcaggacatcatccgcacctggctgttctccaccgtggatcgcgcgcatctcgagaacaagtgtctgccgtgggccaatgccaccctgtctggatggattcttgatccggatcacaagaagatgtcgaagtccaagggcaacgtagttgtgccagacaagccgatcaagcagttcggcgccgacgcggtgcgttattgggccgctgcggcacgtttgggcctggatgccacctacgacgaaggccagatgaagatcggacgccgtttggccatcaagctgctcaacgccaccaagttcgcactggccatcggccgtgaggatgagaaccaccatgtgggcgctccggcaaccgcaagctggaaccctgccgacgtgaccgagccgctggaccgcgcagccatggccaagatggccctcgtagtgcgcgaagccaccgaaagcctcaacaactacgagcattccaaggctttggaagtcatcgaaaactacttctggcagttctgcgacgattacatcgagctggtcaagaaccgcgcgtacggcaccgcagactccaccggccatgtgccgagcgagaaggccgtgaagtccgctcgcaccgcgctgggactgggcttggatgccttcgcacgcctgctggcaccgtacctgccgtacgccaccgaagaagtgtggagctggatgcatgagggcgaaggctccgtgcaccacgccgcatggccgaaggctgaaacgtacgatgcggccgcagcagccgtctccccggagctgctcacccatgccggtgaagctctggccgcgctgcgtggcatcaagtcgaaggccaaggtttcgatgaagaccccgatcctttccgtgcagctgggcgtttccgatgaagcgcgcgaatccatcgaaagcgcattgggcgatatcgccgaggccggtcgcgtggtcggacgcatctccttcatgggagcggccgccgcactgaaggccgtcaaggaaaccgccgaagcagccaaggaagccgtcaaggaggccaaggctgatgccgaagccgccatcgacgtgattgtggccgacagcgaacttggagagccgccggctaaaaagccgaagaactaatggcaactgtaggtgaaaccggcagccttcgtggcaaagccgttcacttcacctacagacagtccacaggactgtctgcttaacggctcagccggctaaaaagcctaagaggggatcttccacgattggaaggccccctctttgtgtatctggatcctatgttcatacatttttataaaacgggaactgcaagcagatattgagattgcgcggccttagcaggctgcgattgcacaggcatatccggatacagcttctgcaaagcctgctgcaatatttcggcagcggccgcaatttcaacggtctcgtcaatcaaatcgctattatcaggcacaatcaacgtgtgatttccggaaccagcaatgccgtatgctgcaatcggcaacgcacttgtcatcaacatttcggaagatgcggtttttcctgttgttccagtattttcagatgcggaatctaccgaatcgccatcgctggatttctttgattccactcccccgactttcgcaacgttcttcgacgtggtatcggcagccgcgccaaatgacgatcgcaggccgcccgcgtagctcatcacatcatccatgctgatggcgttcttgtcgtccaccaagctggccgcagtaccgtcggaagcgttctgctgattggccgcatccgcctgcgcgcgttcctctttgcgttgggccttgatacgcgcccgctcggcacggcccgcaagcgacgtctccgaagccgaggcaagtcccatagaccccttcaacgtaacttccgaaccatcgacagtatcgtcggaactggtcgaatcatcacctgcatcaagctgatccgcaaaacgaagcacgatctggtggaacgcactggcctgacccgtgtgctcgctcgcatccgccaacgcctgcatcgcatcgtcaaccttgcttgaagccgacttcaacttctcattgccgtcaatgctgttgcgcacatccgcaatcgcctgagattccaagttttgcgccgaacctgcggaagcccccaattccttaagccgagcggtgtacgcgtcggtgaaatccatggaatacggaatcatcgccgaagaaagctgcgactggccggcactgtaatccttggcgccacgctgctgctcctcgcccgcacgcttgttgagttccgccaccaaaccggatgtgccacgctgttcgatggtgcgaatcacctcgttcaccgcgtcggcggcacccgtatgtcggtatgcggcgctcacatcgttgaccgcgttggccagatcgaccacggactgcgccaccgcagtatcgccgttcaattcggccgcggtgccgagaatggcggtaagttgcgtggtatcgccaatcgatccggaaagatgcgtcgtatacgagccgacgtacgcgtcgatatacccgttgaacgcctgctcatgttcctgctcacgctgggcgatggtcgtttcggcaagccccttttcatgatcgcgcagttgttcgagctgcgcgatgagctcatggttgcgttgcgatccgacattcgtcaaaccatccaccaatgtggatgcgcgatcggtcaaactggtgagattgccatagcagccagttttttcggaatcgcaggcaacagcggcgacagacagcgaactcatggtgaagtttttcgcagtcacatacgtatgaatcgtaagatcctcacccggcttgcctaccgcagcgaccaatgtcgacgaattgccggcagacacaagcacgccttcgtctgaggtcacgtcattgccgacgcggttgggaatggtgaacgcgacgatcggcgtcagatcagccgtttcctccggtcgttccgatttcagatcgatgcggatgccgaccacgcccgatgcaccggaaatcttggatgcgctgacggtcggaccgtccaaagtaaaggtcgccgttatatcccacggcagtttcacacgctcttgcggcacgcgctgcgaagacgtcgcgccctcatctgcattcatgtccgtatcagttgcagaagcggcgtcattcgtcaaatacaagcggcccggctcatcaacggactcatatgcgctcatcacatcgtgcgaggccaccgccgagacgtactcgccgttccgacgcaccgcatcaaccacattcgaaaccccgaccgcgcatacgggagccgccgaaaccagcattaccgcaatggacgcagccagcatgtgccgcagatggacactcgccacacgcatatcacgctcaccacgcgtgctatcggcatgatgggcacaagatgcacgaaacgcaacagaacgacgcatgccgagcctctcaatcgcaatcaaaacaacgttccaaagcaatcaatgtagcgcgcggcatgccccggcaagaaacgatttcgcggaaaacagacaggtcaggcgaatacgtcgagcgcacccggatcgacgccgttctcggcgatgcgcttatgcctgcgcttggcttcggtcaccacgaattcgcgatacatttcggcgatgtcgggatccaacccggcatcgacagcaatgcggtgcaaccgttcgatctggtaatcctcacgcttgtaatcggccggcgcgaaaccctcgcgggctttcagcacacccacttgggacgtgtatttgaagcgttccgccagtagggaaacgatggccgtgtcgacattgtcgatcgactggcgcaatgcagcgattttcgccacggcatcggcgacctcgggattgctttgcgcggtgcccgcatcgatgacggtttcggtttcatgctcttcttctggccgaagccagtcatgttcgctatcgctcatgcgtacaagactaccgcgcgcatgtcacttggagaagtaccgttgcagcacaatcgtggtttccgtgctcaccggcaccgtttggtggatgacgttcagcagatcctcaagcttgcttggcgaggctgcgcgcacggtcagcatgtagctgggtgacccagccacggaatcgcacgacatgatgccttcgatatcctgcaatttggcgggaatctcggcttccttggaataatcgatcggcgtgaccgcaatgtaggcacgtacggcgaggccacgcttttcatcgtcgataacggccttgtagccgagaatcacattacgacgttccagtttctgcacgcgcgattgcaccgcggaaatcgacagtcccgtagcgtccgaaagctgagacagcgtagcgcggccgtctttctccagcatgctgagaatggtctcgtcgatatcgtcgaattggcccacgctcgcatgcgtggtgtcgggttcgttgccattgcctgtcatagatgcccctttccaacaagcattctgcatcagtccggtaggaccgactcccctatgcagctcacgtttccgtccattaccatacccaccccaacacacaatccgtcaactgcattttcgtaacatttccaacgaatttcgattttcaatcatttttctcctatttttttcatataccccctatatagcaatactattttcgtctttttactttcgatttcgtattttttcgtgcgtcgatttttacataccgtatgtccacaacgtgatcatccacattgccgaatcgtgcggaactttcgaaaaacaatcgaaacgcattcgaaagtagttgaaaactgcaaaacggaaaaacagccaaacagaaagacagccgaacagaaagacagccgaacagaacaaaagggccgcatggcgattgtcatacgacccttggatgcgtaaccgcagattgcgattacctgcgattagctgttgccgttattcgcggtattgccgctctgctggatcagcgacgccatgaaatcacggttggtcgcggtcttcttcagacgcggcacaagcgtctggtaagcctgctcaggctccagaccgccaagcagacgacgcagacggtagatgatcggcagctcctgcggatcggtgatgagttcctcgcgacgggtgccggaagcgttcacgtcgatggccgggaacaggcgcttgtctgccagttcgcggctcaggcgcagctccatgttgccggtgcccttgaactcctcgaaaatcacctcgtccatcttggagccggtttccaccagtgcggaggagatgatggtcagagagccgccgttttcgatgttacgagcggcaccgaagaacttcttcggtgggtacagcgcctgggcatccacaccaccggaaagaatacgaccggaagccggagcggcgatgttgtaggcacgggccagacgggtcatggaatcaagcagcaccaccacgtcctggccaagctccacgagacgcttcgcgcgttcgatggcgagttcggcgacggtggtgtggtcggaggccggacggtcgaaggtggaggaaatgacctcgccctgcaccgtacgttccatatcggtgacctcttccggacgttcgtccacgagcacgaccatcaggtggacttccggattgttggtggcgatcgcgttggcgatgttctgcagggtgatggtcttgccggccttcggcggagacacgatcaggccacgctggcccttgccgatcggcgccacgatgtcgatgagacggccggtgagcttgttcggcgcggtttcctgcttcagacgctcctgcggatacagcggagtgagcttgttgaactgcggacggttctgtgcggcctccacggtcatgccgttgatggagtcgatggactgcagcggcacgaacttctgacgctggttgcggcggtcgccctcacgcggggtacggatggaaccgtgcacggcatcacccttgcgcagcccatacttcttgacctggcccatggaaacgtacacgtcgttcggacccggcaaatagccggaggtacgcacgaaagcgtaggaatcgagcacgtcgacgatgcccgcgacaggcacgagatcctctttcggctcctcgtgacgctgttcgcgttcaacattgcgatccgtgcgctcgttgcgctcgacgcgatcgttacgctcgttgcgatcattgttacggtcgccggtacggccacgacgctcgtcacgctcgtcataatcgcggtcacggccacgcaggcgacggccacgacgatccacgcggtcacccctatcgctgacgcgaccgcgaccacgacgcgcgaaatcaccgtcttcagcctcgtcacgatgttcgtcatcatcactgccctgcgaaggcaacgtggcgagaatgtcatcaagatcgcgcacaacgtcctcatccttcggcccttccaccgcacgacggcgacggcgcggctcaacgtcggacgcatcatccttacgatggcgacgacgatcatcctgcttcggcgaagcatcgtccaatcccagttcggccagcagatcggtggcagcgtccgcatcacggcggcgacggcgcttcggagcctcatcgatgctgtccagggcgttcaccgcggccatgacatcggccgcctcctcgctcgtcggagcctcagcctgcttgcgacggtcagcacgctcggtgcgctcggcacgttccgtctgttcggagcgctccgcacgctcagcgctatcagcacgtccggcaagggtcttcctaacggttttggccgtctgcttttcggactgctcagcctcgttggctttgctttcggcagcctcgttggacttgccggattcctcagccgtgttcgccgcgacctcagcgtctgcggtttgggcttcagcaggagccaccggagcggccggtgcagcggacttcggagctcgcacggtcacaccggcaggcgcttcaccgccggaacgagcggcctgaagcgtcgcgataagttccggcttacgcatggtggaggtgccacgaaggcccatctgcttggcgagctccttgagctcaggcagtttcatgtcttcaagattcgggctggttgccactggtttttgcctttcccctagctttcgcaagcacacgcctgcaacagctgtaaaaagagatacggaaatttccgccactgaaagtccgccgcgaaatatcacggttttcgaacttccctaaccatacaacgtcatccagaccaacgcaacgtaggcgtgccaacgtattcatgccaatcaagcattcaagtcaatgacaaatcgcaaatcacaatgcgaaagacccgccatgcgatcacatgacgggtctttcgctttaccacatgctttacagcaacaggtgcaggtcttgccggaacctacttttcctcgtgatagctcttgtcggtattgacggaccatacgttcttcttggacgtcttgccgttcttgatattgccgacggcctcgattgcggtggccatggaatgatccatgttgttgtaacgatgctggccgttgcggccgacgcaatacagattgccgaaggaatcgaggtattccacgagctcaggcatgcgatcgtaggtgtcgaaatatgccggatacgccttcttcacgcgctcacgatgggagtcgatcacgtcttgcggaccgttgatgatctgcatgcgcgtaagctcctggatggcgaacttcttcgcttcctcgtcagacatgttccagaaggaatcgccttcttcgcagaagtattcaagaccgatccacacggtgttgtcaacgtccttgaccaggtacgggctccagttgttgaagatctgcaaacggccgaccttgtagcccggatcctgcacgtaaatccagcaatcaggcacgatcggcgggttgccgagggtgggaatgtcggtggtgttcgacaggcgcaggtgcttgacgagcagaccaacggtcacgaagtcgcggtacggcaggccgttggcgatttcggtcatgtccttcggcgcgggctggctggaagcgtccacggcgttgatgagatccttgacgggcatggaggagatgaagtcgtccgcggccatttcggtgcggttgccttcggaatcctcatataccacggatgcgatcttgccgtcggcctggcgaatctccaccacgttcgcgtcggtgatgaccttcacgcccgcggcctcgcagttggcctcgacggtttcccacagctggcccggaccatacttcggataccagaattcctcaatcagcgaggtttcaacctcagcattgctgcgcttcttcggcaggagcttctggaacgcgttcttcagcacgcccataatgctcaggcccttgacgcgctgcgcaccccaatcggcggaaatctgggacggatggcgaccccacagcttctcggtgtacccctcgaagaacatggaatacagcttgcggccgaaacgattgatgtagaagttctccagattgtcttccggcagcttgtgcaccatggacttcagatagctgaagccggcaacaagcgtaagcttcggacccatggccttcaacgtgttggcgctcagggaaatcgggtagtcaaagaagtggcggttccagtaaatacgagacacgcgatgacgcttaagcatcaccttgtcttcgacttccggatccggtccgcccggttccatatcgtgctcgcgaccgagcttcttgtcatcatagcttggcgcgccctgcagcggcaggacccccttccaccaatccatgatgcgttcgtccttcgagaagaaacgatggccgccaatatccatacggttgccatcatgcttgacggtgcgggagatgccgccgaattcgcgggtcgcttccaacacagtcacgtcgtagttctcggagccaccgtccttgacgagctcccaagcggcagtcaggcctgcagggccaccgccgataatcaccacggattgcttttgcgtcactttgaggtctccttatgaaaacaaaaatccctgatagtctacccgagggtagggaaacgaacaccgcaacttgtgcgaatgcttacaaaatcaagccaagtcagccggatatacggctatcgcatcatgcaaaacgcaatcatcaaaccggccgatgcacgacccgactgcgcggccaaagcgcgcaaccacattacgcaatccaactacgcgcccagcaaccgcacaactggcaaccgcgtgaccggcaactgcgcaactagatggaatcaggaatgtcaatatcggttttctgcacttcctcaacattgacatccttgaacgtgacgatacgcacgttcttgacgaaacgactggaacgatagacgtcccacacccaagcatcagtcaggcgcacgtcgaaatacacgtcttggcctgcggaacgcacattgaaatcgactttattcgccaaataaaagcgacgttccgtttcaacaacatacgtaaacagcttgattacgtcgcgatactccttatacagagccagttccgcgtcggtttcgtaattatcgagatcctcggcgctcatcacttaccttccgtatcgcgcttgcgaccacgaccaagcgtgcgccaccaagcttccttcgacgtcttacgctcgcccgccgtgtacggccagctgttttcggcatcggcatcgccagtaacggacttgcgatcatcatgctcgctttgtcgcgcaggttccgcgccttccgcgtccttccgcacagcctcggccacgtcaccagcaccatcggaagaagctttctgcacggattgcgcagctgccgcggcatcgttgacatccgtaccttccgcatcatgcttcgaagcattcttctcattcagtcggatggcaatggaatgctcgcgcgcgctcaacgcttccttgacgcccggattatcttcgatcacatgcatgccgaacgcgtcaagcgaacggatcgggtcgaactcgtcaaccagcgtgtccataacgatcagatcctggtaacggttctgcgaagcgttccacaaggcgtcgcgcgaacgaccggacggcacgaatcccaacgactggtacacggacacggaacgcgtgttctgctcgggcacggcaacccaaatgcgatgcatgccaaggcctgccggttccggcgcaagtccgtacgtcatcacgcgcggcatgatgtcacgcgaatagccacggccgcggtaatccttgccaagcaccacctgaatgcgcgcggaacgagcccaaccgtcaatatcgatcaggaaaatcatgccaatcacattgtcggaattcgcggcatcgatctcgccatcgccatcatggtcggcttcggtgatgatggaccatgcgatcgtgcgacgcgactccggatcccccacaccggattcggtcggcgtttcgccttgggaccatgccacggaacgacgcacccacgcatgcaccgcgccacgctcggcaacccgatccttgccggtgattccggaagcgccgatgtacgccccaatggcgtccatacgttcaagatcttcgatcacggacggacgcagatgcaccatctcgcccttgatagacggaatgacgatgagatccggcaattcacgcgactgctggtccaactgctcctgtgtcgcagcctcaacttgttctggcattattcctgtcccctacatcattgcaggcacgaccgtcgccgcacccataccgagggtattgtacccgactgtatgtcagctgtgaatccgcgcggcggcaatcgctgtacatattcctctaccagcataacctgatgttgaaggacatgtcggcaatcgtaagaaaatgcgcttcgcgattatgcattctctttctttgaaatcccttttccggaataacgaaaagaaaacgcacgtcccaagctttttggaacgtgcgttttcctgcgattcaacaatcggctgtaatcgtcagcaatcgttgtaaacgttacttgatcttgctcatcacgatcttggtgacggcctttgcgtcagcctgaccgcgagtggcacgcatgacggcaccaatgatggcgcccatcggcttcatattgccgctcttgagcttttcaacgatgtcaggattggctgcgagagcctcatccacggccttttcgagagcgccgtcatcagacacgacctggaagccatgcttcttgacgacctcatccggagtgccttcgccagcaagcacaccggcgacggtctgcttggccagcttgtcgttgagcttgccatcggcgatcagcttctcaacctcagcaacatcggccggagcgatcggcagctcttcgaggctcacgcccttgttgttggcttcacggctcagctcgcccagccaccacttcttggcacctgcggcggtggcaccagccttgacggtctcctcaagcagatccagagcgtcggcgttgagcacgtcacgcatctccaaatcgttgaagccccactcgcccttcaggcggttgcggcgctcgcgcggcatttccggcatctgagccttcatctcttcgatgtgctccttggtgatgtgcagcatcaccagatccggatccgggaagtagcggtaatcgtcggcatcggacttcacgcggccgcctgcggtggtctgcgaagcctcatcccagtggcgggtttcctgcagaatctcgccgccttcgctcagaatggccgcctgacggcgaatctcatactgaatggtcttttcaataccgcggaacgagttcacgttcttggtttcggaacgggtgccgaacggatcggacgggctgttgcgcagcgacacgttcacgtcggcacgcatgttgccctgctccatgcgagcgtgggaaatattaagcgcacgcacgatgtcgcggatggcgcgcatgtaggcaccggcgatttccggagcacgatcgcctgcgccaacgatcggcttggtcacgatttcgatcagcggaacgcctgcacggttgtagtcgaccagggagtggtcagcgccttcgatacggccgtcagcgccaccgacgtgggtgttcttgcctgcgtcgtcttcgatgtgggcgcgttcgatcggcacacggaacacggtgccgtcttcaagttccacatcaagatagccgttgccgttggtcggcttgtcatactgcgagatctggtaatcgcgcggcatgtccgggtagaagtagttcttacgcgcgaactggctccactcggcaatttcgcaatgcagggcaagacccagcttgatggcgtaatcgactgcggtcttgttgaccaccggcagagaacccggcagaccaaggctcaccggggtgagctggctgttcggatcgccaccgaacgagacttcggccgggcagaacagcttcgtggtggtgctcagctcaacatgggtttccagaccgatgaccggatcgaacttcttgacggcatcggcgtacttcatcaacttttcagccattttgttttctttcctccgatgcttcctacttgttcaagccgtcgagccacggggtcttcagggactgccagatcggaccgttccagtcttcctcgagagccgcctcaagtgccgcggcaggcttgtacatggcctcgtcacgctgctgcggagcgaggaactggaagccaaccggcaagccgtcgtcgctcagaccagcaggaatgctcatggccggaacgcctgcaaggttggccggaatggtggtgatatcgatggcatacatggccatcggatcctcggtcttctcaccgaacttgaatgcggtgaccgggctggtcgggccaacaagcacgtcgaccttctcgaaagccttcttgaaatcgtcgatgatcagggtgcgcaccttctgtgcggaaccgtaccatgcatcgtaataaccggcggacagggcatacgtgccaagaatgatacgacgcttgacctcgtctccgaaaccggcttcacgagtgtaggccatcatgttggcggcggtctgaggaacacccgccggcggcatgacgcgcagaccgtaacgcatgccatcgtaacgagccaggttggagctgacctcggacggcatgatgatgtagtacgcaccgagggagtacggcaggtgaggcagagacacctcggtgatctcagcacccatttcctcgagcttcttgacgccttcattgaaacgtgccataacgcccggctggaaaccttcgccgccgagctccttgatcagaccgaccttgaggcccttcagatcacgcttcatgcctgcgcgggcggccgccaccatcgggcgagggccttccggaatggacgtggaatcgcgcttgtcgtggccgccgatcacttcctgcagcagagccgcgtcgagcacagtacgggagcatgggccgatctggtcgagcgaggaagccatggcgattgcgccgaaacgagagacaccgccgtaggtcggcttgacaccgacggtaccggtcagcgagcccggctgacggatggagccaccggtgtcggtacccagggcgagcggggcttcgaacgctgccactgcagctgcggaaccaccgccggaaccgcccggaacacgttcggtatcccacggattgtgtgtggtctggtaggcggaatgctcggtggacgaaccctgagcgaactcatcgaggttggtcttgcccagcagcggcatgcctgcagccttgagcttctcgatgacggtagcgtcgtacggaggcacccagccttcgaggatcttggaggctgcggtggtttcgatgcccttggtgacgatcatgtctttgatggcgatcggcacgccggcaagttccggcagctgtgccttttcctcatcggacttggcatcgaaggcgtcggcctgttcgagagcctgatcgccggacaccttcaggaaagccttgatgctcggctcggcggcctcgatgacttcgagatgcgcttcaaccagttcacggctggaaacttccttggccttgatcttagccgccatctcggcggcggaaagcttgacgagttcgctcatgtcactcctcccccagaatgcgcggtgcaacaaacatgccggcctcggaaaccggggctcctgcggtcgcctcttcctgagtcagcggggtttccggcacatccgggcgcaggtaggcttccagcggaatcgggttcgcggttggttccacatcgtcggtagcgacttcctggaccttgttgatggattctgcgatgacgttcagatcgccctgcagacgggtgatctcctcgtcagtaagtgcaattcgggccaaatcgcccagatgcacgatttcttctttggtgaaagtaggcatgtccctaacattaacgcgtctgtgtgacgagcgcccgcccatttcgcctcgcccggcagccccaccacgctcccgccctaccaccccaccaaagtcccaattcccccggcagccccacactgcatgccgcccggcagccccacacgctaaccgcaacagcctgccgcaccaacaccccagctctgtcagagtcccaaatcccccacccactggaacaaaaggacgccaaacgctgtttcaccgggcaaatccctccagacactggaggattcttcccgccaacaagccatccacagtcccaaaacctccatccacagtcccaaaacctccactcactggaacaatccgggcccaaaccagcctctcatcgtcccgattcgtccacccgctggaagaatcttcccgctgaacgctctgctggagtccggattcctccagaagatggaaggatcctcccgcggaaggccccactagaggccaaaatcccccagtcattggaacaaaacggacactaaaagcaatacaaccgtctaaaaacctccagccactggatgaattctcccactagcgcttcgtcagagcccctattcctccacccaatggaagaattctcccgcaagccagccatccacagtcccaatacctccacccaatggaggaatctggactctgaacggcatcccaatacttaaaaatatccaaccaatagaagaaaacaacaaaaattcacacaaaacaagcggatacaagcacttatctgcaaaacaaccacccagttatccacaaaacccgtaagttatccacagacacgcccgaaacagcatcctctatccacatttgccgatcgcacttccatagcagagccacaacaaggtagcgtcaaatcatgaaagcatatcctcaaatcgatgcgctgctcgatcaaacagaaaatgcgcaacgatgcgcacacagcagtgaccctctcatccagaagggactatatcgcagataccgcgcgggagatttggcgcgcccatacccagggctattcgcccgtgccgaatattggaatcagctgaacgagcccgaacaatcgttgcacgcggcccgaaccctcagcaggctccaccccaactgggttttcgcaggaataacagccgccgcagcccacggattcgaccacccgcgattcctgcaccggcaaggactgaccataacattgcccaatcacggatcataccggccgcacgacaaactcaatatcatctacagcccatatcccagagaaaatgcggtactcgcaaacggaatccatgtcactaatccccctcgtaccttattggactgtggacggacgttagagttcatctattccctgccgattttcgatgatgcagcagcagacggaatcgaagaaaagcagatcttgcaggaatgcgcacgcacgacactcgattgctcgcgcatcttcaaattgttgagatataccgacgcaggaagtgaaaatggcggtgaatcttttgctcgggcagtcatgattgaaaacggttttgcggttcctcaattgcaagtctccttcgccgactcgcttacgggaaaacaatttagggtcgattttttatggcgcacaaccgatggacgtattattgtcggagaacttgacggcacagcaaaatacgttgatccgaaaatgactgatcgtaggagcatccaggagaccgttcaggccgagcgagaacgcgagcaagcgctttttcgcgcaggagttacggaaattgtcagattaacttttgacgatgcagtccagcaaaaaccactgattgcgaaactgcggcgtgctggggttccttgcgtttcatagggtaatcatctgcgggaagattcctccagtaagtggaggaatcggaacgttgagaagctcgccaccgggaagattcctccagagggtggagaaatctagactctagcagggcactcagcggaaagattgctccagtgggtggaggttttgggtctctggtgaggctttcagagggaagattcctccagcgactggaagaatcaggactctgacaggcttgttagcgggaagattgctccagtaagtggaggaatcttcccgcagaacaccgtactaaagtcccaacctcgccagtcactgaaggactcaccccgccagacgccccacaggagacccaaaacctccacccactggaacaatcatcccgctgacagaactccaatcgtcccgattcttccagtcactggaggattttggacgataggagatggaggttagagctggggagcggcgtgctgggagatccatgcgtgcatggaaacggcggccgcggctccggcattgatggaacgcaccgaaccgaactgggagatgtaaaccacatcgtcggccaactcaagcgctttttcggacaatcccggaccttccgcgccaaacagcatgaggcaacgcttcggaaaacggtacgtttccatcggcaccgcacccggaataatatcaagcgcaataacccgcgccgccttcaactcggcaatacgctgatcaatcgcagccaattgcgccatgcaggtaggctcgaatccattcccaacgccgcttgcatccgaagcatccgtcgaaatgccagatggagcgcatccagcaacacggccttcagccaacaaagcatcgcttacgccggcatcgtttccagcttccacattttttcccgcgctttcatgcatacgaaatgcgatggcggccgcctgcgattgcgccgccgcgatttctccggcaatgcgcagcttccagcattcgacaagttcggttatggaagggtggttttcgacgtgctggtacagctccgtcatcagcgaccccttgcgattccacttgtgcggtccgacgatatgcacacgtttcgcttggaacgcgttcgccgtgcgcaccatggatccgatgttgaaatcgtgcgtccagttttccacggcgacttcgaaatcatggcgaccgcgagcgtcaagatcggctttgatggccgcgaccgcccagtagcgatactggtcaagcacgttgcgacgatcgccctcgtcaagcaaagacgagtcgaatcggcgatcataatttacagattgcggatcatccggacgaggctcacccggatgtgtttcggcccacggccctacacccacctcgcgaaagaccggctcgccagacgctttcgctgcaatatcaatgggatgaggctgatgcacgcgattcctccttacgaacctcgtatcgccaatggctggtcaacaggatacctagtgaagctccgattccttgaacacttcaacgaacggcagctcggattcagacccatccaccggattgatgaccttgatcgtcggctcggtcatgtcaacgccgccgatcagcgaagcgatggcaagcacctcggcgccctcgttcttcaccacggagaaatcaaggctcaactcattgccattgcgcaaggtaaccaaagaggacgtctgtacatacgacttttcagacagccaggaatccagcaacaccacgcgcttacccgcgatcgacggtcccttaatggacggatacacgaaatccatcacaaaaccgttgagattctcaccgcgcgaagcggccgcctgaatcatggcggacaccagcggaaccgcggccgcggtcaacgcgcccacggcgtcgaaatcatccacggaatagccggattcttccaacgcgtccagcagaatatgcccgacaaccgaagcgccacgatgatcgaacaatacagaggaaagctccgagaacggcttgtcggccatctctgcctgcaacagcgacttcagctggtcacgcggctcaagcatggcgaaatcgatgtcgctatgctcaggagcatcggcaggcacagcaaccggattggtcttacggaaagtcttctcttcggtcatactcccagcctaccgtttctactcgtcaaaccttacttatgccgacacgtatttagtcagatatcactgttcactggtttcgggagcagtgagttcgcggacatcggccttttctggcgcgatcatgtttacgggttcgatgattctgctctggtcgacgcgctgcagcttgcgtgcggtgaccagcacgcgcgattccagtgacgaggcgaacgcattgtaggcaccgaccgttttggtgatggcggaccccagcttggtggcacggtccccaagcacggcgaaccgttcatacaattcgcgagacaggtcgaacagcattttcgcgtcatcggtcaggctttgctgctgccacgcgtatgccacggatttcagcaccgcccatagggtgatcggcgaggtcaaagccaccttgcgtgcgaacgcgtcgtccatcagcgtcggatcggtttccaaagccgcctgcagcagggattcgttggggatgaaggcgatcacaaaatccggagcgtcgtcgaacgcgttccagtaggccttgtcccccaaggtcttcacatgctcgcgtaccgctttggcatgcgcatgcagcagctccgactttcgcgtcagctcctcgggcgtggcggtatcgggaatctcgcacgccttctggtagtcggcatacggcgctttcgcatcgatcggaatggttttgccgcccggcatgtggatgatcatgtccggacgctgcgtacgcccatccacgtcggtgacgaccacctgggtgtcaaaatccacatgttccagcagtcccgcggattccacgatgttcctcagctgcgcctcaccccacgcgccgcgcaccttgttgttgcgcaacgcggacgacagggcgttggtttcgcggtcaagacgagcctgctgctcgccaaggcctttgagctgctcgccaagcgcacccatttcccgcttgcgaccctcttcgatctgcgaaaccttctgctgcagggcgtcaagattcttctgcacgggcgcgagcgcggacaataccttgctctgctcctgcagttttcgctcgttttcggcctgcttgcgttccgcttcggccgcggcacgctcacgctcccgctccacacgttcctgttcggcccgctgggcctgcgcgagctgcgatttgagataggtcaactgttgggccaacccttccgcctgcgtgcggtattgggtcaccgccgtggacaattcactgatttcctgccgatcagcttcgatctgcgctttcgcctcgttaagatcagcggttttcgcatcacgggccatttcctgccctttggaacggcccgcaaaaaagccggccgcggctccaagcacggccacaaccaccagaagaatcaccacaaacacaggattgtcgaacatatgttctatataacagcatgaccaagacatcttggaagatcaaagttcgcaagacatccatgcccagctgcattatgcttggagccgaaagcatgctcacgaacatgcggcaacgcgagcacgctgaatattcgagaggcattcaagaggcaatccgggggttcggaaacacatgggattcgatttgtttatgacggtggcggcgattgttgcggcggccgtggccacttgggccatcctcaggctattcctaagcgaaaacgatgacatagccccctcccaccaacgcatcaccgatgacaagcccgccaagaatcacaccgaaaatcacaccgaaaatccagacgaggcagccggcgcaacacaccgaagcgacatcgccaagagtctcgccatcgcaaccatactgaccgctcccacattcaccgtaaccatgctgacattcggcggcatcacacttccccactggctgaccaatccatggctgcacgccatcatcgccacgccggtcatgttctactgcgccgcgccgatgcacaatcgcggtatcgccgccctgaaaagccacacgcccaacgcggattcgctgctgtcgctcgccatgaccattgtgtacgtctacagtctgctggcgtgcgtggtgtcgtggattttccccgcggggtcacgcaatcagtatttcgctttcgcaagcatggtcgccgtgctatcgcttgcgatttcgctgatcgcgcaacgccccatggcaaagaaagcatcggaaggcgatattccgaccgcacaatcgcaagaaaagcaagaaatacaatcgcaagaaacgcaagaaacacagcaaagcatggatacgcttatccaggccagcatcacatatgagattcgcacgcgggtaacgcagattaccgcgaccgtgacgatggtcatcgcggtgtggacgttcgctttgtggctgattttcgggcttcagccgaagcttgcgatcgccgtgttgatcggtgcgacggttttgacggtcgcaggcttggttttgcaggcatatgaccgccaaccgtcacggtaaaacggttttcgcaaaagaaaatcgcgcaatcgcacgaaaaatgggcggacccgcatgtgcgcagtccgcccaccgtcaacggttagaccgttttgtgactcggccaatcaacagtcagtcaggccaaaccgatcagccgaatgactccgaccgtcacttagcctctgccgaaaaatcgtcgtcaatctgccccggcgcccacgaggagagctccaaatggtcgccgccggtctgatccacaagcacggtgtcgccgtcgtgcacttcgccggccagcagcatgcgcgccaactggtcgccgacttcggtttgtaccaaacgacgcagcgggcgagcgccatacgccgggtcgtaaccggtgttggcgagccaatcgcgcgccgaatcggtaacatccagcttgatgcggcgatccgccaagcgggccgaaacctgcgccacctgaatgtccacgatgccgccgagctcttcgcgcgtaagcgggtggaacataaccagttcatccaagcggttgatgaattccggcttgaactgcatatgcacggcgtccatcacggccttcttcttggcttcgtcatccagttcggtgttcaccaggaactgcgagccaaggttggaggtcatgatcagaatcgtgttcttgaagtccacggtcctgccctgcccgtcggtcaaacggccgtcgtcgagcacctgcaacagcacgtcgaatacttcaggattggccttttcaacctcatcgaacagcaccaccgaatatgggcggcgacgcacggcttcagtcagctggccaccctcctcatagccgatgtagcctggcgcagcaccgattagacgagacacggaggccttctccatgtactcgctcatgtcaatgcgcaccatggccttttcatcgtcgaacaggaagtcggcgagcgccttggcgagctcggtcttgcccacgccggtcgggccgaggaacaggaacgagccggttgggcggttcgggtcggaaatgcccgcacgcgaacgacgtaccgcatcggaaaccgcttgaatggcttccttctggccgatcacacgtttgccgagatagtcttccatggtcagcagcttctcgttttcgccttgcatgaggcgtccgacgggaatgcccgtccagtcggacacgatttcggccacggagtcggcgtcaacgcggtccggcaccatcggaatatcgccacccaagccaccgtcagcaccgcctgccgcactgttcttggccgccgcctcgttttgttcggcttgcgcgatctccttctggatggccggaatttcgccatagttgatggcggaggatttcgccagatcgccttcgcgttcataccgttcggcttgggtgcgtagttcgtcgagcttcttgcgcaggtcgccgatgcggttgtgcccgttcttttcggcgtcccagcgtgctttcagaccgttgagtttctcgcttttgtcggcgatttccttgttgaggtcgtcgagacgttccttggcgctttcatcaagctcgttttccgctttctgcgcgtcggcatcgtctttcggattgccaagcaggtacgatttttccatcttgagacggtcgacctgacgctgcagttcgtcgatttcctcaggcgaggagtcgagttccatgcgcaggtgcgatgcggcctcgtcaaccagatcgatggctttgtccggcagctgacggccggaaatataccggttcgacagcgtcgccgcggccacgagcgcatcgtctccgatggtcaccttgtggtgggcttcgtatttcggtgcgatgccacgcaggatggcgatggtgtcttccacgctcggctctcctacgaacacctgctggaaacggcgttccaatgccggatccttttcgatgttctcacggtattcgtcgagtgtggtggcaccgatcaggcgcagttcgcctcgcgcgagcatgggtttgagcatgttgcccgcgtccatggatccttcggccgcgcccgcgccgacgatggtatggatctcatcgatgaacgtgatgatctgcccgtctgcgttcttgatttcctgcagcacgctcttcaggcgttcctcgaactcgccacggtatttcgaacctgccaccatggagcccagatcaagcgagatgagcttcttgttttgcagggtggtcggcacatcgccggcgacgatacgctgcgcaaggccttccaccacggcggttttgcccacgccaggctcgccgatcagcaccggattgttcttggtgcggcggctcaggatctggatgactcggcggatttcctgatcgcggccgatcacggggtcgagcttgccttctttcgcggctgccgtcaggtcggtcgaatacttttcgagggctttgtaggagccttcggcgtcgggactggtcactttcgcgcctcctcggatcgttggcacggctttgcgtagcgcgtcggcggtcacgccgtattgttccatgatttgcgcgctctgattcggctttgccgccgcgatggcgatgagcagatgttcggtggatacgtattcgtcgcccatctgctgcatttccttgccggcttgcgcaagtactgcggatagttgcctgctgacttgcggttgcgcggtggtcgatccgctggcgcttggcagcgcgtcctgcgcttggtgcacggcggcgctgatgttctgcgcgttgccgcccgcggcttcgatcagaccgcggatcacgccgttttcctggcgcagcagcgcgtcaagcaggtgcagggtttcgacttgcgcgttgcctgctgccgacgcgttctgtacggcgtcggaaatggcttcctgcgccattgtggtgaacttctgttccatatcatcctccatggttcgcgccgatcgtccgtttttcgcacggtcgcgtcgacgcatatgtcgttgtctgatatgctcaaccgacttcaccaccattctattcccaaaagttgagcctgcaacactcaacttttgttcactaaacgggaaatcgcgaacaacgcagcacaaaggccgtcacccacgaaaggtgacggccttcatatcttcaatatgtcaatcagcaatcggcaatcagccgcgcaccaccacgttgcgcaggctgccgatgccttcgacgtgcacgatcgcctcgtcgcccggatcaagatggccggaagcgttcggcgtgcccgtcagaatcacgtcgcccggcagcagcgtcgtgaagctggaaatcgccgcgatctgctccggaatgccgtgaatcagattcgccgtggtgccggaagccagctcgacatcctcaccgttcagcgtgaaggagatcttcgcgtccttccaatccaaatcgtcgcgggtcacgatccacgggccgagcgggcaggaggtgtcgaagcctttcgcacgcgtccacatcgggtcaagtccctgcaggtcacgcaatgtcacatcgttcacgcaagtgaagccgagcacgtaatccatggcctgttcgaccgtcacgttcttggcgatgcgccccatcaccacggccacttccggctcgaaattcatatcgttcgagtacgacgggatcacgatcggatcgtccgggccgatcaccgacgtgctcggcttggagaagatcaccatgtcttccggagcgtgcttgatgtcggaatggcctgcttcatgcatgaactgcgcgtgcgcctcgtaattcttggccagcccgtataccttcgacgggatcaccggagagagcagacgaacgccatcgccatccaccggaaaacgctcgccggtcggcttcacaccggcaccggccagaggatgcccctcaagcgccacgagatagtccttgccgtcgctttcgtcggtctgcacgaaagcgtattgcggtacatcattatgcgaaaaacgtgcgattctcatgcttgccagtctacccgcaacaatcgtcgaatcgtccatatcatcgacatgcaacgcccgacaatcaaaaacatcgaaaaaaaaacgggccatcacatcatgcgaaggcccgtcacaggaagaaaacgtcagataaaagcacgctcgccgaaaatcgcggtgccgacgcgcacgatggtggatccttccgcaaccgcaagttccatgtcgccggtcatgcccatcgacagttcgcggcaggattgcgtgcccggctcgccggattcgagaatatggtcgcgggttttgcgcaggtgctcgaatcccttgcggatggcggtttcgtcgtcgacatgcgcgccgatggtcatcagcccctgcaattcaagtccgtccaatgtaccgattttttgcgcgatgcggatggcatgcgagggatcgcagccggatttcgacgcctcacccgattcgttgacttccagcagcacgcccacggtgatgccgcgcgccacggccctgcgcgagattttctccgccaagtcaagggaatcaaccgattcgatggtgttgacgaccggcagcactttgccgatcttattgctttgcagctggccgatcagatggaacggaatatgctcacccgcaatagtggaagcgccggcatcgtcggcaacgcccaacgtgaatccgcgctcctcgcaacgtgccatcaatccttcggccttcgccatcacttcctgcggacgattctcgccgatcatacgcacgccagcgtcgatcgcagccatgatctcacccacgtcgcgcgttttcgtggcggcaagcaggcgtacggaacctgcgtcacgcccggcatgctgctccgccgatgcgatgcggtccagcacacggtgcacgccatcggcgatctgcacggcacgcacaccgccgatcacctcattggcaagattcttatggtccatatatgcagtcatgttcagcctcttgcgttcaatcccaactacctctaccagagtaagaagaagcccgtacgacggtctgaagtgaagcgataaagcgaccgatatccgtacgggctaataaaacagacggcagtagaagggggaacttcaaagactccgtccgacagcaactatatgcaagatttactaaacacgcgccgaaaaaaacttttttcttcaaaaaaaaattttctcagcgaactcaaattcagccttgcgattcgtctaatttgcgttccaaagcatcaacgcgttccttcaacgcaagcacctgacacgtcagcgatcgaatctgccccaactgcacagtcaccaatcgttccctggtgtcggaagacaaggcgcccgtcgtggaattgcttcttgcggccgccataatatccagatccactttccaaaatatccagatccactttccaacgtgcgatattacgttccacacgcttgcgcccgatgatcgcagggctcaacccagccgacgtgaaaatcgtgctcggccgctcgccatccaaatatcggcgcatgcaactgatctgaaaatcacgcgaatacgtgatccgattttccgtaaccgactcaaccgccggcaacgcacgaagatactcgacctccgtgttactaaactgccttttcgtcatatcgaccccattcatccgacaaaacggaataccattctcgtgctcgtagattaccatcacaaacgaacgcgcccgaacggcatatactaccactttaacgtaaggctatgggggctcacgccacctgaatcgccctacgctaaacctagctaaaccccaacgggtacagttgcgtactgccacagtcaacccaccaaaggagcagccatgaccggccgattcgcaccaaccccatcaggacgcatgcacatcggcaacgtttacgccatgctcggagcatggctttccgcccgcaaatcgggtgattccatacggctgcgcatcgaagacatcgacgagccacgagtggttcccggcgccgccgaaaccatgatgcgcgatctcgaatggcttggtctcggttgggatgacgaaccggtattccagtcgtcgcgacacgccctataccaggaagcgcttgagcttctcagcaagctaagctttgacgaaatcagcgatattatcggtactggttccaacgattccaagccctgcagcactacagcaggcaacgaagcagccacctctgaggcaacaccgctcatctacccctgcttctgctcgcgcgccgacatccgcgccgcctctgcaccacaggaaggcgatcgtttcaccgtgtacccaggaacatgccgacgcctcatcgccagcgaaccgcagcgtgcgaaacaacgcctcgccaataacgaccgccactcgatgcgcatcgccaccgccgacaccaccatcaccttccacgacgaagtattcggcacccagcaataccacctcgcccacgacatcggcgacatcatcgtgcgccgctcggacggcatctactcctaccagctggccgtcaccgtggacgacctcgacatgggcatcaccgacattgtgcgcggccgtgatctgcttcgctccaacgctttgcaaatctacattcgcaaagcccttatcaacgcgggattcaagccttccgaaccgacacagcccttccatcctgccgacggttccaataaacctgacgatgtgaccatctcatacgcgcatctgcccctcatcgacaacgcagccggccaacgccttgccaaacgcgagcgctcgctcgatctcggcatactcacggcacacggcgccaccgcgcaacagatcatcggctattgcgcatggctgctcggattgcagggagacctgaaacacaccaaaccgcagcctatgagcgccgacgaagcgcttggcgtattcagttgggatgccgttcgcaccaacacgtcagaccgcacgctcgatcaaggcgagttcaacgcatatttcggactgtaggccctattctgcagttttattctgcagttttattctgcagttttattctgcagctctattccgcaatcgcgttcagccaatccataattccgaatcaagcggatattcgttgatcgcacagccatccaaaaatatggactgctcctgcataagcggtgccgcttggccagcccccgcgcacgtcatctcattgtcgatatgccccaaccggtgcccgacctcatgattgatcaccatcgtgcgatatcgcgccaagtcgccgcctcccgacatccacacgtccgtgccggaattccaacgatcatcgttgataatcacattgttgcccacacggcagctgtattgctccgaacataccgacgaaaacgtcggcaaggtcgacgcttgggcgagcacgatatcgaaatcgcaattgccgtccgtagaaggttcgaaaatcgcgcctgcgcgcccatccatgttcgctgttcagaatacgaaacacggcattcgaaaaatcttcgactgatccgacttcaccattggtgaccacacagtaatgatattgcaccatgccatatccgctgttttgcgccgtttgctgcgctttcgcaagtatttcgcttttctgatcgtccatcagcgcggccgactgctcgcgaagcgctttggtgacggcgtcttcctgcggttccgccgtttcctccgctgaggcctttgcgtctttcgtttccgacgattcctaggttttcttctctgattgttgcgatttcttttcggatttcgcggattgatccgttttttctgaatgcgttccggaattgccgatctgcgccgttttcgcatgtccgttcaggaccgcgttgaccagcacggcatgcacgctgcacgacgtacatgacacgatgacgcataatgcaagaatccaagccacgacgcttctgcggatgcggaacgcttccgtccgttcccggcggctcatggtggcggccgctttcggatcgagcgcacgcagaatggtacgaattcgcttcaatccggcctccttataaccctgccgtcacgcaggtggcagcatatctcttccgcggcaacactaccagccaacagtaggcatgcaaaaagcctgcttcccccgtaccggaaattttccgaggaaaacaggctttatgcaacagttctcatatatcaaacgcaacttatgcgacggtcaggcaaacaagtcacgaatgattgaatgcgatcaggcgaacaacttgaacacgaacgcacccacgatagcgcccagaatcggggcgacaaccggaatccaagcctcgccccagcgggaggagcccttggacgggatcggcaggatggcgtgcagcagtcgcggcatgagatcacgggccgggttcaggccaggaccggtcgggccacccatggaagtcacgagaccccacacaatgaagccgaccacgatggaagcggcagcgtggtccgcttcgccccacggcatggacaggcagcacagggcgccgaacacgagcacgagggtgccgaagaactcgttgacgaagtagttgatgcggtcgttgtgggcgtcggtggtgcagaaggtgccgaggatggcgttggcgttttcggtgtccttatagtgcgggtagtaggtgatgtacaccacgagctgacctgcggcggcaccaagcagctgggcgatgatgtacggcagcacgaggctccagtcgaacaggccgttcacagcctgggcgatggtcatggccgggttgatgtgcgcgccggagacggcaccgaacatgagcaccgggatcatcacgccgaagccgtagcccatggcgatgttcagccagcccgcatggtggcccttggtgttcttcagttcaacgttcgcgacagcgccgttgccgaagatcatcagaatggcggtaccgaagaattcggccgcaagtttgacaaaagtcgagtattccactgctgtttcctctattgcttcttctcaataagaatcagattgatgtcgattccgctctcggcggacaacagcgtccaacactactccccgcactggaagtcagtaggccactaggtatgacgtcatagcgctggtttcatatgttggatattgcactcgtagtttgattcggcaaaccgcggtttcgccagttccaccattatcgtcagtactgccgaccgctgggcagcgtcacatcgaattcggaattatacgattgcgtttcgttgatatggtatgcggatccgccttggctgacccaagtaccgccgaattgttcggctttgtcgtcacctgcggatttcatgctgccggtccacgtaccgccagtctgcatagtcatctgcatttcggtaatggtcagacctgccgccttggcagagaatccccatgtgccaatgagattgcctttcgcagccttcttcggtgtggtcagcgtggccacaaccatagtgctggctttatctatagatgatgaatccactccgaagaactctgcaataccgatgtcttcgccatccctgtagaaatgaagattagagatgtcgtactgcgcgttggagcctgtcgacctgcccttgccaagagtgcccacgatcttgtcttctgcaatcagagtaacacgtcattattctcagacaaagaagcaaatcgatgatcggactgcacgtgggcctttgagcatgtaggaaccaaagttattgcctataccctcggaagttattaccagggtggacgcgccggggggattgaacctggaacgcgtgtcttcatggagtgatgaggcgtcggccgacgtgcgggagccatagtgagtccgtcgcgggaagccagtagggccggtacgtaagtccatccacgggaattcatcgcaaagccttttccttagcatcccatttcctccacccgctggatgttttgcccgctggaaggcttgcttccgggtagattcccccagtcactggaggaatcaggactccgaagcgtgcgccagcgggtagatttccccaccggctggaagaatcaggacgctgagacgccagtcgatgggtggattcctccaccgactggatgtttcgccccgctgaaaggcttgctttccgggtaaattcccccagtcactggaggaatcaagatgctgaagcgtgcgccagcgggaagcttcctccaccgactggatgtttcgcccgctgaaaggcccacttccgggaagatccctccaccgattggatgttttcggactctgggatgcttacaaacgggaagattcctccactgactggaggaatcaggacgctggagaaccttgccgatagtacggatgcggagtacgaggaggataggcccgagaaacagtttctacgcaaactgcagtggatgtgggagtagacatgcgagcatcagaaaacaaaaaaccttggaaccggagttccaaggttttgtctgtgccccctcagggattcgaaccctggacacgctgattaagagtcagctgctctaaccaactgagctaaaggggcgttggtcttgcgaggttttattctcgctgagcacgagaagtaaatatactcagaatcaagaagaacgcaactctcggcgtgtcgcgattgtagaaccgctatttttcaacgatttcagcatattgcataaatcacagaaaatgcgatccagccatcatgttccctatctaaacagcacagccaaggcaggaaatcacaatttcttcacaactgtcgttccgcgtaatccaatcgccccaaacacttccgccaattcatttcgctaatttatttgcacggccatgcaatcattctccccgaatccattgtccgaacaccatgcacgcgcatcagccaccgaaccgaactcctccccggaaagaagcacgtaataatcggcctcatgcccataccgcgtgtagtagctgtagtccgcggcccacgccaacaccgccttcggccatgaagcgcgcaatgtaagatactgcgcgtaaatatcgcggtattgctgggttttgccgtcgacttccataccgtatttacgactgaacagctgcgttgtcggaatgtcgtacagtccggaaaccgccgaccggtcatgagacagctgccagctcaacgccagctgcgcatagcgttccgcatcggagtcggcaatgttcgcaccaccccttgcgtctcccacactcgcaaccgcattaccgttcggcgtcgcacccttctgcaccaccatgctggtcgacttggtttcgatctggtcggacgcacgccagtactgccctatcgcgtacgccagctcgagcgtcgctgtgccgcttgtgaactgcatcggatcggatgcgaagtcgtacaccgcggacgcgatcacctcattgctggaatccttgatggagattgtgacgtcctcgcctttccacgcggtgtcaccgcaggcgtgtgcagagaacgcgacggtcgcaatcatcgtggttccgtttttctcgacactctccaagcccgcgtcgggcgttgtcgcgcaatccttggtttgcttggccgcatcgttctgcttggttttgttggattgctcatccgcgttttgcgccgaatcgtcaccgctattacgattggttgatttccatacaacaaatcccgcgattaacgctatcaccgcaataattacaataattgcgatgatgattggcttcttgcggttcttgcaatcattggcttgcggatcagattgcgttccggactgcatgtctagctgcaggcttgatggcgcgggcatgggaaccggaggatatgcggccgttgccggcggaacatcgatgtgagtggtctcagccggctgagcaccttgtgtccccaacggaaaaccgcaggaaccacagaatcgcatatctgcggtgacggcaacgccgcactgcggacacacggaaggaattcccgcagccgcatggccatcctgcaattgcgcggcgccgcgtttggcgcttatatgctggcgcataagtccgcactgcatttcaagtggaccggtgcgatcagttccgctatcgtcggtgtgctttccggtttggtggttgttattctcgccgccattttccctgcgaaaatcggaggatcgtacgcatattactccgcgtccgcatcgctttccggagcatcgttccgcacgttcttcatggcgttcctgctggctggactcggcgcattggccggctacgctctggcgcaatttgctcccgattccaataacatgttctccgccacttggcgttgggctcatcgcacgcgcggtttcgtacgcacgcttgttgaatctgctgcgatttacggcgtattgttcctggcgctcggtctcgttgcactgattgtggcgacggccgcttccggaagcgcactggccggcatactgctgattccgctgctattgcctgccgtaccgttcgtactgttttccgtatcttcgttcggtggtgtcacggcttcggtttccgggcaatcctcctacacgctttccctgttcaatgtcgccagcgtcacccaatacgcttgggcactgtggatttgctttgtgcttttcatcattgcaacgatttacattgcgcttcgtgaaacggcacgcaacatgtatgacccgtattatgcgaagtgggagaacacatggaaggctcctgtcgccgtgatggtgttctggcttgtcgcggaattcctgtgcacgaatttccttgccggatacagctcgaatacggtttcgacgatggtgccaatgtggtatttcatcgtcgccggcatctgggctttcctcgttgaagtgattgcgatgacgtttggtccgacgttggttgcgtcgacgccgggattgtggaagattcttgttggcggtaccgtacagcagactccgcagaacgtcgtcgattacgtcaaggcttgcgatccgcatttcggccaaccgaaggcagccaggaccgcagcttccgcgcagaccacgcagaccgcgcaatacaacgcgcaatacaacgcgcagtacgccaatccgtccgcgccagcaacgtcaccagccgcgcagaccgctcctacgcaagcgatgcccgctgttccaatgccaaccacgccaatcccagcgccagctgcttcggttccaccagtaccgcagtcaacggcttcggttcctcccatgccacaatctccggccgacattccgatgccggccgttccacagggtgaaggaaagccactcgacccaaaaactaagaagacgatcctgatcggctgcatcgtcgccggtgcactgatcgtattgggcattgtctatggtgtgctcaattcgaccgtcttcagcgcgaaatccatggcggaaagctatgtgtcggcaatcgccagcggcgattacgacaaggctaacgacattgccgatcctcaagtgggtaaaaaccaacgcaagctgctttccaacagcgtcgccaagaccgataacgcgaccatttcgaatgcgcatgtcaatggcgtgaaatccggcaatggcacaaccaccgcatcaatcagctactcgttgaacggcgaaaccgtcgatgaggaactcacgatgcacaaatccggcaacaaattcctgattttcccgaactggcaaatcaccacgccactgatcaagtccatcaatgtttccgtgccaagcagtgtggaatcgttgacggtcaacaaggttgcggtcacagccaaaaacgcggagaagacggattccggcgaatggcagttgcgcgtatacccgggcacgtacaacatttccgttacgagcacggattatatcgtcagcgaaacggtggtattccgcacgaacgaagacagcgattcgccgaccacgctgaaggtgacgaccaccagcaagttcaaggatgcattaagcaccgccgtgaacaacgcgctcgacaagtgcgcggaatccaccgactatgcgccggaaaactgcccgttcggcttccgcgtatgggatgaggataattaccgtaatttcgcgtggtcgatcagcgtctatccgaaaatcgacgaagtcgaccttgattatggcgcttttgatactaaaaccggtaaggcaaagtgcacatacgaggtgaaagacggcgattcttgggatccggatgatgatagtacgacgttcaatgcgagcggatcgttcgctatcaaggatggtaaggtcacggtcacgcttgatgacggtggctacagctattaaataaagtatgaaaatccccctgcatagctgttttcagctggtgcagggggattttccatgcttaagctcagacgtatctcagtctgaagtcattcgccgtaaccgcaatgaatgcagccatagcgaatggggccgaatcactcagcgacaaccttcacggtgaaggaagcggagatttccgggtgcagagcgacggttgcagcgaactcgccggtggtcttgatcggatccacggtgatgttcttcgggttgacggcagccttggaagacagcgcgatggcgatcttgtcggcggagatgccaccgaacagcttgccggactcggagaccttggcggcgatttcgacgacggaaccctcgatgagttccttggcggcaacagcctcttcgcgggtggcaacggccttggccagacgagcgcgcttcatggcctcgatctgggcggcagcgttcttggaccatgcgaagcccagaccctgcggaatcaggtagttgcgagcgtagccggccttgacggacacgacgtcgcccgggtgacccaggtgattgacggacttggtgagaataaccttagtttcagccatttttcaaacctctctaagatcagcgaccggaagtggcgtacggcagcagagccatctcgcgggcgttcttgatagccttggcgagctcgcgctgttcctgcacggaaacaccggtgatacgacgggaacgaatcttgccgcgatcggagatgaacttgcgcagcagggcaacgtccttgtaatcgatctcggtgaccttagcggccttcagtggattcggcttcttcttaaacggcttgaccggcggctgcggcctcttgcgtgacatcttgatgttctccttacaatctggaaattgcttttcttttaagctgcgatccgggccggatcagaattccggttcgtcgctgcttccgccaaattcggaggagccaaaggaaccgaacgatgaggaaccggaattatccgaattgccccacggatccgatgccggagcaggctgcacggcgggcgcggcattggctggagcggcagccccaccctgatagccagcgccaccggaatatccggcaccgccctgatagccaccggcattgccggcgaagccaccattgttgaatccgccattgccgccagcgaaattgttgccgccgcgattgccggcaaaattaccaccgttggcactggaggttcgggtgacctgggcggtcgcatagcgcagggacgggccgatctcatcgacctgaagctcgacgaccgtgcgctgggaaccatcgttcgcctggtaggaacgctgctgcaaacggccttgcgcgatcacacgcatgcccttgctcaggctctgcgcgcaatgttcggccatgtcgcgccacgcggagcagcgcatgaacaaagcctgaccatcttcaaactggcccgtattacggttccaggtgcgcggagtggaggcaatcgtgaagctggccacggacgagccgttgccaaccgtacggatttcgggatcagccgtgaggttacccaccacagtgataatcgtttcgcctgccatcgttacctacttactttgcagcttattgttttgcagcttgaaaagcttggaattacttacttgcgaagaatcttcgtacggatgacggattcgttcaggttcagcagacgatcgagttcgtcgctggtggccggctcagcggagtagttgaccacaacgtaattgccttcggtcttgccggcgatctcgtaggcaagcttgcgacggccccagatgtcgatgttctcgacagcaccgccttccttggtgacagtttccagatactgctcggtcaacttcttcagaccgcgctcatccagctcaggatcggcaatgaacatcagttcgtacttatgcgcagacatcacccacctccttcggactatcggccatggaccttccatggcaggagtgtgtatgcgtactgccttcacgcatctatatatgaaaggtataaagatacagttcagacaacctgttcagcatagcccttctgctggacgagcggcaattgcgcacgttctgtggtgcaggcgcgtcatgggcacccgcattgttatattgaatacggctatttttgtacggttggtaccgtatttacgcgactctagatttgtggaaggcgaagcatgtcggcgattctcgaaggcaccccggataagaaattggctttggtgacgggtcgtgcgtaccctgagcaggcccatgaaaccgcgaaatacctgggaatcgacgtacttgagaccacggcttacgatttcgccaacggcgagatgtatgtgcgttacaccgagccggtgcgtggcgccgatgcgttcgtgatgcaggcgcacaccgagccgatcaacaagtggattatggagcagctcattatggttgacgccatgaagcgcgcttccgcccgttccattaccgtggtcgcgccgttccttggctattcgcgccaggataagaagcatcagggccgcgagcccatcaccgcccgactgattttcgacctgttccgcgcagccggcgccgaccgtattatgacggtcgatctgcatgccgcccaggagcagggtttcttcgatggaccggtcgaccatctcaccgccactccggtgctgcttgactacgtgcgcaacaacatgccgcttgagaacaccaccatcgtgtctccggatgccggccgcatcaaggtttccgaacagtgggccgcgaagctgggcaatctgccgctcgcgttcattcacaagacccgtgacaccacccgcccgaaccatgccgaagcgcatggcattatcggcgaggtcgaaggtcacgactgcgtggtggtcgacgacatgatcgacaccgcgggcaccatctgcgaggccgtgcgcacactgaacaacgctggtgcgaagtccgtgacgctggttgccacgcatggcctgctgtccggcccggccgtggaacgcctgagaaattgcggtgccaaggaaatcgtgctcaccgacaccgtgcccgttccggaagagaagcgcttgccgaacatgaccgtgctgtccgtggctccgctgttggccgccggcatccgttccgtgttcgaatccggatccgtttccacgctgctcaacggtctgcccgaagacatgcgtccccgcaatatctacgcctgattcgcgcaatcttttcaacgtaacaaaaactcgcccccatccggtcggcgagttttttaatgtcagatcttcccaaaaacggggtgccgcatcctacgtcggtaggatgcggcaccccgcgtatcaagagagaaaagagaaatctggctagcgtccgataggcatcctcgcttccgttatttggcgaatgcttcgcggatttgcgcggcattgccgtaggaggcctgcgcaccataccctgtggcggcgtatgccgaaacatacgaggcaagctcggccgcttcggaaagcgccatgcccgaggcaagaccggccagcaccgtgcccatgaaggagtcgccgcagccggtggtgtccaccgcgttcacatgcacgggggcaatgcgctggatcggcgttgccgaagtggaatccaataccacggaaccatcgccgccgagcgtcacgatcgcctgttcgaaaccgaatccacgcattgcttccagcgcatgattccaatcgaaaccgtcccaatcgtcgttttccggctcgtcaatgccgagcagctgcaccatctcatgctcgttgacgagcagaatatcggatgcttccaccagttcggacggcagcgacggggtgaacggcgaatcgttgagcagcactttcacgcccgcttcatggcacatgcgcgcggcggccgtcaccgtttcgatcgggctttccaagcacaggccaagtacggaagaccgtgccagcgcatcgcgcacggattccacataatccacggtgacctgcgcgttggatcccggcgagtacacgatggtgttttcgccggttgcgtccacggtaatcacggttgtgccggatggtccgagcacgcggcgaacatgcgtggtgttcacgcccgcctcgcccagagcgccgagtaggaagtcggcgttggaatcggagccgaccgcgccgaacatctgcacggttgcgccgatgcgcgctgcggcggccgcctggttgccggattttccgcccggcagcagctgcagcggaccgccggtgatggtctcccccggccctggcagacgctgtgcggtgacggtgtagtccgcgttcatcgagccgattacggacactgtgccgtggatgcggtccaatgcggagagaacttcagtcgcgctcatctttaccttccttacatcaaaagaagatttatgaaaatggagatttgcgaaatagtgttgttcagtaatcgcaattatcgcaaatccccatttttattatattgaggatgtaatgtgcgattactttgccgattcctcggtttccagcgcatggttgccttcgtagatcttcttcttgaagacgaagaacacgatcaggccaagcagtgcggtaccggcggcgaccagcagcaggttggcatagttggcggcagtgccggttgcgccggtgatggagccgcctgcgagggcgttggagccgagcaggctgccgatgatggcgatgccgatggacggggaaacgttcatggccagatcgttcatgccgacgccacggccggattcgtccttttcaatggtgcccagcacggtggagaccaccggggagtacatgaggccgcagcctgcgtagaacacacatgcgcacagggtcagcaccacgaaaccggagttcacgcagaatgccgcaccggtccagccgaggaacatgagggtgcctgcggtcacgatgccggccttgattccgatcttgcggatgatcatgccggagcaggtgcccaccacggcggcgaccacgaaggcccacacaatgtgcagggagacctgggtggtggtcatgccgtagatgttggtgccgatggcgttgaagatcgggctcagtgcgtagttcacgaagtagaacacgaggatcaggcagatggcgcgcagccagcgggtgttcttgaagaacgccggggtgatgaacgggttggaggccttgttgatgtagaaggcgaatgccacgaacagcagcagggagaccacgagcatccaccatgccatgtacgagaagaacagggtgaggaatgcggtggcgaagccgaagatcacgaagccgaatgcgtcaaccttctggccgttgccgctcttggacggcagggtcttgagcaggatcggcaggaacaggatggtgacggacgggatcaggaacaggaactgccatgcgatggagctgagcatgccggctgcgaacacgccgatggatgcggaaagctggtatgcggcggtgaacagaccgaagaagatgaccttcaaatcgttacgcaggtacttggtggccaccaccaggaaggcggaacctgccacctgttcgcctgcggtctgcagcacgcgtgcgatgatcacggtccacaggtttgcggcaaagaagtagtttgccacgaaaccgaagatggagccgacgaacagcgtcacgagaccgacggtcacaagcttacgcagggagacgaaatcgcccagggaaccgtagatgaagcacacgatgccgagcacgatgctcggaaatgcggtgatcagggacgcctggttcggtgcgccgacgtcggcgccgacctgctggaacaccaggttgaagccctgcaggcacagggtgccgagcacgaaggtgatcagcagcgggatcagggcgcggatggccatcttgttgctggtcaccggatcatcgaacggatcggcggatgcggtgccggtcacggcggttgtgttgttagacataataaaaatccttgattctctcgaattgcgcgatatgcgatacgcgattgcttggccggttacgcttattcagccttggctgcgaggccggagatgcgggtcatgaattcgttcaggaagcgcggcacgtcgacgccgacggcaaccttcatggtcttggccgggtcattcaggcgggtttcgtcgccgatggtgcgtccgcgggtcgggccttccacgtcgaccttcatattgatgtcgagggtggtgacgagggtcgggtccactgccacgccaacggcgagcggatcgtgcaggccgcagccgcccagatgcggggacgtggtttcgtaagccttgatgtagaagtcggtcatgtcggccaggaacttgccggccttggtgccgaggtcgcgccactgctgagtttccttgtaggtgagcagggtctgcagggtcacgtcgaggccgatcatagtggtcggagcgccggaacggaacaggtagtcggcggcttccggatcctgcgaaatgttggcttccatgcaggcgttgcagttaccgggcacggtcagtgcgccgcccatgagcacgatctggccgatttcatccttgatttccggagccttcttcagtgcggcttcgatgttggtcatcgggccggtcggcacgtagacgagatccttgccataggtcttcactgcgtcgatgatgaagtctaccgcggattcggtttcgacggagcggttggaatcagggatttccacatcgccgatgccgttgtcgccgtggatgaacgcggagattggcaatacttcgaaatggtcggtggtgctggagtgcggcaaaccctgatacaccttgacttccgggtggccgagcaggtcggtcacggccagtgcgttgcgcacaccctgctcgacgagcacgttgccgtaggtgccggtgatgccgatcagttcaatctccgggcttcccagagcatacgaaatggcaagcgcgtcatcaacgccggtatcaagatcaagaatcatctttttcatgtgtgtgcctttcctctttgacggcctgacgacggtccgccaccatacgggtgcgtcgtcagttatacatcgagcgcattctcgattgtgttgtgttgacaagatttatgataaagcgttttatcaagaacgcaaattcttcacctatacacggcgtgttgcctgtattcccaacgattacagcatattggagatgcttacgtcaccacataccgagattgatctgcaccacccgttttgcaccagtctgcagcatctaaaaatggcggtttacgcgcaggccgcctgcaccagtttcggcgtaagcacttcaacctgcggatcggaaagccacggacgggcatcccctgattccgtaccggacttggcacgaaccgcaacatcaatccgcttacgcaacataccccaacaagcggcggccaaatcagtcacgctctgctcaacggtggtcatacgccaaccaagaccgaatcgtttgagaatattgtcgtaaccaatcacctgcatatcctcagtaacatgcaacccacgctccgccatacgctgacggaagccaagcgccatcacatcgttgcagcagaacacggccgtcgccccgccatcgatgatctgattcgcggcacgatagccgctatcgaaacggtaatcaccctcaacacacagcgaagaatcaaaatgcttccccgactgctcgatggcatccacaaaaccacgacgacgctccgcggcactcgactccgcaatatcgccggtgacaatgccaatacgagtatgaccaccttccaacagatactgggcagccaaacgaccaccaagatagttgtcaaaaccgacggcatcgcaccagccgcactgcgtcaaacggtcgatcagcaccaccgggcacgacacaagcgccacatcctcacacagctgctcaacagcactcccaacacacgactcacgcgccgggatcaacatcaccccatccaccccacgggcaggaagacgctgcaacaactcatgctccgcagcacgcgaatcatcggaattggccacaatcagcgaatacccctgcgcggcgcactcatcctccacacacttggcaagcgccgcgaaaaacaagttctcaatatcaggcacgatcagcgcaaccagctgggactgcttggtcaccaagctacgcgcgctctgattcggcacataattcagcttcttcgccgcgtcggcaatggccttacgcttctcctcagacacgcgagccggccgattattcaacaccagcgaaaccgtcgtcacagacacccccgcagcagcggccacatccttcaacgtcgcacgatacgccattcaaaccccttaaaacgtttctccttccagcataaatgccacgcactcctgacgcgcccagcacccccatccacaaacaaattcctttcatagcaaaataatccacattatttccagtggtaaatcgtttctcagaaatgtttttgtatactcgcaacgttttgcttaatacgaaagccacagagaagagaggaaccccaatgcaaccaacagcacagaaaaacaatgcgagacagcgcaagaccatcgccatcgtcgccgtgatagcagtggttgccatcgcgctcgcagccgttgccatcatcgcagtcgccaataagcgcgaaatgacgcaagccgccagcgacacctgcacgttgaacgcgaaggcgctcgccacgcatcagcaaaacttcgaagaggctcagaaagaagccgaagatgcggcaaaactcaccgtggacgacgtggccgacggcaccacgctggaaaccctgaaggatgcgatcacgctggccgaagccgtggaaaacgcgccaacatgccccgcgaacggcaatgccagcgacttcaccaaggcgacagacgatattcgcacgtacgccgacaacctgcgcaacatcaccaacgaactcgacgcggccgccaagtcggtgatcgccagccaggaactcaaactcgagtccgccaagtaagccgtccgagccagacaagccgacagggcgccgcccccagctccgccacccctgcgttcaacggggccaagttgcgttttcaaacaactttgacctcgttaaagatgactttcgcaacgttttcacaacccgataaccgcccataccgcaaatcgatacccccttccacaaaaacccgaaagagcttattaacggggtcaaagttacgttttggacgacttcacccccgcacaagcgctttcgcaccgtatctggcttatatatggcagattcgacagtccgaccggaggcatttcctgacgaagtcagctacttgcaacacgttatttcccaatcgccacttgccgaacccaattaccaagctgcgtcgcatccaccatgacgcaccgtcacaaacgttcccgtccgacgcgctttactggccttgggcgcggtagcgggcttcggtggcggctttggcgggctcccaccaggcgcggttggcagcataccaagcgatggtcgtctgcaaaccggcttcgaaatcggtgcgcacaggcttccatccaagttcggtacgcagcttgctggagtcaatcgcgtaacgccgatcatgcccggggcggtcacgcacccagtcgaacgcatcttcggcacatcccataagccgcaggatcatacgcatcacggcaatgttgctcatttcaccatccgcgccgatcaggtatgtttcgccgatccgcccgcgtgtaagaatcttccacaccgcagaagagtggtcttccgtatggatccagtcgcgcacgttctcgcctgtgccatatagtttcggccgcacgccctccatgatggaagtgatctggcgtggaatgaatttttccacatgctggtacggcccgtaattgttggaacagttggaaatcgtggcgcgaagcccgtacgtgcgaacccaggcacgcaccagctggtcggatgccgcttttgacgcgctgtacgggcttgacggcttatatggcgtgctttcggtgaatttgcatggatcgtcgagcgcaaggtcgccgtacacttcgtcggtgctgatgtgatggaatcgcacgtcatgcttgcgcgccgcctcaagcaggtggaacgtaccctccacattcgttgtgatgaagggttcaggattggcgatggagttgtcgttatgcgattcggccgcgaaatgcacgatcgcgtcatgcccgggcacgatacgttccagtagtgcagcatcgcagatatcgccttgcacgagttcgacttgcgattgcggaagaccggcgatattctgcggatttccggcataggtcagcttgtcgagcacggttatgcgcacgtcaggatggttgtgtgccacgtagcgcacgaaattggctccgataaacccacatccgccggtcacgatgatgttgcgcggcttgaaaatctcactactcaccatttcagggtaccggcagggttgcatagttcatggagcaatttcacacctacctcatatatggcagatttggaaggctgaccggaaatatctacgagacactcgttcgtccacagctgaacactaaaatgtacccggtttaattgtacagagcctccaattataagggggctatctttttgaaggatgcgacgatgcctattttttcgcctgaccgtcatgctcacgttccttcatacgtaaaacttactaagcagccgattgcgggtggaacatatcgccctcttgcggacagcgaaggcagcaacgcctgtgctccatccgccctttcaggtcaccacagttcaaaactgtatacgcagaaatcagcaattcacgccatctccgataacataagcgtttttatttcaggcgctggcaccctgccctgtttaccggagatggcttccagtggatccgtcagtaaagccgaaatagacaataacgaacaaatcgcttcttctgagctccagccccatcaacccgctgagcagcctttgaatcaggtcgtctcggtttgcaaacgagccgcacatactacggcaaaaacgctttccaccgcagggcacacggctgtaaaagcaaccaaagttaccggtcacgccatccacaccgctgccacagcggtaaagacctcatggcaaactttcaccaatttcaaagccgttcaactcatcatcaaattcttcaaaaaagcgtatggcctctggaagaaacgtcatcgcttctcattctcgttctacgccattgttctcgtattagtcaccgcttttgaggtcgtttttcttcagtggggcatgtacggcgagccggaatatcctgaaggctcggaaattgacgatacgaccagagttttgcaaagtgttattgggcgcacgacaaaattcgttagccagatctggattgaccatcaataccaagcattactgaatttcatagttttgggtgttatttaccttactctggtgctgattctcaatcgtttctgggttgcttcagccatctttggcacagttatgacagtatttgctgtcgccaatcacatcaagatcgagtcccgcaacgaacctgttattcccgccgatttgaacttcatcacaggaggcaatgcgggagaactcacttcctttattccaaattccagtcaggctctagttgacggcgcggtagctggcgttatttgctttgtggccatctgcatcgtcatgcaattccttgatggcagaaatgcagtcatcccctgccactggctacacccgtttgccagcgttaaaaattttgccggcacgattacgcgcattttgacagccgctctcagtactgcactcgtattttccttcgtgtggggactcggagcagacgattcctgggctacaaaatttgcccacaatctttccgaccgcccccagccttggaatccaattgctgacgctaccagcaatggtcccgccatcaatttcctccagcttgcacataccaagatcatggataagcccgaagattattccgaagaaaccatgaccaagattacaaagaaatactccaaggaggctgattccatcaatcagtccagaacaaccaatctgactgataacaccgtaatcatggtgctttcggaaaccttctcggatcccacacgagtaccgggcgtaagtttcgccgaagatccgatgccaaatattcgacagatcaagcgcgaaacaacatccggtcttatgctttcccccggctatggtggcggtactgccaacatcgagtatcaagctctcacgggtctttccatggcgaattacagcgataccctatctatcgcctatcagcaattagttccgggacaaaagtgggatcagtccctcaatcagctatggaatgaaaagaatggcgaggactcttctgtagcctttcacgcatacaaccgtggaatgtatttccgcgatatcaactataagaagttcggattctctaaattctacgccacggacggaacacccaagctcacagatcttcatcctatagattcggcttggtattcttccgatgaatcgttctatagccaggtgttgaaacaggtgcagtcctctgactccaacaagttctatcaggttgtgactatacagaatcacatgccttatgaggaggatttatacacagataatcagttcaaagaacttgatacttccgaaaatcttcaggagaatgaacgactcaatattgagacttacactaagggtcttaattacacagatcaatcaacgttagatttccttaatcagctcaatgacatcaatcgtcctatcactgttattttctacggggaccacttacccggcatctatagcactgcctactccgattcagacaatattcttggtcttcacgaaaccgattacttcatttggtccaataatgcgtcttctgctgctggaaccaaacttgatgacgcgtcctccgcatacacctcatccaactatttctccactcaacttgcttcacatctcaacgcaaaggtgagcccttatctggcattcctgacggaaatgcatcaagccatatctgctatgtctgttccttcagcagcgggaggcagctctgaagaaccggtatatctcaacgctgctggggctcgtatgagtaagaaggatctttccgaagaggctaaaacactactccatgattacaaactcattcaatacgatatgagtgccggtaagaattaccttaaagacactaatttcgtagagcttcagtagattcgtgttcctcatcaccgccagtttctacaatagtgctagtttgtcgagaataacgaaagccggtaactatgaaaattgcagttgcaggaactggatatgtaggtctttctgtcgctttgctgcttgctcagcataatgaggttcatgctttggacattgttccggagaaagttgagcttctaaacaacggtaagagtccgattgtggatgctgtgattactgattttctggagaagaacacctccggcgagcgtcctctggacttccatgcaaccgttgacccagaagaagcatattccgatgctgatttcgcagtgattgcaacgcctacgaactatgacgagaaaaagaattattttgatacttccagcgtcgaagctgcgatttccgcagtacgaaagtatgcgccggaagcgtggatcattattaaatctacgattcctgtcggatacacgcagcagctacgcgaccgtttgaacgatgatcatattctgttttctccggaattccttcgtgaaggtcacgctctgtttgacaacttgcaccccagccgtattgttgtcggtgctccgcaggatgacgcacgttccgtagaggccgcacgtacttttgtggatcttctggctcagggagcagcccccgaagaacgctctcgagtcaatcatgatggcagtacaggcattccagaactggtggtgggcactaccgaggccgaagccatcaaactgtttgccaacacgtatcttgcgttgcgtgtggcttatttcaatgagcttgacacttatgctgaaagccgcggactgagcactcgcgaaatcattgacggcgtttgccttgatccgcgcatcggcgacggttacaacaatccaagcttcggatatggcggctactgcctgccaaaggacaccaagcagctactcgccaattacgatcaggttccacagaatctaatcgaggcgattgtggatgctaaccgcacccgcaaggaattcgttgcttctgaagtgatggatcgcatcaaagatgtgaaagatccgattgtcggtatctaccgcctgaccatgaaatccggttctgacaacttccgccagtccgcgattcaggatgttatgaagcagttcaaggcaaacggcatcctcgtactgatttacgagccgacgctagatgccactgacttcttcggcagcgaagtaacgcacgattttaattcgttcacggaacggtctaccgtcatcgttgccaatcgctggaatgatgaccttaacaaggtatctggcaaggttttcactcgcgatttgttccgtagagactgacaattcttttaaagccctaatgaatttctagggcacaactaggaggggcgtctggtgcttgtatgaaccgcaccccgattgttggactgaggaaattcagattcgatgatcggaggtgcggttcatactcagcataacggctcctcggtaatcttctctcatgcgatagtgagacactattgttccactactccatctcctaccgtatcccctttccttcatatgcgacaagataaatgcggttttgaaaggacaaatgtcaaaaatgctgcatccgcaggcagattaaagcaattcggcaaaaacaccaatccaccaaatgatgtgacggcataagccaacacacccatccgaatctacaccctacttaaaataagggggtaaacactttgatgaactagctaaaggagcacatcatgagagaaaagaagaagcctaagaagcggatattatgcgcgataatatcatgttctttgttggcaagcataggtttcgcgcaaccggcgagcgcagctgacaccgcagtagacacgcccgcagtccaagacgacatcgagacaatgtcttattcagatggcacgtcgaccggtacttcagagcttaccggagtgtcactgggaacaggaacaaccgtatacgcgaaacaattcatcaaccaagtggacgtctacaactcggcactgaatgaagtcgtgaaatggcgtcgagacgcgctcaacgacaaacaagtaactttcggcgtctacaactggcagaccaagcaaaccgattactattcagtatcggattacctgaagaaacttggaatctccgaaaacgaatatctaacgccaaaatggtctaatgcgttggaacgaatcgcaattcaacgagcgattgaggcatattctgcagaggatgcgcatactcgacctaatggagagagctgcttccgagccagctataacaaaatccaatcagaggcagaaatactcgcatggggtcctgccaacatatccggcgcaattgatttatgggccgaagaaaagaaagactacgtccaaaacacaggagctgaagtcgggcattatcttactttgatcaatccaaactatgagtattatggtttcgctgcaggagatggacagtattacagaacaactttttctggagaggcaggaactcgcagcagtgccgctgaatactcggattcaactccgacgaacatgcgaggcctagggcaattcgaagtcaacgtggatgacgatgatttacgagaaggggctacttggaacctgtcatcgatgaagtctggatccacgcaaaccgcaaaagtaacgctgaagcacaggtccggaagatatgagttcaggggcacatggggatcttccaatgcgaatgtgattagcgccaaccaaagtggcgtatataccgcggggaaggtaggaactgcgaaagcaaccgtttcttctgggtctttcgctttttccacggatgtcacggtcatgcctctcactttgaaatatgacggcaatggagcgacctctggctatgtagcttcacagacaggatcccacaatgatgagatcacagtggcgaagaatggtttcagccgatcaggttacactttctcgagctggaacaccaaagctgatggtaccggcacttcatatgcacctggatccaaaataacccttcccgctggcgataccatcttgtacgcacaatgggttgagaatccaaaactgacgagacttgccggacagacacgctatgacactatggcaaccatcgttcaacacgaacagacaaaacaaggacaaaccgtcatcatcgcttctggagagaattatcctgatgcactctccgcgtcaggcttagccggaggattagctgcaacgattatgctcgtcggatctaactctctgcccagccaaactgctaaccgtcttgcctcacttaagccgaatcgaatcatcattatcggcggtccaagcgcaatttccaaaaatgtagaaaacgcactccatcaatacagctccacagtcaccagatattacggagaagatcgttatgaaacctctcttgcagtattcaaggcggggcagaagctgggagtaaaatggaattccacagcgctaatggcaaccggagataactacgcggatgcgctctccgcgtcttccttggcttacgcgcagaagatgccgattttcctgtgcagttcagcttcaggattctcttcatcccaactggatgccatcaacaaaaccatcaaacagggtcttgtaatcggaggcaccagcgccataccaaattggattgtcaacagccagctgcagcagcagcaaggcatatcaacaaaaagaattgccggcgcaactaggtatgagaccagcattgaaatcgccaaaagcgcagagcggtatgggttgaccgctgaaggtagcgtcttcgcaaccggcgccaacttccctgatgctctggctgccggaccgcttgccggaaagaaaaacggattcctgttgctagcggatccttttggaactacagctcagtttgttcaaaaatacaagaatcaagttaaaaccgcttacgtagttggcggagaacaagctgtttcttccaccacggctaaccagatagcagatagtctcggtctgcgtcatccgtaagtttcgtagataagagaatggaatggcgggatgccagcctaggctggcactggcatcccgccattccatttagtgagcaaacaccaccattgacttatcagatacggcttgttcctaagcagtcaatatgaagcgccttgtcattaagaagccctgcgaaattagtagttcctggatttcgaaccgagaagtagcatgagttctcatcactcgtaaaagcaagctgctcaaacttcctcagatttgacgtatccggaatcttgcgcatggtggcgataatcttaaaatctccatcattgaatatgctcagaggcaacgcaaagtgaatcttgttatgcccggcattgctgaatttaaaagcgacaccacagtcatagggcacaccgccgcgcttgacatccaagaccgacataggaatgtagaattctccgccgtcactatcacgaagatcatattcgacatcaaattcgaacgtctcggcacaggatgaaatctgcggggaaacaggcagaattcggaaagtgggcaccttctcactcaagcctagtgaatattcatcttccggattttcttttcgctctttatgctcagacttgagattttcgagagtataacgatcggcaacatcgttcttgtcaccactggcgataatctcgccgtccttgatcaggatggccttgttgcagtacttcttgacggaatccatggaatgggtgacaagaataacggtcttcgttggatctttcttgatttcggcgaagaagttgtcgcacttacgctggaatgcttcgtcgccgacggctagaacttcatcgagaactaggatatcgccttgagccttgatagcaacggagaaggcgaggcgcacctgcatgcccgaagaataattcttgagcttctgatccatgaaatcttcaagctcggcgaactcaacgatgtcgtcatacatcgcgtcgatttcagcacgagtgaagcctagtagagcaccgttcagatacacgttctcgcggccggtcaactccggattgaatccaacaccaagctcgatgaatggcaccagcttgcctttaaccgttacggaaccatgttccggagtatagatctgagaaataatcttcaacagcgtggacttgccggaaccgttacgcccgacgataccgaagaaatcaccttgacgaacttcgaagttgatgtcacgcagaacatgctgctcggtatagcctttgatgcctttcgtccaattcagaaaggccatcttcaagccagtagcctgttctgtaggcagacggaacattttggcgacatggtcgaccctgagcactacagggcgctcgtcaacgtttccctcttcagtcattgcaacctcagtcatgatttagagcacctccgcgaacttggaactgtacttacggaacacgtgaatgcccagccacagaatgaaaactgacaacgcatacggcagcaagcaaagcaacttgttatcaaccatgctccacacagtcggcacatactccggagaaagcagattatgacgaatatccataatcacctgagtggaaggattaagcatcaaaatattggcggcccagccgtaacccttatccgcaatcatggaaattgggtagatgataggcgttgcatagaacatggcctgcaatatgacttcccaaatatgagccacgtcacggaaatacacgaacagcgaagcaagcagcaaagctacgccaagaccaaggcaatacaactgaataatgctgagcggcacaagcaatactcgccacgtgtaatgcgcatgggcgaagaaaccgaagcagatcaccacgagcaggttgatgccgagagaaatcatagaacccatagtggtggaagccacaataatgtagttcgggaaatgaaccttacgcagcaaatcaccgcggccaacaatggattgcatacccatgctagtggattcggagaagaagctccacaagcaggtaccgcacaacaacgaaatcgggaacgtcggggtgccgtcggagaacttcaagaacttcacgaacaccacatacatcacagcgaacaacataagcggcttcaacacggaccacaccatgccgaggaacgatccttggtaacgcaactggaaatcggttttcaccagttccttgaataccactatcgcgtagtggtacctctttttgaggctgtcaaaaaagttcttcacaagcgtcctatcctactagtgcgaagtatttgagcacaaaaacgtatagcgtgcccttcttcagcagtactttcatatattctattgtggaaaggacgtttgtttcagtaaggcggaatatctcacatggctctcacaggagaacatcagcatccggatatcaaaatcttcgtgtcggcacacaagcctgctgttttccctgaaggaaacagcatcctccctgtacaggttggagtggccaatgccgcaaggcggttcgacagcacgctgcatgacgatgagggtgagaatatttccgataaaaatccccgttactgcgaactgaccgcgcaatactgggcttggaaaaacgaggatgccgactactacggtttctgccactaccgacgctacttcgatttcaccgataccccgcatcaggaaaacgactatggcgaaatcatcgattcctatatcgacagtcaaaccattgaaaagtatggcatcaacgatggcgatatctccaaagcggtagatggatgggacgttatcaccacgccgcttaatgacacccgtcgtattggtgggtttacgaatctcaagcagcattgggatgcggataggcatcttcgcctcaaggatttgcgtcacatgtacgacattctgtgcgcacgtcatcctgattacaaagcggatgctgatgcggtgctgaatggccatactgcagctttctgcaacatgtttatcatgaagaaggatattttcttcgagtacaacgaatggttgttccccctgctggatgagtttgccgagcatactgatttcagcaagatggatgtgcagactactcgcaccgtggggcatctttctgaacgtttacttaatatttttcttgcacataagcagcgcactggagccaattggaaaatcaagcgactgcagtgcgtgcattttctgcatccggaaccgttcgccaagcttgaaccgttgcaggagaatcctgaaaccattgtgcctgtggtttttgcagcggacgataattacgttccaatgctcactaccacgatatattcgatgctgaagaacgcttccgaagatcgtttttacgatgtgatcgtgctggaacgaaacatttctgacgagaacaagcagattattacgaaattccttgcgcaattctcgaatgccgccgtacgtttctatgatgtgagccgatatcttgcaggattcaatctcaccaccagcaatgcgcatatcagtgtggaaacgtattatcgtttcatcattcaggaagcgttgcctttctactcaaagctgctgtacttggattgcgatcttgtagtgaatggtgatgttgccgaactgttcgatacggaaatgggcgataatgctatcgccgcagtgccggatatcgacttcatcggcaatctcaatatgaaggatggtattcgcgccgagtatgtgcgcaagcagttgcatatgcgtgacgcctatggatatttccaggctggcgtgctagttatgaatttggatcgcacgcgtaagattcatacggttcatgaatggctgcagattgcctcgaagccgggatatatctacaacgatcaggacattcttaataccgagtgcgaaggtcttgttacctacctcgactattcgtggaatgtgatgcataactgtgctggacgtgtggcgggagtattcgatttcgcacctgcagacgtgtataaggcatacatggaatcgcgcaaggcgccaaaggtcgtacattatgccggtttcgacaagccttggaagaatccttggtgcgatttcgctccactgtattggcagtacgcgcaggaaactccgttcgttgcgcaaatgtacgccgccatgtcgggagtgcagaagccggaacctccggaacatcatgatcgggccattgctgaagacagtccaatccgtaaatatgtggatgttttagcccccaccggatccaagcagcgcgaacttatgaaagtcgtagcgcgcaaggtgcgaggcaagaagtaaaacaagtagcgctaccggtcatccgcgtatgtgttggggctgtccgttcctttaaggagcgggcagccccaacgcatatctctgaatgccctcacgaagttgcttagtttgtcagagccaaaccaagactcttagaaagccggccggcagtgttccagctaaccgcattagctcctcccaaaatgtacgcttcagacacagattccgcataagaagacacatagcttcccacattggatacggttgcatcgctgttgttcaccagcaacatacagcttgcatcacgaccagccaaaggacctccagataaggcatctggatagttttgccctgtagtgaaaacaacattgttcatagtcaatgcgccctgtccgatagcccagcgagcgaaaagaatactcgtattataccgagtctgcccagcaatacgaattggtttaatacctaccgtctgctcgatttgagccgagacaaattcaggaactgcctgagcccctccaacgattacgatttgagtaaagttcccatcctttaaagcattctgctgatctgctgtaagaccagtctccgcatcagataagaacaccggtgccttctgagcatacgcataggatgtcacagatagtgcatcagcaaatccgttttgattatttcctccagtaacaacaaccgcggtttctccccatccagcggacagactcttccccgcttcataaatttgcaatgccgtatctattcgtgtggcaccctgaattcgttcaactccgtcaacgcattgctttaaagaagactccacatcagaggaaaccgctttttctccaccgacaataacgacggaagaaggcttcaagcgctttatttcattacgtacgttggcactcaacacctgtgggttcgtcagaagcacaggagcattttctatgccggcaaatccggaaacagccaaagcatcgggataattctcacccgaagtgacaataaccgtcgaagtctcctctggaaaagcagtgtcgacaacatccgtcatcgtgtcgtaccgattatttccaaacaaacgaatcatttgcccatgcgtatcgtccggagtgggatcaggattcggtaaaggcacttccggagaagcgttattcccgttgtaaaccgggatagtttgcccggacggacactgagacaataccgaccgcattgcttctttctcagcagtgtctaccgaaagaccgtagtgttcttttattccgatttgacgactcacatacgagcagtcatagctcttctgagaaggaagccagttcgctgcatctttatccgattttgacgcattcgccgctccttttacggccagcaaaacataaggatcattggcataggcaacccgctgattctttgtccaagcatcagcgccactttcatacgcctcccctacggcaacgacatgatcaatctgaaccttattagatgtactctgccctctttgaaaatagattgtttctccggtgtacgggtcatgcagtgttccagtattaacatgcctttccgacgtgaacgtgacattttccatatctctctgcaaaatatagtcacgagtagtcgcgctacctccaagctcatcattgtggagccaggttccgaataaatcctctctttccgaggaacggtaatcatctgactgcgctttgaccattaatcgttcaagagcaaccgacgcattttccccctcatcagccgcagctgggagcgctgcaatcagtaaaccgaataaaacaaaaatacaaaccataataggaatgtctcttcgtcccaagcgtctcatagaaccccctcaatctcagtcggcgacccgaatctccacattcaattcaacacctttcaaaggtataatcgctctaggcacaccgtttgaggagagaaatatgaaatcgattcataacaaagttcgaagtgtgattgccgctatcgtatgtgtattttgcactctagcgcttatccccacacataatgcatatgccagcgtcaactcattcacccgaatcgcgggcaatactcgctatgaaacgatgtctcagatcgttgaacaggcatttcctacatcgtctgagtatgcggtgcttgcggcaggaagcaacttcccagatgcacttgccgcttcttctctcgctggagcctataacgcacctataatattgacggattcctatagcctgtcaagcgaagcttccttcgagatgcaacgtctcggagttcgcaaagtctttatcattggtggacaaagcgctatttctgccgatgtggagcagtcaatccgtcagattcagtcctccatggaaattgaacgaatcgccggcagcacccgttatgacacagctctgcagatttacaacgctttgacctcctcaaatacgagaagccaagcttccaaagtagcaatcattgccacaggaaacagcttcgccgacactctttccatatcaccttatgcatatcagacctcttcgccattcttcctcagctctccttctggtcttgacccagattcccttcagattctggaatccggcgcattcaattccgtcattatcgccggaggaacggcagccgtcccacaacatgttcagacgaatctggaagcactgggaatcaacgtaactcgcttatccggaggcactcgctatgaaacgagtaaatcaataggcgagttcgtgctcaataacctaaattctgcaccgcaagatgtggtattcgccacaggatccaacttcccagatgcccttgcaggcagcgcactatcaggatcgaaaaagactgccatgctgcttgtgcaagacagcaattctccgactattgattttgcagcgcaaaatatttcctccgcgcagaacgtctacgttctaggaggaaaaaatgcagttaactcgtccacgcttaatgccattgcgcgagcatatggtttgggggatcaggaaagcgagccacaaccgccagcgccccaacctacccctcagccaaacccacaagtaggcactcatgatgctggagaattctgcaagaaagcagatgtcggcaaagttgaatatgcgaaaaacggcagactgatcgtttgcgaatatcgaaataacaataaaacaccacattggcactatgtatagcgcaatgaggcattagatgggttgggtgccgcaaggctggactttgtggcacccaatccatctaaactaatcaaagatattgatcaagctcatcatcccgaacaagctgatcaaaatcagctgtcaaggcatggcggctcttcatctcttcaagaattgccgcaagcacgatgttgttcacgccactttcagtattctggtggcacagggcttcctctccttgcgtgcccggaacataattaagcaattgatcgcctgttgcagccacaacaggcactcccgctttgacttgcatcacttttagccacaaatcatccgcagtgagacacagtttttttatatcttccgcattaaaagtttcagacggcataaggtgtggtgggtacaaggttccggcaccatttgtagcaaatactctcatcgaaggctttcctacaagatctggatgataatggggagcttcgtaaatccactgctcgtacggagtgcatgaaccttgttcatcgaacatgatgagatgggttctcacggctacgattgctttcggatgccgttcatgcatctccatcagatcaccgatcattgtattcctgtacaataaatcgtcatctgttgtaattacataatcatctttgaactcttgcaaagcccaataatatttcttatgcggtttgagatcattgttcacccaacgcacttcaacatcatgccagagaacgtctttcaacgattcgggaagatcatcttccctatttggaaaatcactttcacatagccaaagaataattttgtccggcaatcttttttgagcaagcaacgtacgaatagcaaagtgaacagtgttaattcgtgccggatacgaagtcatggaaactatgattcgaggatgccgccggaatacacgagctagatgcgttccagcacggcgaagcttgttcttcttctcaccaacccatgtcaagtctaccattatgactgctcctcaagttcttaacaatgctctacagcaatgatacttatatacgctgcttttcagagtcaacggatacactgttaacagttgcgttagtagtttgcccaatcgagggagagttatgccgaagatctcaatcatcattcctgcatacaatgtcggcaaatacatagaggaatgcttggagtcagcacgaaatcagaccctcaaggatatcgaaatcgttgtcgtcaatgatggaagcaccgataataccggcgatgtcattgcccaggaagcttcaaaagatagccgtattcaagtggtgaccaaccaccccaatatgggcacacaccgcacccgtatggcgggagccgaagccgctaccggagagtattctttcttcctcgatggtgatgatgcgctcaagccagacatgtgcaagcaacttgttcaggagctatcattgcatcctgcagatgttcttcatttcggcatcacagtagtcggggcaaacgaacttctggattccgagcgcgaagccttcgaagccaataacaacgcgtctacgcaggatgccgtaggcgaggacataattcgcgatatcttcgacgaatctcgaggatataaagtggactggcgagtaacccagcgtctgtacaaaacgtctgtccttaagcaggcttttgcagcaatgaccaaggagcgtctcggccgttcacaagacggatatgaatgcttcgttgtttctgcctttgcaaagacatatcactcatgcaagcattgccgtggatatatttactactacggtcgcggtatcagcggaaccagcaccattagcgctgagaagtacgcgcagtattgtcatcatttcaaggccgattttgacgcagcatacgatttcgccgacactcagcactcagaaatgcttcgcgcttgcgctcagggattccaacggaaagcaacagaaatcctcgctaacgactggaaaatccgaattccggaaaacgagaagctttcagcggcacaaagcatgtctgacgtatttggaccggcaattgcaggtcgagaaatatatcgttttgtgcgggatgacgcgtatgaaaaactgtctgaaaaaacagcacttctgcctaatgacagactgaataactggtttggtattgccaattcgtttgaggttctcccatcccttgaagatactgatagccttcgtttccatgaaatgaaacgtatcgcaacatcccacatgcttgatttagtaactcaaagtgagcaaaccgaacaaatcgaacgatacaacaaccagcgcgttcgcctgttcgtcaccacgcataagaatgtgaatcgatttgagagcgatatcatgcagcctgtgcaggttggcctgcacgaaggcagctatcgtttcccctgggcgttccacgatgacgaaggcgagaatatctccgaccgtaatccgcgctattgcgagctgactacccaatactgggcttggaagaatgtggatgccgattattacggtttctgccactatcgccgctattttgatttctctgacactctccacaaagagaacccatatggcgaaatcatggatgattacatcgatgccaaagctgcgaaagagtatggacttgacgatacaaacattgagcgagtagttcgccaatacgacgtcatcaccactccattcggtgatctcacgaagattatcgacaagcatggtactcctcgcgcattgtgggaagccgctcccctgctgcacgatgatgatatgctccgctgttatcggattctatgcaagatgtatccggattacaaagaggatgccgattctttcttcacgggcaacaaggcatgcttctgcaatatgttcattatgaagaaggagatcttcttcgactattgctcttggatgttcccgattcttgaggagttcgataagaacaccagctatagtgcctacagcaaggaagcgttgcgtactccgggacacctttccgaacgcctgctgaacatctatttgatgcatcataagcgcatcggttccaattggaagttcaaggagcttcagtgtgttcactttaccaatccggaacccgctgaagagctgaagcctcttgatatgtttgacaagccgatcgttccagtcgtgtttgccgcggatgataattatgttccacagctcaccaccacggtttattcggccatgaagaatgctgatccgacatatttctatgatgttgtggttctacaacgaaacatcgcttgggataagcaggaacgactgcgtaacttcttcaagcagttcccgaacatgtcattgcgattcaccaatgtggagcgtgagctgtctggatacgatctttccacgaataatgctcatatcagcatcgaaacctactatcgattcctgatccagaagctattgccgttctacgacaaggtgctgtatttggattcggatatcgtcatcaatggcgatatttccaagttgtacaacaccgacttgcaaggcaagctgctcggtgcgattcgagatatcgacttccttgccaacctcaacgtcaagcatggcaagcgcatggggtatgccaagaatgtgctgaagatgaagaatccatacgattacttccaggctggcgtgctggtgctcaacaccaaagcgatgcgcgagcattacaccatcaggcaatggcttacctatgcctcgaatcccgatttcatctacaacgaccaggatgtgctcaacgcgcactgcgaagggaacgtgctgtatctgccatgggaatggaacgtggtgcacgactgtggcggacgtgtcggcaacctcttcgtacaggcgccaaacgacatctacgatgcatacatgaagtcgcgtaacaatccgaagatcatccactacgctggttttcaaaagccatggaccgatccagattgcgatttcgcctccatctattggaaatacgcacgtgaaaccccgttctatgagcgtctgctcaagcgcgtggtgaaggcgaacgaaccgaaaatccctgaagaggcgcttcgtccaaagcacgaacgcgccgttggagaggataaccctattcgcaagattgtcgatccactcatgccaataggttcccgccgtcgtgccatggcgaaggccatcggtcgcgcggttcgaggaagggaataatcgcattgaaacagaccacaaaaagttttagaattaccgaacataactttgcttatctcgtccccattcttctgggtacgttgtttggcatgtgttcttttattggccagcatgagggcaaaatcgacactcgaaatgcactgctttatgtgaacactctcttttatattgccctgttcacattactgtttttcgctgcgacaaaaatagttccgcgcataaatcaccataacgaatcactgagtaaaccgtttgaagcgttccgcaaactcacaatggactggtctcctcgatccattatcacgttatggtgtctcgtaacggcattctggattccgtattttgtagcttatttcccgggcgtctactggtacgatacttcctggcagctgatggaatattatgacccttcagtgccgttcaccgatcatcatcccttcatgatgacgtatttgtatgtcggattcgcacatattggcaaagcattgttcaataacgctatctatggattgtacctgctagtgctcgtgcagtcgctactgtccacattggccatcgcttgtacagtttgctatacaggcaaatccaatataccttggaaatgccgtttctttatcgctgcatttcttacctttttccccatcatccccatgatgtcgatgtctcttgcgaaagatactttcaatacgccatttttcgtattcttctctatcgcattctgtgaactttggagaacacagggggaaattttaaaatccgtttcatttaatgttttctttatcttagatgtattggccgtatccttaacaaaaaaaacaggcatgtatatcattgttctggctctgcttcttttggcctgcttcgttgtcaaacattggtcctgtaaaatagctactattgttttgggtagcgttccttatttggttgttggtataatcgtgccaacttttattttgccagcattgcacattgccccgggggaaagtaacgagattcttgctgtgcccatgcaacaagtcgccaatgtggtgcatgaccataaggatgatttgggcgcagccgaaatcgacaaaatccaacaaacttaccatatggatattgatcaactccaaggtgcttactgttggtataaagctgatccgataaaaggacaggaattatcttctaaagatgtccatgccttaatcacgacatggatgaaacagctggttaaacatcccggcgacatgatagcaggatggggtggactctccgtcgcatggttctcattcaatgtcgcatcaggagaagaacgagatctcagcatgatgcttccaatcaacaattccaaacatcattatcaaaacatcgaacaatatattccttggacagataacactaaagctggtaatgcgattggacgattctacgcagacacattatcagcgacgcctatattcaatatcatatggcaaaaagccttttgggctacaatacttccttttgccatcatgtttctcatactgagatccaagaagaacaaacttaatctgttgatgcttaatctgccaatgttcatcacaatgcttgttctatttgctggaccgatttccacgcacacggaggcaacacgctatgtgttgcctatgctgtatatcattccactgtttctatcacttacgctgaagcatttgcctgaagaatcctaaatcgtctctccggacgtgagtcctacgctgactcacttcgatagtagggctcgtttcacctttgagatgcaccacttgccgacatatacggcaatgccagtaagcagatagaccgcaatggccttaatgaatgggtggtattgcccaaacgtcaggatgcgctcgaaaggcccaccaagcgtaaggttcaccagcagtaggtggaacatatatacaccgagcgagacgctggacactttgcgaattatcgacttcattctgtcagatccacgctgaagggatggctccagcgctttgcagagcatgaacagtgataccgcggatatcacacataacggagaggaaatgccgacaagataattctggtattccacccccatcgaattctggaagaaaccgttccaacataaaccgccgaggaacatcaacgtcacagatccgaggaaagttgcggcccatgcaagcgcattccaatgcaacggcaagccgtagttttccaaataatatcccagcaggaaatacagcagggcactggaagcaaatagcggccagctcaacaatgggctgaaatattcctcgttgattccaatggcttttgctgcaggaatcagaattgaacagaacagcgtcagcgcaatggcatattccaacaaacgacggtcatggacgatttttgaaagcaatggagtcaataagtacaaatagatgatggtatacaggaaccagtaaatatcgataatggagttggtaaggaatctcttgcaaaaatcgacaggaccgaaaccatcggcgattgattgcgctccataaaacaggccggggagcaaaccgaacaataaatagcaagcgatgctgcccagaatcaacgcacgtcccactcgtacgaatcgttttttgaaaaacactttcgtagaatatttcttccggtaatccaaaagattcattccgctgaccatgaagaaaataggcacggcgaaaataaacatcgcctgcatgagctcttggaatgtccatagaaaagtatgttgcagagagaacacacctaaagacgtatgcagacataccacggcaaagcaggaaacaatgttcagcacgtccacaaatacatagtgagtaccgtgacagctgctttcccgcctgtcgacagagccttgccacatatctgtttgtctcgccgtcactgatcgtcctttccttctccaacttgcacgcccttagcatatcaacgctaaagtatctccgacagaagcggaaactcatccgcaggcgtccgctctcatatctaatctggaaaacacagcatctttatctacgaatcagaagtccgagacatgaaaaacaagtttggaaaccgctatactcgcgccatagcaacgttccactttcataaatttgttcagatgtttagaagaactttctcattgatactgtcattcattctgttttcctgcgtacgctcaggaaagcaagaaaacaccacaagaaaacggaaacaccgcccttcctttaccgagctgtgtaatggacagcatggttctgcaacagaacaaaaccaccaccttaagcggctcagctcagaaatcctcatcggggaaaacaatttccgttactttgcgagaaggaaaacataaatacgccagttcttcaacaatcgataaagcaggaaaattttcaatcaagttgcctagaatcaaagggtcacttgcccaatacaccatggaatttgccatagctaccaccgtgatgaaaacacggtacatgatgtatgcgtgggcgaactttttatagccgctggccaatcgaacatggagatcaactataacgattatttcaaaagcgattcggcattcaagacgaacacttcgtcacgctacactcgtgataattaatgtgaatcgataaatccatttgcttcaagtatgcaacatcacctataatccattccccatgcagaccagtacaagggatatagtggagcatatgcctgagaattcgaacgtttccgttgcagtacttcttccttgctataacgagggagtcaccatcggcaaggtcattcgtgatttcaaaacgtctttgccgcaagcagacatctacgtatacgataacaactccactgaccgcactgcagaaatcgccgcgtcagaaggggccatcgtccgcaaggagccacgccaaggcaagggcaacgtgatccgcgccatgtttgaagacattgatgccgacgtatacgtcatgtcggatggcgacgacacctacccggcagacgcggcgcccgccatggtgaacaaagtgctcgaaggctacgacatggtaatcggcgaccgcttgagctccacctacttccaagagaacaaacgaccattccacaacttcggcaaccgtttggtacgcggatccatcaacggcctgttccacgcgaacgtcaccgatatcatgaccggataccgggccttctcattcaccttcgtcaagacctaccccgtgttgtcgcgcggcttcgaggtcgaaaccgaaatgaccatccactcgttgaacaacaacctgcgtctgttcgagatgccaattcagtaccgcgaccgtcctgccggatccgtcagcaagcttgacaccgtgggtgacggcatcaaggtgatgagcaccatcttccgcatgatccgcgaatacaagccactgccgttcttcggcggacttggcgtcatcctcggtatcatcggcattgtgctgtgcggcagcgtgaccgtggacttctggcacactggcgtggtggcgcgattccccacgctgatcggcgcggtcatgctcgtcattgccggactgctattgttcatcaccggcatcatcctcgatgtcatggccaagaacgaccgcaaagcattcattattgacgccaatcaattcgccatgatgcggcgccagaaatagcacagattccaaatatggctgagagcaaaaagatacttgtcctcagccatattttattggttaatctgtctgctatttcacccacttttgggcattcgtgccatttgcggcatatagctgcacattggcaccattcgaggtagaagcacccgaaacatcaaggactttgttttccgcgagcgccgactggaacgtgtatgagccatcggagtttttgacagctatccacttctgagcgtatgttccattggaatcgtactgttgcacgttggttccgttggcagatacgccgccattcacatccaaaactttgccggagttcacactggtcaaggtcacatacccgttggaatcatgcgtcactttccacttctgagcattggtaccattacctgcccaaatctgcacgtttccataatttgaacgggaagcaccgcttacatccatcttcatagacgtattaagcttcgatccgaacgtgtacgtaccatccggcagatcttgcctatgcttggttgcggtttcgttcaaacgttcgcgcaacgttaacggcgcctttgcaaccagccattgctgagcaacggtgccattcggcgaataaagctgcaactgagcctgctgcacggcattaccacttggaatatcgacagccttattagcattcaccgacactagcgcaaccttgccactaccgtaatttcgcaccgtccactgttgggcaacagtgttattattcgtatattgctgcaacgccgctccattagcagtggatccgccagatacatccagcaccttgcctgaattcacattgacgatcttataagttccattgccaattgattcaaatcgatatttctgggcgttcgtattattacttgaataaagctgaactcgtgccccgttcgccgttgacgcactcgtcacatccgtgacaagttttttattcgcaaccgaagtgataatcatcgatactccagtagctatgttgacatcgcttgacgaaacaacaaacagctgtgaagcagtgccgttgggcgtatacagccgaatcgcagcaccattcgcagtatttccaccgctcaaatccagaacccaattaccgagagcggactgcaaataatatcccgctccggaatcacgaataaaccatcgttgagcttgagaattatttcgagaatactgttgcactatagcgttattctcagcaacaccattacgcacgtccaaagccttgccggaattcacattgacgatctcgtagctcccatcagactgcctagtaaaagtgaactgttgagccttggaactgttaccggaatacaactgaatggcggtggaatctgcagcacttccaccaggaatatcaacactggacgcaactttggaacgaacattgatgtaataattgccattcggaatggtaactgcagtcattttgcgtacatcaatggccgcttgtaaatcattgctgctcccgccattcacatacgctttattcccaaacgcattcatgtccacattgccgctgatgccatccaccttgccggagctggtgtattgccatccgcgactgttggtcgggaacgagtcgaatcccatgcgagcgccgtactgcgccacccacgtggttttggcgtaaatgtcgacatgtttcagcggtccttgcaggtagctggtgtacgagtagacgccaagattcttgtatccggcggactgtagtgcgctgtaccaattgttgacgatattgttgtacacgttcgggtcggtgggtggctgatgcccctcccaggtccacttttccaggtcgtagtacacggggtacgccaagtcgctcggattcacaccgaattgcttgagtttggcgaccacgtcggtaccttcttctttggcgagcgccggagtgtccgcgtaggaataccagtagatgccgaatgggatgccaagtctcttgcattcggaaatgttacgttgcgctttcttgtcggcattgttgccttcgccgtagccgaggcggatgatcgcgccttccacgccgtcggctttcgctttggcccagtcgatgtcgccttgccatccggaaacgtcgatcacgcctttggcttgctgcacgaacagattgttctggtagtcgaagaaagctttcgaattgttgtaagtgccccagtgcgcgccgtattcattgctttcgaatttggagagctgtacgttcgcgtcggctacagcatttttgacatcttccgcacttaccggaatgaaggattcgccgttggttttggcgagcggatccggctgctgatctttcgtgccgaccaatgttggatcggtcacgatttcgccggtttcgatgttcttgacctcaccttcgggggtgacggccaggtcttccgaaaccacggtggcatcgtcggaaatctcgtcactgacgttatccggaagtttcgcattcggattgtcgggcatgctgtcttgcgattgctggtcgcccgtctgatcatccgactgatcgtcagactgcataacaacaccattatctgcagtaacggaaccgctttgcgcaacagcatcctcaatcgcaatatcctgcaatgcgtaagccggcgcaaccgcaacggaagcagtcaacgcaaccgcagacagcgcagtcgcaatcttcacaacatgatgtggcgaaaccattcgtcagcctctcttgaatacagtcatcaaccccaaatattcggcgcaaacgccctaatcgtcaactctaactgcaacccacaaccccgtccatccccaactccaaaatcatcccaatccccacatctcacgcattacacactgataagaatcgactagctcgttaggggcaccgatatggcatcatccatttccatatctcctttccagcattctcgctgaccttcccatcacgcttcgtagagggaccattcccaggaggggattacgtggatcgtgccagtggaatcgggaagttcgatggtttctccctcgttaagcgtgagaatcaggccggaatcaacgttggtacgttgcataaccgcttgcagagagccgatttctcgcgccctggttttctcatttcccatattggcacacacttgaataagcccatacggttccgtagcaagagcatcgccgataagaaagtcaactttctcctgtttggacgtcggcatagtgtacgaagtgattgtttccgtacgcctaccggaagttcgtctctgcagttcgcagaaaatcgcagtttccagtcgttttccaatatcttgctggttggcgcgtgacaccgcgtaaaccataccctgatcgacggcatacattttcggcaccgcagtactacccggcttgagcatggtggaatactcctcaagctgatacaccagaaatgcctgcttgaacagctcgagtaacgtattcgccttatcccaatagattttccagccgaccgctcgcaacgtttccacaagaccattggtagacagctcgcaggccgtattgcgcagcaaaaacagcgctatctgcgtggcgagagtaatgttttcacgaccaagacgctcggcaacgtcacgcgcaaccacgtcccgcacgtaaccttggagcgtttcaatacgatcagcttcaaccatacgttgcactgcagggaagccgccaatagttaggtaatcgttgtaggcagcttcaaaccgggtgacctctcgcggcgaaaacacggcatcggcaagagtgctgcccgctgtaggcgtttcgattccccgaaagtcgcagaattcacggaaagacagtggcgccatggcatgcggatgcgatcttccccggaaattcgttgcgatttcttcgctggacagtttcgaagacgatccagtaatgactagcgtcacagcttcatgttcggctatgcgctggcagaatccctgccaattggcgcattcttgcacttcgtcaaggaagaggtagcagccatggtcacgagagtcgggatattgccgccagtattccgtaacaatatcgttgagcacggtgtcttgcattggttgcagacgatcgtcagcgaagttgaaatagaaaatatcattacgcgagacgccgttttgtaacaaatcatgaattttctggaaaagatagaacgttttgccgcaacgtcggatgccagtgatgatgtgcacagcattgaacactgccggctgcggcagctcgcgtatgatttcgatgcggcgtgacggcgtaggaatgtcaaactgcatggactcacgaaccagcatggcatacgattcacatggattatccggcaccataagttcttcctttcgccgtccgttgcgaaacacccaacaatcccagcataacacttctcaaaaattttaagaagtttccaccaacacttctcaaaatttttaagaagttaccacagacgaataaaactccagagaatacctgaatgcattaacgactacaacacgagtgtgggaaatcggggaaggacgggtatcgtacgctgtatattggcatttcaggtggactctcggaacgtgattcaattgacctgaatcgggagctgtcaccggggagtacagaatagtaggcagattctggaggggttatggcacggcacggcaagaagccaagcgaggaaagtacctcgtcacacacaccgagaacacttgccggaagcgcaacgaccaacacttctgccgacagcactgacgccgctgccagcggtatcgctgttaacagctcgaccgccaacagcgcatttgccagcgatgccgatggcaataccgggaatacgcttgtcggcaacgcttccaacgaagtcgaagcaaccgaagtcgaaaccaacgcaaccagtaccaacgcaaccagtaccaacgcaaccggagagcgcacaatcagcaacagcaacacggctgaaatcagcaaccggcaatcacacgaatccagcgaatcccgccagccgcaagacctattcgacgcggccatagcgcaaggcatcagcgacggcgacgcttggacggaccagcgcgtaaagcacatctaccgccagatcatcatcgccgtagtcgtcgtagtcgttgttctgggcgcggtcttcggattcacaggcgtgcgcgcatcgcagcaaatgcgcgacctggccgcactcaacgactgcaaggaagccgtcacggccatgaacacctcctattccaaggcgttccagctgaaggcgaagatctccgaagcgttcaccagcttcgacgggtcctacgatctcgacaagcttgccgaactgcaccagacggaagttaccgcgccgaaaacgctgagctgcgccgccgacacttccgctaccatcagcaaagccaacgccgcaaaagccgagtacgataagcaggccaagcagttcaagcaggctttgcagaagagcgacgaatccgcggccaccgatggcggtgacggaaccgacaatagcgctgacggaacggccggcgacgacggaacggacgaagccacagacacggagggcgatgctggagttgccggcgacgcgggcgccacggacggcaccgtcgaccaatccggcgcagccgacgcgaccgacgcaacgctggacgatcaattcctccagtaaatcaaccaatcgcaacgctgccaaccaaccagccgatcaagccggccaatcaagccaaccaggcctgtcaaccaagccggtcattagcctcaccgtctttacgtttctcccaactcttccataccccttttccgcatacccaacgtttcttttgattttagaatcaaaagaaaagcaaaagagagtcacatggcaggcaaaagaagaaacgttgaaattccgccattttcaagacttcacggctataaaatgcagtaacaagtcaaaagaaaagtgcaagactagggaaagaccaaacgaacggaaaggaggctctcatgagctggacagcggcaaatgggcaagagatcaccgatgagatgatcgatcgttggcgcaaatcctacgaacaaggcgaatttcctgaagacgaacgaacagtgggtggcgtgattatgggacgtccaccgctctcgaccgataaaagtccggcccatgggacgccatcatgaagagatgacagaaatgggcagagcctgacggatgaccatatttgtgcgcatcgcagcaagattgactaggctttaatgtgattgctccgttaaacaaacgctgcaagcgttgcattgcggacgcagaaggggagccatcttgaagaagaaacgactggcacgcgtgattattgccgcggtagtgaccgcggcaattctggtggcgatcattgttggttgtgggccgaaatggggcgacggttcagcaaacgtcaacggcagtaattccaagagcagcaacagcgcatcagataatgtctccagcaacgacaacgccgcgcaatccaacaacaattatgcgacccgcatcaccgtgaaactcccctcctactatttggagaacatggttttccaacgtgggaaaacgctgatagtcaaaggaacggccaccacttcacaacgcggaaaagttgttgacccaacgcaactgattacaacgatttcccaaggaaagaaatcagcatcagcacaagctaaaatttccaaaaatggcgatttcacctgcaccttacctaaacaaaaagcaagtcttaaaccatattcattaacgattttatacaacgaaaccactttgttgactctgaaaaacgtgtatgttggcgacgtatttattgctgcaggacagtcgaatatggaattgaattattcgcaatattatgagggttcaggcaactcctacaatttcggcggaggtctgataacgaccgacgatctgccgaagcagctttccgacaacaacgtacacttcgttgcgagcgccaattcctaaaggtacggattttccgttacgcgacgtgaatgagcaggctggcacctggcttgaggcaaccgccgataattcgcagcatttcagttatctggcgcagcagtttgccatgcagcttcgtgccgcgcatccgaacgtgccgatcggcattattcaaaccgcatggggtggcacgccgattcgacgtcacgtgcaaggcggtgatatttatgcgaaccatattgcgcctttggaagggttccacgtggcgggcgtgctgtggtatcagggatgcaatgattccacgaacgaggcgaccgcgctggcgtacgagtcgcagatgacgctgctgatcaaccaatatcgtgaagtgttcgatcaggatgatctgccgttcctgtatgtgcaattggcacgctggcctggctaccagtacacgcaaaacgtgcgattcgcgcagttgaacacgttgagcaatgccggattacgcaatgcttccaacgttgcaatgacggtgtcgcttgatacggacaagggcacttcaacgttgatacatccgcttggcaaagatattctcggcgcgcgcatggcagcgcaatatctggcgatgtcggaaggcaggaccattcccaacgggccgcttatcgcgcatgcgaagcatgcttccgatggcacgatcgtattgtcgttccagaacggcaccgcaaccggtttgcaggcggaaaagcccaattattcgaagactgcgagcgcgaccgtgcccgattatgatgcgaatccggacgcgactcctttgaatggtatttccaacgttgcaacgccgacttccacgccattgcaaggttttgaaattgccgacgattccggaaagtgggtttcggcaacggcaacgattaagggtgatcagattgtgctgagtgccgccgatggaagctcgaattgcaacgcggtaactcaagtgcgttactggtggagtggaaatccggttatttccagtctgctgtataacgatctcggattgcctgcaagtccgtttattgctgttgttgagtaatacggcagattgataatcgggcattatccggctgcgacgactaatcgataaagcggactgtaattaggttagaatcaggcctgtttcatcgaacttaagtcgaaagcaatgtcgacggtcaaaatcgacgatcaatcgacgtagtgcggggcgctggacgctatgcggggcgttatggagccgctattgccgttgccgtcggtactaccgtctgcatcgaaatcttgcgatttacgaagcgagccggcagccagcgaacgtatggatcgaacggaacggccaatctgcgcctgtttttcctgagcatccgactgtattgcgggaatcgtgcccgtcacagggcgaatgcggccggtcgcagtgggaatgaagcttggcggcaacacctgcgcggtaacggcacccggcgatgaaacatggtagtgggccatcgaagccagggaatcgcgggtatcgagttcacgctgcatatctagctcatcgtcgaactcagccatcgctgccctccctctcttcaagcaatctctgccggtaatctctccactggcaacggtcatcgttccgagcgtaacgcaaggtagcataccgttacgaacgaaatcagcgatatgcgcaactcccccactgtttcgcaacttttccgttgcacgtgccgcagcgagccacgccagcgagctattgaaaacccgccgttttggcataaaaaaaggcttccgaaatcatccggaagccctactggcggagaatacgagattcgaactcgtgaggctgttacaccaacacgctttccaagcgtgcgccatagaccactaggcgaattctccaattatgcaacgtctcacagtgtctatccgcgaaacgcaacttgattaggatacaacagtttcttccaaaccccaaatcggcgtgtcgcaacgtcccagatcgcccactcactggaggaatccgtacacgtgaggacttccccgcgcaccgaattctccaccctctgggacaattcacccgccaacgcacctctcagcgtcccagatcgcccactcactggaggaatcagcccgctgccaagactctcacagtccgaattcctccagtggctggaacaatcagtacgcccataggccttctacagtccgaaaacatccacccactggaggaaaacacccgcgcaccggcctttaaacgtcctgaaacctccatccactggaggaattggtacgttggtatgcttcccagcatccggattctcccacccactggaggaatctgcccgcacatacacccccgaattgtccagattcttccagcgagtggagggatccggacacgagctcacgtaccgtgagcacagcagctatcgtttggacgcgaaggcacgcaggtcggcgagcatggcagtgaacatcgggcggaccggaccgaacttatcaagcagcgatcccgaaaccggagcactagccgctcccagcaacgcgccaggcagcaacaccacgcctgcggcaagcacagacgcgccgaatcccagttgcgaagcgttcggaatcatatagccgtaaccgatcgtcacaaactgcagcagcacatacgcaagcaaatgccaacggaatttcacactccgcaacacggtcagacgaaccagcggcgagaacgcacgatgcgacacccaagcgaacactagcaaagcggccatggcaatcagcagcagaaccactgcaatcacacattgcgtagtcgcggaagtatccccattactcactgcggtaacggcggatccgccacggtcgagcgcaaacacgaaacagacgaatccgactgctaggcaaagcacatgcagcggattgatatgcgcctcttcggtaggggtgacctgatgaatcgttttaaggccgcacaccagcgaaacaaacaggaacggcagcagaatcacgaaaatccaacgccacggcatgaacgtgccgacaagaccgcccacaagtcggtccgagtgccggcgccacggccaccaccatgcctccaacgcccatcagcatgccgattttgcttttcggagactgttcaagaatgatattgaacatcagcggaagcgcgattccagtgcccgctccctgtagtattcgcgcggtcatcagcataggaaagttcaacgtgcaagctgccatcaggcagccggtgatgcagagcacgattgcggtaaggaagatggtacgcaacttcagtttgcgcttgaaatagcttgagagcggcgtgacaagcgctaccgtaagcagatagccggtctcagccattgaacagtggacgtgtcgacgtggaattccgccattaatccagggaaaagcacgttggtgagggtttccgtaaggatgccaatgaaggccatgattccagttgacagaatggcaagaataagattgatggagatgttctcgtcatcttgcgttgccgtgttattgtttcgcgcaatggactgtgacatggatttgcggccgttcccgaccttccctttcttggcccggctttgctgagccaccattccgttatgccgggcagtttgctggaatggcgattatttgcccagaaatacaaaaagatccttgggagcggagcgctctaccaaggatcttcatattattaagttgaatgttgtggattgggagcctcccgcgcgtcgcgggaaacaagaaccaaaagacaaaggttggaagttcatgtggccgttcgcgttggtgttcgtgttcgtgttcgtgatcccgatcctgtacgcgatctacatcagcttcttccagaagcagatgatcggcggcacgaagttcgtgggaatcagcaactacattcgtctgttccacgaccagcagttctggagctcggtcggcagggtcgcgctgttcacctgcgtgcaggtgccgatcatgctgttcctgtcggcggcgatggcgctcgcgttggattccatgaagctgcacggcgcgaagttcttccgcatctccacgttcctgccgtacgcggtgccggccgtggtgtcgactttggtgtggggcttcatgtacggcgcgaagtacggtctggtcggctccctgaacgactggctgggcacgaacctcgacgtgctgagcccgaacgtgctgctcgccgcgatcggcaacatcgtgacctgggagttcaccggctacaacatgctgatcttctacagctcgctgtccacgatcccgcattcgctgtacgaggccgcatcgatcgacggcgcgggcgaatggcagatcatcaagtccatcaagctgccggaactgaagggctcgctcgcgatcacggtgatcttctcgatcatcggctcgttccagctgttcaacgagccgagcatcctgcagaacatggtgccgggcaacgcgatcaccacgtactacacgccgaacatgtacgcgtacaacctgagcttcgcgggcaaccagtcgaactacgccgccgccctggcgatcacgatggccgtgatcacgatggcgatcgcgtacgcggtgcagctcaacagcatgaaggagcagatgaagtaacgcccggtggcgcgaaccatccgcatataggggaagaaacgctaaggagcatcgaaaatgagtgacgcaacaatcgccgcgggcacggagcagaggctcaccgctcaggagctcaaagcccaggagaaggccgcgaaaaagaccgagaaggaacgcctcaagagggtcgcgcgcgacgagaaggccgagcgcaagagggctgcgaagtccggcttcgcgaacgtggcgaacccgcgcaggagcacgctgctgaccatcgtgtgcgcgctgttcgcggtgtactgcctgtttccgttcgtgtacctgctgatcaacgccacgaagacgcaggcggacttcacgtccacgttcggtctgggcttcggccgcacgttcgctttgtgggacaacatcaagaccgtgttcacctaccaggacggcatcttcggacgctggttcctgaacacgatcctgtacgtggtcgtgggcgccggcggcgcgaccctgctcgccatcatgggcgggtacggcctggcgaagttccgtttcccgggacgcaaggccgtgttcgcggtgatcatcggcgccatctcggtgccgggcatcgccctggccgtgccgcagttcctgctgttcgccaagctgaacctgacgaacaccccgtgggccatgatcatcccgagcctggtgtcgacgttcggcctgtacctgatgtggatcttctccgaccaggccgtgccgaccgagctgctcgaagccgcccgcgtggacggcgccggcgagttccgcacgttcttccaggtatccctgccgctgctcgccccggggatcgtgacgacggccctgttcacgatcgtggcgacgtggaacaactacttcctgccgttgatcatgctgaaggattcgaactggtatccgctcacgatcggtctgaaccagtggaaggaccaggcgagcaccgcgggcggccaggcgatccagaacctggtggtcacgggttcgttgatcacgatcgtcccgttggtcatcgcgttcctgtgcctgcagaagtactggcagtccggccttgccgcaggcgccgtcaaggaatgatggccacgttggcgatggcgtacagcaggtagctcaaggcaacccacagcagctgatcgttctgggccagagccttgaaggcctgcagcgggccgccgttgtcttcggccttggcacgcagcgtggtggtgctttccttggtgccgaacgccacggagcacacggtgaggatgccgaggatggccacgatgatggcgaagcaggtccagccggactggctttcgacgtacttgccggtgaacacccagctgaagtaggtgacgatcgggatgaccacgatggtcagaccgttgtagccgatggagccgccgaaggagccgagtgcggtgtaggtggagcgctcgtgggagtcggagctcaatgccgggatcataccccagtaggaaatgtcacgcagcgagtagaacacgtcgagcacaatgaaggtgatgacgaacagcacgatgaacagggtagtattcacgttcaccagaccgaacagaccagtgtagacgagcaccagcaggatggcggaaacggtaccaccgatgagctgccacggcttgaagcgaccccacttggtgttggtgttgtcgatgatgttgcccagcagcgggtcgatgaagatttctgcgatacgaatcaccacgaccaggccggtgatgatgccaatcagcttggtggcgacgctcttatcgacgccagagaacagcgagctcgtcacgtagacgatgaaataggtgctcagtgcgttgtagaacgcggactggccgacgttaccgaacgagtacgccacgcaagacaagaggttcccgcctttggaaccgttgttgccatttcccatctttgcttctccttagaagtcagatacaggtccttccttgacctaactatcagtatatccccttacctaaagttagtaaaatttatcaccgaacatatcgcctatcggcgtgtcatattttgtgagcttctgttcgaaagatagccaaaaacgttatttttccgccatttacacaacaaaataggcaaactgtcacattatcttgtggcagcttttaccaaaatcgatatttacgatatgcaaaagcttccacgtcgaaacgaaaccaagccaatctggaaatagcccgattactatacagaagtaaagaaataaccgctattttgccggcacaaaactatcgcgcaccaccagcgacgtcgacaggtacgcatgctgacgaatcgtgcgtttgccggaaatggcatcacccaacatcagcgtcgccacgcgcgcaagctcgttctgatcgatggagaatgtgctcaacggcggcgaggtcaactgcgaaatcgtttgattgttaatgctgatcacgctgatatcgcgcggcaccagcacgccaaccgcattgaacgcctgcagcacgccaaccgcaatcacatcggcagctacgatcacggcatcaggcagcacgccattatggtcgcgcacgaattgctcccccaacgcacggccgttgctcacggtgaacaagccgtcggaatacaccaatccgtcggattgaataccgaaacgccttgcctcacgacggaaatatgtggcgcgattctcctcatcgacctcataaaagttcatcaggcagcccttgcctccgatgaatccaacgcgcttcatgcccttggcagcacaggccgcgaccgcatcatgcatggtctgctgcaaatcaggctgcacggaatcgaacagattcggcgccggattcacgtcaatgaacacgccatacggcatggccctatgcagccgctccaagtcttcctcgctgatctggtcggcgcatatcgccatgaacccgtcgaatttggaactgcgagcgatcatatcgtcgagattgtggaacaccgtcatttccatgcgttgctgttccgcattgcattcgagcgctgaacgcaaatcggtgaaataggagtcccgcaacgcctcgtcggacttttcattgtcaagcaatgcaacctcatgagggatgacgatgcgcttggtctgcacgctatagccgaggtcctcgctcgcctgaatgatcttgcgacgagtctcttcacgcaccgatagggtgggatccccgttcagaagtcgagacaccgtagcctgagaaaacccggtacgttgcgcaatctctttaatcgtcgccatgtctcgctctccaatttagtaaatcgtttacccatgaaaggataacctattattgacataacgacaaaccaagcgagatttatgcaacgattacgcaagccaattataatcgctgctcatgcagcagtctcatgaacgtatgacggaaccgccttcacggaaggcgggctggccgcagccgaataccatgcatggcaaagacaataagaaatcccttgcttcaaaatcgcaatttcaaagcaagggattttccagaggatccgtgccgttcaaagccaccggccataagggcggtatcagccgacagggatcgaagcgcggctagtgtagaacgctagcgtgtgctcgcatcgctccaattcaggagactattagattattcgagttctacggcacctgtgtagagctgatagtactcgcccttctgcgcgatgagctcgtcatgcgagccgcgttcgatgatgcggccatggtcgagcaccatgatcacgtcggagttgcgcaccgtggagaggcggtgggcgatcacgaacacggtacgccccttcatgaggttgtccatgccggcctgcaccacctcttcggtacgggtgtcgatggacgaggtggcctcgtcgaggatcatggccggcggatcggccacggcagcacgtgcgatggaaatcaactggcgctggccctgggacaggccggagccgtcgccttcgagcacggtctggtagccgttgggcagcatgcggatgaagccgtcggcgttcgtgagcttcgcggcggcgatgcattcctcatcggtggcgtcgaggcgaccgtagcggatgttgtccatcaccgtaccggtgaacaggttcacgtcctgcagcaccacacccagcgaacgacgcagatccggcttgcggatgcccttgacggaaatgccgtcatacaggatcatgccgtcctgaatgtcgtagaaacggttgatcagattggtgacagtggttttgccagcaccggttgcgcccaccaatgcgatcttctgtccgggcttggcgaaccaggtgatgtcgtgcagcaccggtttgtcggggttatagccgaagttcacgtcggtgaagcgcacatcgccctgcaggagggtgaggcgaccgtccggtgaggtaatggcggtttcacgggctttcatggccacttcggcggcacgcgggctcaaggattgcgcggccttgagcgaacgggtgccgtcatcgccttcctcgcgcttccacgcccagtgaccggtttcatggtcaacttcggtcatggtgcgtccatcttcgccgagttccacgttcaccaaggtcacggaaccgccgtcgtcctccggctgctcgtccataagcgcgaagatgcgggatgcgcctgcaagcgccatcatcaccatgttgaactgcatggacacctggccaagcgggttcacgaaagagcggacccgcggtctcaaccttggcaaggttgcgctttaccaactaagctatgtccgcatgttctccgcagtactactgcctgagcacgagtatctactatatccgcattctcaaaatttgcaagtccgcgtgtcgtgttcgtgttttgctgttttcaaagggcttttatctaccgaaaaggttttgagctttcttgacattcgggtattttgagatgctgttgtctagatcgggatgccctgctcgtcacattcaccgatggcggaagcgtgtttgcggaaatatgatttcgttatacatttaaagcatgtgtgaggagacgaaaaaacgcgagacaataatgatctccgcgtttgaggggtggaatgacgcctgccaggctgcgacgaacgtcatacggcatcttgtgtcgcgatatgattcacaggaggtgcatcatatcgacaatgagggtttctacgactatcaggtagcccgtccgatgatttgctcggtacaaggtcgtaaacgaatcatctggccacagaccacgttctatgacattgcagtctccccctcgctgcattttctcgctcagatcgcccccgagccaaattatcgttgggaggaatactgcaggcagacgttgcgtatcgcagaagactacgatgtgagcggtatcgtcacgcttggatccatgttcgacgattgcccccacactaggcctttgccgcttgacatttccaaaaatgactgcgaaagcgaacccgacaaggaatataacggccctgtgggcatccccaacattcttgacgcatttgcggcggacgcaggatttcataccacatccatgtgggtgtccgtaccccattactgtgcgaataccgagtgcttgcagggcacgctggaattggttcgcgcattgtctcttttacttgagcatccgctgactgaaggtgatttgaacagaaaagccgccgaatggcgcaaggctgccgacgagattgtcgagcagacgcatgccggcgattatcttgcctgtctggaacgcgactacgatttgaacgctcaagcgcaacgtatcgcgtcgaatggcatgcccgcttgcgaagagctgattcgtgaggctgaatcgttcttgcgtggcaattaagttgtgattggcgataagcagtgaatatataagtcgggtcgaccatcgcaggatgatcggcccgacttttttgttattcgattatcgaattagattcacgctgcagctgcggcttccagcggcgaaagcacgccggtaatcagcagcaatgccacgacgatcgccaagccgatgcggtagatggcgaatgccttgtacgagaaggtggaaacaaacttcaggaagccgatgatcaccacgtagccgaccacaaatgccacgatggctgcggcaatggtaggaccccagccggggaacataccggcatcccccgcggcaacgtccttgacggccgatacggcttccagaatgcctgcgccgaacacggcaggaatggccatgaggaagctcactcgaacggctgcctcacgggtgtatcccatggcgcgtccaaaggtgatggtgcccccagaacgggaaacgccgggaatcaatgcgagcatctggccgatgccgaagatcagcgcatccttccaggtcatttccttcatggtcttgacctgcttggaacgggcgtcgaccacccacagcagcacgccgaacaatgcaagtacggtgacggtgatccacagattacgcagtgacccttcgatcgcatgcttgaacagcaggccggcaatcagaatcggcatcgtgccgaggatgatgaaccagcccatctgcgtgtctggattgtgcgctcccatacggcttttgaaatccttgccttctttgccgaacagggagccgaaccatgctccaagaatgcggatgatgtcatgtcggaaatacaaaatcacggcaagctcggtgccgatctggatgattgcggtgaacgcggcgcccggatcggatcccagcatcaaatcgccgataatgcgaatatgcgcgctggaagaaactggcaggtactcggtcaatgcctgcaccagaccaaggaaaatcgcttggaagaaattcatgaaccctcttttatatgtatcaatggtttcgtctgcttttccgcatccaagactagcgagaggggtctaatttttcgctatggatccttgagttgtctcaaaccatgcacacaatggtgccaaaacccatcggagcttcactaacgattccataaggtctcgcaaatgtggcggatcatgcaaggaaaggtcgggcagcatgagcaaatatcgcaagagcagggcattcagtcctgaaggtttcttcgaatgcgagggccgtggtctgcagtggcttggcgaagcgcaatccaaaggcgggccacgtgtggtagacgtgtacgactggggcaaggattatctcaacattgaacgagtgaacgcctgtggtccgactttgcaggccgcgcatgatttcggcgctgctctcgcacgtatgcatgatgccggagccgattactttggatctgccccagccggatatacgggaacttgttatttcggccccttgcaggatcccgttcccatggacgcaggcgaatgggatgatgtggcgacatatttggccgaaggcaggctccgtccgatggtacagcttggtatgaagcgccgtgaactcactgattacgatatggaactgactgaggccgtcattgaagcgttgcctgaaatactgggcaaggcagccaatgacaagccagcacgagtgcacggcgatctgtggagcggcaatgtcatgtggtcggccgattccggatccgtggaagcggtgctgatcgacccagccgcgcacggcgggcatcgtgaagaggatctcgccatgcttgacctattcggcatgtcgtacttgcgggacattctcgacggataccagtccgtacatccgctgaaagcaggatggcaggagcgcaccacattgtggcagctctaccccatcgcaggccactgcgtgttcttcggcggtggctatgtgaaccagtatcgcgctatgtgccggtcattgctcaaataaacacgtagatatgcctaatgattggctgttgtaggcgtgaggcaatccgcttgctacagcagaaacattgacaaaatagccggttgcttcgtttttgaagcaaccggctatttgatatgcgatctaacgttttctcatcggatgtacgacatgaggatagggaaattcagcgcagtgcatccttcagcttggagaagaagcccttcttcgttccggaagtcgggcgtgcgcttaccgcaacatgttgggcatctgtgtcatgcttttcggcaaaccgttccatcaaggcacgctcgtcgtcagtgagctttgtcggaatcttcactgcgatatgcgccaccagatcgccacgctcgctcttgttgttaagatgcgtgacgcccagattcttcaaggtcacagtgtcgtcaggctggcttcctgcaggcactctcacagactgcttgccatcgaacgtgtcgatttccagatcatgccccagtacggcccagctcatcggcacttggatccagcagtgcaaatcatcaccgttacgagtgaaggtgtcatcctgagcgatgcggatgtcgacatacaggtcgccggcaacaccgccgttttcacccacctcgccctgattagcgagacgcagacgggtattgttcgtcacgccggcaggcacggacacgccgacattacgggtgatacgcacacgaccatgaccaaggcaggacggacacggattttcgataacggtaccatgtccctcgcaacgctcgcatggagcggtggtcatcatctggccaagcatggtgcgcaccacgcgctgtgcgtagccctgaccatggcagtcggggcactgtgccggctgggtacctttctggcagccggtgccggcgcattcctggcacagaccgaacgttttgatttcaacatgtgcggtgtcgccgaacaccgcagtcttcaagtcgatggtcactgtggccagtgcatcgtgtcccggctgtgtacgaggggtcggaccgccgttaccaccgccgaaagcacctccggtgaacatgttgaaaatgtcacccatgtcgccgaatccgccgctgaatccgccatgcatgccgccggcgttcggatcgttcgggtccacgccggcgtcgaacatctgacgcttctgtggatcggacaacacttcgtaggcgttattgacttccttgaatttgtcttcgaattccggacctgcgatatcgggatgatatttgcggctcatctttcgataagcttttttgatctcgtcgtcgcttgcggagcggtctacgcccagcacttcgtaatagtccgtcacggttgttctttctccctattgcttttcgcgtgtcattgtgccataaggcggggtcagctgttgttttggttttcgtcgtgagccacgaatgcggtcagatatctggcaacggcacgcactgctgccatggtcgcagcatagtccatatgcgtcggtcctatggatccgacgaaggcgatgggctcggtggaatcctgcgctgcagtggtgtgattgcttgtctctctcccctgctcctccgcagtctcgccttttgttacgtcgtcagcggttgccgaggttcgaccgtacccgctggtcaccacggatgcatgcagcagaccgggcgtgtgcgtttcggagccgatggccactccgactccatcggattgcgtggtttcgctcaacgtgctcatgagtttcatgagcacgacttgctcttccagcgcatcgaacaatggtgcaagatcggccacggcacgctggtgcgcgagtcgtgaggttcctgccatatagagttcgctcgcgcgctcgtcgtcggccatgccatcgaaagcttgagcaagcgtttccgccagtctactgatggggcggtattccttgcgggatgacatctgcctgacatagtccgcggttcgtgtcaaagaaacgctggcacactgcgcgttgatttcgttgaccagatgcgacagcactgtggtgtccggcaactcggaaacgttgagtatatgttgcgccactcggccggtgtcagtgatgacgacggccaacagggtgttgattgatacgggaacgatttcgatatgccgtaatgtcgatttcgccaacgacggggccgccacaaccgcgacctgaccggtgatctgtgccagaaggcgggctgcgcgctgcaaggtgtcctgcagattgacggatcccgacagaaaactgttgatgccacggcgttgcgcttcagacatcggcaccactgtggccaagcggtccacgaagtatcggtaccctttttccgttggtatgcgccctgccgacgtatggggttgaataagatatccctcatcttccaaggcggccatatcattacggacggtggccgagctgacgcccagatcatgatctttggtcaaggtggtcgaaccgactggctcctgcgagcgaatatagtcctcgacgacggcacgcagcaccaacatacgtcttgactgcgtcatgcgtgcctcctctttatgtatacacgatacgattcagcgggagccggttttcggaatatctgcgacattaggagaaaccgtcttccgtaaatacttctcccattgtattagcactcgcgaggcgcgagtgctaatacgttcgcttccagagtactcgtttctcgtttttcccgatagcaatctcccgaaatgctcgtcataccaccaatcgaacagagcaatcgcacgagaatgttaactgtgagcgttaacagaacacaaactaccaaaacacgccaaaaatccaccacaacgtcacctcacatcgctactatggaaaacgcaatgtgagggcgtcgagcgctcggcacaagccggatacgcggcccgaccaattggaaggaaagtaatccatgaccgaattcaaggagaccgagctggacgagcgcgccatcaagatggccaaggtcctgtcggccgacgcggttgagcgtgcgggacacggccacccgggttcccccgtctccctggcgcctatcgcctacactctgtaccagcatttcatcaagcatgatccgaacgatcccaattgggaaggtcgcgaccgcttcatcctttctggcggtcatgcttccctcacccagtacgtccagctgtacttctccggctacggcctgactctggatgacctgaagaacttccgcggcggtgctgacacccgtaccccgggtcacccggaatatggtctgaccccgggcatcgaaatgaccactggtccgctgggccagggcttcgcttccgccattggtttcgcctatggccagcgtttccagcgtggtctgcttgatccggaagctccggcaggcgaatccccgttcgaccacaacatctgggtcatctgcggcgaaggcgatatcgaagaaggtatctctggcgaagctgcctccctcgctgccaaccagcagctgggcaacctgaccgtcatcttcgatgccaaccgcatccagatcgaaggcgacaccaatctggttctggctgaggacgtgctcaagcgcttccaggcctacggctggtacaccgacgagttcagcttcatccagcctgacggctcctacaaggaggacgtcgagggtctggccgacaccatcgccaaggctcgcgaggccgctccgaaccagccgaagctcatcaaggtcgataccctgatcgcatggccgaccccgggcaagaccaatgatccgtcctctcacggctccaagctgggcgccgaagccgtcgcaggcctcaaggaactgcttggctacgatccggaagagtccttccatgtcgacgaagaggctctggctcacgcacgcaaggttgccgagcgcggcctcgaagcccacaaggaatgggacgagaagtacaacgcatggcgcaaggccaacccggacaacgctgccctgtatgaccgcctcaaggccggcgaactgccggaaggcttcgacaaggccatcgatgacctcgaggctaccttcgaagtcggcaagggcgttgcaacccgtggcgcttccggttccgtgctgaacgccatcgccgctgtcatgccggaactctggggcggctccgccgacctcggtggctccaacaagaccgatcttaagggcgctgccaccttcgctcctgccgagtgcgccaccaagcagtggccggtctgcagcccgtacggccgtcagctgcacttcggcgtgcgcgagttcaccatgggtaccatcaccaacggcatcctgctgggctcccatacccgtccgttcggtggcaccttcttcatgttctccgactacgagcgttccgctgtgcgtctggccgccctcatgcagattccgaacctgtatgtgtggtcccacgactccgtcgccgtcggcgaagatggtccgacccaccagccggtggagcacctggcttccttccgtgccatcccgcagcttgaggtcgtccgcccggccgacgcttacgagaccgccgaagcctaccgttacttcttcgagaagaagaacactctgcctgcagccatggtgctgacccgccagggcgttccggttcttgccgaaaccgctgagaaggccaaggacggcgtcaagaagggcgcttacgtgcttgtcgacaccgagggcacccctgacgtcattatcatggccaccggttccgaagtgcagtgggccgtctccgcagccaagaccctggctggtgaaggcattaaggctcgcgttgtgtccgctccgtccctcgaatggttcgaggagcaggacgccgagtacaaggaagctgtgcttccggcctccgtcaaggctcgtgtctccgtcgaggctggcgttgccatgccgtggtacaagtacctcggctcctacggcaagccggtttccatcgagcagttcggcctgcagggcgacggtgctcagaacatgatcgacctgggcatcaccgccgagcatgttgtcgaagccgccaaggcctccattgcggaagtcgaagccgccaagtgattcgacggggaggggcatgatgcatgtgcctctccccttttaccgcacaataaataaagatttgatccaaaaaggtatcaaggagaaaaacaatgactgaagcaactcagcgcacctctgactccggtgtctcgatctggctggacgatctgtcccgcacccgtatcgaatccggcaacctgcaggagctcatcaaggacaagaacgtcgttggcgtcaccaccaacccgtccatcttccagaaggctctgagccaggtcggcccgtacgatgcacagctcaaggagctcggcaaggttgacgttgagaccgctatccgcgagctcaccaccaccgacgtgcgcaacgccaccgacatcttccgtgagatcgccgaagccaccgatttcgtcgatggccgcgtttccatcgaagttgatccgcgtctggcccacgagaccgaagccaccgagcagcaggctgtcgagctctgggagaaggtcaaccgtccgaacgccatgatcaagatcccggcaaccctcgaaggcctgccggcaatcactgcaaccctggccaagggcatctccgtcaacgtcaccctgatcttctcgctcgagcgttacgagcaggtcatcgatgccttcatcgaaggcatcgctcaggctgacgccaacggccatgacctgaagcacatcggttccgtcgcttccttcttcgtgtcccgcgtggacaccgccgtcgacaacaagcttgaggagatcggctccgatgaggccaaggctctcgagggcaaggccgctatcgccaacgctcgcctcgcttacgagctgttcgagaacaagttcgccaacgatccgcgttgggctgctctcgaagccaagggcgccaagaagcagcgtccgctgtgggcctccaccggcactaagaacccggcctattccgattgcgtctacgttgacgagctcgttgccccgctcatcgtgaacaccatgccggagaagaccctgaacgctctcgccgatcacggcaacggcgctccgaccatcaagggtacctacgaagagtcccacgccatcatggccaagctcgctgagctgggcatcgacttcaaggctgtcaccgacaagctggaagccgacggcgtcgcttccttcatcaagtcctgggattccgtccttactgacgtccaggctggcatcgaccgcgtcaacggctgagcttcttgcttaagtgttagcgatctaagctaaggacccccctgccagaattctggcagggggtttctgctattgctctacatgttttcagcttattccggtacgaggcgtaaaaccagtggcctggtggatcgcttgaatcgcctgcgttttgcgcccttcaaaagttggattgtcaagcgtcaccacacggtcggcatacggtgactcctgaatgacgcgtaccaaagtctcatggaaccgataccgatccgaagcccaccgcattgcacggaacccatcatccacatattcggtgatcggaggaatcagcaacaccagatcaggcttctcctgttcaatcaccatatcgaatgtcggcttgcagcttggcgttctcatcggccggcagatagcgttccgcatagacacgcgtaaccatggcatcagtatcaagaaaaacgatgccatgattggcatgcgatgctattgcatgctcgttctgagagaacttggaaagaatcagccgctcgtaatcgaaagcggtaagttcatcatcgtcaacattgcaggcttcctcaaattcacgggcatactcgaccgcgatcggagcgtcatacaatttcgacaagcgtgtcaccaatgtggttttgccgacggaagccggcccaacaaccaatatgatcgttgtgaactcgcgacggaacgattgattgatcagcggccaccatttgcgattatgctttccgtgcaaatacttgattgcagatcatccgatacggccatagtgctgctcttgtggaaccagacccatgcgccgtaaaaaccgttggccaacatgaccacctgaagaacgaacatcgacatggcgccaggacctccggcggaaagctggttgaaccagataaccaccttgatcacgtcaagaataatccatgcgacccactggctgcggtagccgtatgtcatgagaatctgtccgacgataccaagcggcagcagcgtgccgtcaagccaaacctgtacaccgccagtatggctcgacacgaataccacaatcagatagatcacgatggttgcgatgacggcgagaatgccttgccaccatgtgaacatgcgggcattgacttcctcatactcgtttttttcctgacgatcaagctggcgctgccacacccatacgccgacgaactgcatggtgacgtagaagatctgagcgaagatgtctccgacgagatggttcatgatgacaacgatcagccaagtggcgcaaccgatgaagccccacagatagttggtcagtcgcccacggtcgacgagaatgagattgaacacgatgcataggccggaaatcagaccaattcaacctgccgcggaaaatctttggacacgaagaatgacaccaactgcgccaacagcatgaccgtgatcaggacaaactcccccggcttgaagtcagtcagctcgcggaacacacgcttcggattgacgacgttgccgattcctttgagcaaatcgttcacaatatcccctttcacaatgaaacgatggctcggccctaaggccggagccatcgtagccctacttatggtcagtatgactataagtatttggggacggagtgtcgcgatgctgcgcgtacttcacaccatgaaagcccttcaagcaatcaaggtcatcatgcctgatgatatgtgctcaagaaatcaccgatctcacttacggtttcctttaacatcgtgatacgtggcagatataccaccctgaaatgatccggattctgccagttgaatgcaccgccatgactgatcagaatatgcttgtcatgcagcagatccaacgcaaactgctcgtcggagtgaatattgaacttcttgacgttcagcttcgggaagatatagaacgccgctttcggcttaactgcggtaacgccgggaatctcattgagcatctgatagaccagttcgcgctgctcgtacacacggccacctggcttgatgtaatccttgacgctctgatgcccgcccaaagcggtctgcaccaccgactgagctgggacattcgagcacatacgcatgttcgccagcatgttcaagccctcgatgtaatccttcgcaatacgcttgttgccggaaagtatcatccatccaatgcgatatccggcaatcatatgcgacttcgacagaccggagaacgttacacagaacaggtccggagccagcgatgcgatagaaatatgctccagtccatccatgaccaaacgatcgtaaatctcatcggagaaaataatgagctgatgttctcgggcaatgtcgacgatttgttgcagcagttcctttggataaagcgctccggtcggattatttggattgatgatgacaattgccttggtcttatccgtgattttagagcggatatcgtcgatatcgggataccattcggatccctcatcacagatgtaatgcacggcggtaccgccagctaaattcacgcaggcggtccacagaggatagtccggcgaaggcaccagcacctcgtcgccatcatccagcaacgcggacagcgacaggttgatgagctcgctgacgccattgccggtgaagatatcatcgatggagacgttcggaatattcttgagctgtgcatactgcatgatggctttgcgtgccgagaacagacccttggacggtgaatatccttcggtttcagggagctgttgcgccatatcatacacgacttcatccggagtccggaatccgaatggcgcaggattgccgatattgagtttcagaatatgcgttcccgcggcttccatgcgtgctgcctcgtccgccaccggaccacgaacgtcgtagagcacattgtcgagcttatgagatttcgtaaaggtgcgcatagtctttccttctgttgattgcgctgatgcaggattgctatcatgttgggcttcatcagacttgattgcgggcaaggtggcgacgttctgctccatgggaacgtcctttcccatcagccagtcctcattgacctgcagaaaagccgcaagaaaatgggcgatatcggcacgcggcacggttttgccgctcacgtactgactcatatgacttttgccaagtttgatattgaacttctcagcagcatgcacaaagtcaatttgtttgacattgcggaacgccatagcgacgttcaaccggttggagaacgattccgccatactagtcctttcagttcaattttcatcaagcgctagttcaaatcctaacacaaaccaactaacgaaattgcggaagttcaatatcaaatgtaactatttcgcatccttttgcgacaaaagttcaattcacgaagttcaactcatgtaactcttgaatatcacgagacatcacagcagattatcttcaatccactgcgccacaccgtcatcattattagatggacagatttcatctgcgatgttcaacacatccggattggcgttcgccaccgccactcccctgccggatttacgtagcatggcaatgtcgaccaaatcgtcaccgaatgagacggtattgctcatcggcgtctcaaaatgttctgccagcaaatccaacgcatgctccttgttggcttgaggattcatcaacatccacagcgatccctcagagatatgtacgtcaaaatcgttgggcacaagagaaccgacctgattccgctgctcatcgttagggaagataatgagcttatcggcgatgccttcaggaacatcgtcaaagtcagtgtatcgccaggtctgtgttttccaatatttcgtaacatcgaaattggtgtatctcacatcatccatgacaatgccgacttccataccgggcagttcattcaacagattcttgcagacttcgcatgctcgctgtgaggagaatccgattttcttgagatggccgtcttccggcagcatcggcgaagtgagcatttcataatttgatgaggctggattgaaatcgatcaatgctccattgagataggcaacggcatcaaccggcagtttttccacgaacgaaaagcctgtgctgaccggacgtgccgtttccacaacgaaggtcacgccattatcgtgcatgcggttaatcacatcgatggaacgttgtgtaagaaaacgttcctcgaacgtttcgccatcatgcagcaaagtaccgtccaaatccgcgacgaccatcgtggtttcttgggttttctcgattttcaaagacgtcaaatcaatccttagctcgtatgttgtagacaatactacgataaaaaacacttcggcccatgactgtaatccagtcatgggccgaagcaaaaagccaatcagatgagatcgaacttcgtcatcagaccgagggcaatgatgatggcaacccacagcaccgcgatgatgacggtccaacgattcaggttcttttccgcgacaccggaagaacccgcattctgggtgagaccgccgccgaacatatcggacagaccgccgcccttacccttgtgcatcagaatcaacagggtgagcaagaggctgaaaataacaagaataatctgcagcacaagcttgacgatggccatagcggacacgagtgaacctccagttcgtaaacactgctgttaacaatagcgcaaggtattgagaaaaccgaataatgaccacaccttgaaaggccaactcgataaaaacattactccgcgagcatcatactgtcgcattcatggtgagctggcagattctggtgagctcatccacgttcagcgcggcaccgccgataaggaatccatccacatcgggctcgccaatcaattcttcggcgttctttgaggagacggagccaccatacagaatgcgcacggactctcctacatgcgtgccgaaagtttcagccaaatcatcccgaatcgccttggccgcgtcctgagcggattgtggagtggccaccattccggagccgatggcccatatcggctcatacgccacaatcagacgcgacgcttcctcgtcggaaagatcgcgtgtgacgtcatgcacctgccccacggcgaaatcaagctcaatgcctttgcgacgttcctcgtagctttcgccgacgcaaagaatcggctgcattccggccgccaaaacagcgcgtacctgatccacgatgttcgcatcatcttccggatggtactttcgtcgttcggaatgtccgacaatcacatacgaacagccgaggtgggcgatcatatcggcagacacatctccagtgaacgcgccctgcgatgttacggaaacagcctgtgcgccgtagtgaatcttcaaattgtcggattcgaccaacacctgcacgctgcgtaacgatgtgaaggacggcatcaatgcgatttcacaatggcggtagtcgaaatggatgtcacgaagtttccatgcgagctgctgaacgaaataggtggcttcaagatggtcgaagttcatcttccaattgccggcgaccagtggaattcgttgcgatgccatgtgtttgcctgcctccgttcttatttcattcagtgttcgtacgccgtggtttcgggttagtgaaaacaagaggtgctcccccaccttttttgttgataagggagcacctccggttatgcgttaagcaatcagtcgagcaccttcaggcccggcagttccttaccctcgaggaactcgagggaggcaccgccaccggtggagatgtgcgagaagccatcctccgggaagccgaggttacgcactgcggaagcggaatcaccgccgccgacgatggtgaacgcaccagctgcggtagcgtcgaccagaccctgggccacggcctcggtgccggcagcgaaagccggaacctcgaacacacccatcgggccgttccaaacgacggtcttggaatccacgatcttgtcgtggaagagcttctgggaatccggaccgatgtccagacccatcttgtcagccggaatggcgtcggcagccacgacttccggagcgatgtcctcatcggacttcgggaagaccgggttcaccacgatatcggtcggcaacacgagttcgacgccgttctgctcagcgcgctcgatgtagcccttgacggtctcgacctgatcctcttccagcagggaggtgccgacctcgaggcccttggccttgaggaaggtgtaaaccatgccgccgccaatgaccagacggttggccttgtcgagcaggttttcgatcacaccgagcttgtcggagaccttggaaccgccgagcacgacggtcagcgggcgttccggctcaacggtagcgcgggacagagccttgacttccttctcgaccagcaggccggcagcagccggaagatcggcagcaacgtcgtaattggagccctgtgcgcggtgcacgacgccgaagccatcggatacgaacgcttcgccgagcgcagcaatcttcttggcataagcggcgcgctcctccggatccttgctggtttcttccgggttgtaacgcacgttctgcagcagaacgacatcgccgtcgcccattgcggcgaccttggcctgggcatcctcaccataggtgtcttcagccagcgggacctcgatgccgagcagctcgccgagacgagcagcgaccggggcaagggacagttccggaacgaccttgcccttcggacggccgaggtgagccatcagaatgaccttcgcgccttcttcgcgcagggccttaatggtcggcagagcggccttgatacgaccgtcatcggtgatcgtggtgccgtccagcggaacgttgaaatcggcgcgaacgagaacgcgcttgcccttgagatctccaagatccttgagtgtcttcatgtatatcctttcctagccgcttgtaagcgtggaatggccatattgccatttacgaataatacaagcccaaacgaacaaaaacaccatactgttcgaaaacaggcatggtgttttgcataaaagattcaatcaagccgactggcggcgcgccttttcggttttctcggcgagctgcagaagtcgacggatgcggcccgcgatggcatccttggtgattggtggatcggccaaacgtcccagctgttccagcgacgcatcagcatggtcgagacgaagctggccggccgatttgaggttgtctggaatgtcatctccaagaatctcaaacgcctgacgaaccttgtcgcatgcttccgcagccgccttggcgctgcgacgcatgttggcgtcgtcgaagttggccagacggttggctttgccccgagcttcgccgtcggaacgctttccggtccactcgcgtgcggagcgcggcgcacccataagaatgagcatacgttcgatggcgtcgggatcgcgcagggtgacgcgttcggagctgcgtagcttacgcggcttggcggtgatgcccagacgccgtgcggtggagaccagtgccagagcggcctcatggttcgggcacacgatttcaagatagctggccttgcctggatcggacagacgtccgttggcgaggaacgcgccgcgccatgcggacttgatctgcgcgattttgccgttgatgatatcgcttggaagaccaagcaccatgttcttggtgtaacggctgtacaggccggtctgcagcacgagcgccgtactgcccttcggcacgcgaatcacataacgctgcacggtgccggttggcgtctgcctagagacaggagtaagcgtggcttcatgaccatacaggttcttgatggtgtcctgcagccaagcagccgcatcttgggagtcgagctgcacctgcacgagaatgtggtgatccaccgagtgcaaaccattgccgaatcgaatcatcgctgtcgcctgcgcctttttggcgatcggcagttcgttatcgattgcggccagctcgcttttgacgtcatccagaagagccaagagccaacctcctaccttgctgttcttccctaaatttcaggcgagtcgcggaatcattccgcactgccacggcttactgtgataccgaatatcttggacaatcacagccaggtttctttacatatggacactattctctcataatacggtcatttttccgctgaccgcttatcaagctcgcgtgcggaaacggaaaccgacaaccccctcgcacgcagtcgcttagccaaagcctcactcatcgcgacagaacgatgctggcctccggtgcaaccaatcgcaatagtcacataatgcttatcttcctgcgcatatccttcaatcgcaatcgaaagcgccttttcatacgagtcgaggaagtccgcggccccttcgctggaaagtacgtaatcactcacctctttgtcgcgtccggtcagcgagcgaagcctgggaacccaaaatggattcggcaggaatctcacgtcggccacaaagtcggcgtcgatgggaataccgtatttgaaaccgaaactgaagatgtgcacggaaaccgtggtcggaccggatccgagcatggcctcatataatttcgtggacagctgatggatactcaatgatgacgtgtcgataacgatgtccgcacgttctttgagattctcaagcagatctcgttcctcgagaatgccgtcaatcagtcgattgccctgctgcaacggatgaggcctgcgtacggattcatatcgtttgatcagcacctcgttgctggcatcaaggaacaggatacgcgttttcacaccaagatcgtccagatggctgagcaccgcggacaggtcatcgaaatagtcgcgggaacgcacgtcgacaacagcggcgagtttgtgaatattggatcccgtggtcatcatgtccaccaagggcaccagcagttttggaggcatgttgtcaaccacataccaacccatgtcttcaatgctgtcggcagcatgcgaacggcccgcaccgctcatgccggtgatcagcaatacttcaaaaccttcagccggcgaaggggcgctggcatgcgtgccattcgcctgtacgtcgatgtctttctgtgccatcacagagcctcctcaagcgcgatgcgcatggcttgttccaaacgcgcggtgcaatcctgatcaaccataccgctcggcggatcgtcatcccagattcccgtcatcaaccagacctgcaccatggcctgatacaacagcatctgctcgccgccaatggcgattcctccctgttggcgccatgcctgcatcagcttggtagggcgtgggtcatatacgacgtcgagcaatgttccatgcatgcgcacacctggcattctcaatgattcggcaataccgtccgcagccaatccgggaatggtgtttatcgccacatcagcctggcgcaacgcttcgatggcgtggtccatgccgacaatgctgatcggctgttccgatggcatataccgttcggcaagtggcttgagatcggcgttcttctcaggatggcgagccacaacgatgacatgtccgatcgcagacatctccacgcatgccgctaacgccgacgttgcggtgttgccgttgccgatgatcacggccgttcccgaacggtccgtcttcggcgttatcgcacgtgtctgatacgagtgttcgaaagcgagttcgatgccgcgtacgtccgtgttatatagcctgatgaaggggatgttcgaattgccattgacgcaggttttggtccaatcaaacaccgcggtattggcaaccataagctctttggcccatgtattgcacggtgttccgtatggctggatcgttttcttcaatggcatggtcaggctgagtcccgaccaggtcggatcaagcgattcaagaaagccctcaagatcaggctcgcccacctcatgcttgtcgtacgaccagtcatcaagatgcaacgcgtgataagcggcattgtgcagcaccggagacaatgaatgtgcgatgggcttgcccagaaccgcgcaccggtggttgacctcggtcatattccctccctatatattcaccgtcatcatgctagcaatccgattgtcttttttcgctacccaatcttattccatttcatctttcggactattcgacgaaatggcattttccgtcgacggttgcccgtcgtgggcgtgcaacgcttggtaaatggctgcggctttggcttttccgacgcctttgacctgctcgaaatcctcgacatccgcctcacgcatggcacgaaccgagccgaaatggctcagtaggcgcttctggtatgcctcgccgacgcctggaatatcgtccaaggcggaacgcaacgcgcctttccttctggtctgacgatgataggtgatggcaaaacgatgcgattcgtcgcggacgcgttgcagtagatacatgccttcggattgacgtttgagaatgatcggatagtcgtcatccggcacccacacctcttccaaacgttttgccaatccgcacacggccacgtcatccacaccgcaatcctcaagcgccttcgcggccgccatgacctgcggtttgccgccatcgaccaccaccagattaggcttgtatgcgaaatgatgccgattggtgttctgctggacagtcggttcatgagtctggtcaccatgctcggatgcccgacgttcattatccatgctttcgccggagtcaccggcgatattgccatgttggaatcgtcgcgtcagcgtctcgtacaatgcgctcaaatcgtcgagtgcaccctgtccgtccgctccgcgaatggcgaaacgacgatattcggactttttggcaatcgcgtcctcgaataccaccatggaagcgacctggaacgctccgccgacggtattggaaatgtcgtagcattcgatgcgcaatggagcctgttcaagtcccaaagccttggcaacatcattcatggctgtgctgcgggcgcccatatcgctgatgcgactcatcttgctgcgctgcattgcctgcttggcattatcgttggcacggtccagaagccgtctcttatcccctctgctggccacgcgaatgctcacggcaccaccgcgcaatccgctaagccatgattcaagctcttcacgccgggccggctcgatgggaacaatcacctcgcgcggcaccggagagataggagccaacaaatccgcacgaccggtctgatcctgccgctcgttacgttccctggtagcttgcgcgcgtgccaccgcatcggtcgccgtcacgatttgcgtcgatccgatggcattgcgttgttcggtgacaacagtcgactgcgaagccctaatcgtctcccctgcggtttccgaatacacctgcacaataaggtcggcaatcagctcctcatccgtcacatcctcaacccgttccacactccaattgcgttcacctcggatggaaccggcacgcacgtaaaacgcgtgcacggaagcttccagctcgtccgaatcgacgccgaagaaatccgcatcgacatcggaatcgaacaccacggcattctgctcacccactgtggatagcatctggatctgatcgcgcaaccgagccgctttctcgaactccaactcgtcgctggcctccttcatttcacgcgtgagctgtgcgatatacgatttgccgatgcgaccggttaatacgccaataagctgttcgcacatcttccggtgttcctcgacgctgatacgtccaatgcaaggggccgaacatttgccgatggacgcaagcaagcatggacgatgagtgatttccgccttatgataaacgttctgcgaacaggtgcgcacaggaaaagtcttgaggagacggtcgagactgtgacgcagatcccatactttggcgtacgggccgaaatatcttgtatcgcggcgtttgcggcttctggtcacccacacccgcggcacgcgttcaccggatgagatcgccagatacggataggttttgtcgtcgcggaacacaacgttgaatcgtgggtcaaactctttgatccacgtgtattccaacgtcaatgactcaagttcggtaccaacgaccgtccattccaggttacgggccgtcaataccatggtttgagtgcggggatgcagctgatacaacggttggaaataattggtcaaacggttgcgcaggtttttcgccttgcctacgtaaatgaccctgccttcaccatctcgccacttgtatacgcccggctgcgccggaatgtcggatgttttcggacgaaacaggtcacgtgaatcccccagcagaggcgcgccgttcttgtttacgtctttgccgggagaatcatcaccaccgacactgaaaccgtcgccgttcaactgttcggcggttttgcgccaaacctcctggctgtgccgctcgatgggtgcgctcacagcatgcccttaaggaacttgccggtccaagactgttcgcattgagccacctgttccggcgtaccttcggtaacgatggtgccgcctccgtcaccgccttccggcccaaggtcgatgatccaatcggccgacttgaccacatcgagattgtgttcaatgacaataacggtattgcccttatccaccaatccctgcaagacaagcagcagtttgcgcacatcttcaaaatgcaaacccgtggtaggttcgtcaagaatatacacggttttgcccgtagaccttcgctgcaactcggtcgcaagcttcacacgctgcgattcgccgccggaaagcgttggagcaggctgtccgagtcggatatacccaagtccgacctgcacaagcgtgtcgagatagcgggagatggagggatacgctttgaagaactgggcagcctcttcgatcggcatgccaagcacgtcggcaacggatttgccattgtatttcacctccaacgtttcgcggttgtagcgtttgccatggcattcctcacagtccacatacacgtccggcaggaagttcatttcgatcttcaaagtgccgtcgccatggcatgcttcgcaccggccacccttgacattgaacgagaaccgccccggaccgtatccacggacttgcgcttcaggggttttggcgaacagcgtgcggatcttatcccatactccggtataggtggccggattggaacgcggagtgcgtccgatcggattctggtcaacgtggatcactttgtcgcactggcccacaccttccacacgggtatgcttgccgggcacgatgcgcgcaccgttgagtttgtcggcaagcaccgggtacagaatctgattgaccaaagtggatttaccggaacccgaaacacccgtcacgcaagtgaatactcccagtgggaagttgaccgtcaaatccttcagattgttttcgcgggctccaaccacgcgcaactgcttggtcttacgtactttgcgacgggactgcgggacctcgatctttcggcggccggcaatgtagtcgcccgtaaccgaacgcggagcgtcaacgagctttttcgcgggaccggaatagatcacttcgccgccatgctcgccagctccaggtccgatgtcaataacccaatcagcgtttttgatagtgtcttcgtcatgctccacaacgatcagcgtgttgccaagatcgcgcagatgatgcagagtggtgatcagccgctcattgtcacgctggtgcaaaccgatggatggttcgtcgagcacatacatcacgcccaccaaaccggaaccgatctgggtcgccaaacgaatacgttgcgcctcgccgccagacaaggttttggcggcacgagacagtgtcagatagttcagtccgacgtcgttgaggaatccaagacgggcacgaatctccttcaacacctcgccggcgatctgcgcggccgacccttcaagctgcaagccgtccatccatgcgaggcttgtctcagcggacatgtcgcacacatcggcaatggattccccgccaacggtcaccgccagcacttccggacgaagcctacggccttggcatgcctgacaaggtacttcacgcatatacgattcgtaatactgcttcatctgatcggagtcggtctcgtcatgcctacgcatcagcgtacgcaccacgccttcgaaaccggtggaatattcgcgcatacgaccccaacggttacgatacgagacctgcaccttgaaatcacgcccatacataatggcttgacgggcctcttccggaagatccttccaaggggtgtcgagatcgaaacccatctcatcgccgagcccctcaagcacatggcgataatattcgccggtgcctttggtcatgccccacggttcgatggcgttctcattcagtgtcttgctgggatcgggaatcaccagttccggatcaatctccagcttgtatccgatgcccgtgcataccgggcaggcaccgtacggggcgttgaacgagaacgtgcgcggctcaatctcatcaagttcaagctgatgcccgttcgggcatgcgcgtttttcggaaaaaggcttacggcggtcaggatccttctcatccaaatccacaaaatcggccaccacgatacccttggcgagcttcaatgcggtttcaatggaatcggtcagacgctgacggatgccgtccttgaccaccagtcgatccaccaccacttcgatggtgtgctttttctgcttggtgagtttgatgtcgtcggacagctgcttcatttcgccgtcaatcagcgctcgtgcgtagccgtcgccccgcaagagttcaagcagatcctcgaactcgcccttacgcccacggacgaccggcgcgagaatctggaatcgtgtgcgctccggatactgcagcaacgcgtccaccatctgttgcggcgtctgtgcgctgaccaacgcgccgcattccgggcaatgcggaatgccagtgcgggcaaacagcaatctcagataatcgtaaatctcggtaatcgtgccgacagtcgaacgtggattgcggttcgtggtcttctgatcgatcgacaccgcagggctcaaaccttcgatgaaatcgacgtcgggcttgtccatttgccccaggaactgccttgcgtacgccgacagcgactccacatatctgcgttggccttcggcgaataacgtatcgaaggcgagcgaggatttgccagaacccgacagtccggtgaacaccaccatgcgattgcgcggaaactcaagatccacgttcttcagattatgctcgcgagcgccttggatggtgattttgaggtcgttgggcaggtgcttgaggtcggctgtaagtgaaccgtttttcgttttgagaggggcttttttgatttctcttgcgaggaatgcgtcgctggtgagaacgcgttcgactatgacgtcgccgtttgctgcgttgttgcgtttggttgccacggcttgcctccgctggtggttgttctttgttctagttgtttaggatacctcattttcgttatgatttcgaacaggtgttctatttgtggtgtgttgtgttccattggtgttggttgtggagtattgtcattgcgtcgttgatggggatgcgttcttgttcgattcgtaggtaggttgtgtttttcccggtgcagagttgttcgtataagtttctttcgtgttgcgtgagtcctggtgttggtttggggtcgcgtgttttgaggggttgttttttggtgtcgagtttggtgccgtatggttcgtatgttttgtatgctgtgctgtccatgagtatggagtcgcaggtgatgccggtttgtcgtagttcggagagtatttcgaggccgtctgcgtctatgtctccccagtagatgatgtggggtgtggttgtgatccaaggtagtagtgttttgattcgggttgccgcgtgtccgctgccgaatatgcagatggcgtgttctgttgtgggtatggcttggtaggtgtctttgttttccacgatgatgatgtgggtgatgtcgtgtggcgcgccgtctgtccatggttgtgtcacgatgaggtctggttggttgtggtgttgtgcgtcgaggagtcggagtcggatttctccgtggcggtcgttgagggctagttgttctcgtttgaggagtttgcagattgctttgcagcggtttgatgttgttttgcctagccattttgcgctgaatccggggatggggaccatgcgtggggtcatgttttcggtgttgtggttggcgaagtagtgtgcggcttgtatgacgaggttgaagtcggtatcgtcgtggtttttgaggattttggcgatgtttatggaggtgttggagtcgaggttgaattggctggtgatggtgtgtgcgcgttggtgttcgcgttggtagagtttgcgtgtttgtggtgtggtgatgttgagggccgtgttgaggtcgggtatggttaccgagtcgatgagttggctggtttgtcggacgattccgttggagatgactttggttttttcgctggtttcgcagtggtgttgttgtgcccagttgcggatggcttcgtcttgggcgcggatgtgcgtgtaatgggcttcgagttcggcttgtttgggtagtcggatggttttgcgcaacggccaggaggtgttggcgtcatacatgtgcttggtgagatagtcggtgacgtatccgttgagttggctgtggatgtcgctgttggtggtgcttctggccgttgccatgggttatgcctccgttgttggtttcgcgggtgcggtggtgggctgtgtttcgtcctgtgtgatggtttcgctgtcgagttcctgtaggtatgagttgtcggtggatgggtctttgtatgcgacgtatgctctgttggcgacgttgaggatttccgcggttttgctttccggggcggagacgatgatttggaagccgagtcggggtagtacggcgagcgcgcgtttggtgtagcggccgtcggctttgatgagtgcttcgtcgaggaagagcgtggtgtaggtggggcgtgcggtgaggtctccgccgagtatgtagatgagggccgcgccgtagacgaatgaggtgagttcttggagggctccgccggattttccgccggtagagctgatgcgttcgtcgggggcgttgtcgtggtgcacgattgcgtagaatgagctgcgtacgcgtgggtcgaggttgcgtgcgccgtatgctttgatgccgttggtgtcgtgtattttgtcgagttcgttgtgcagtctgttcacgaatgtttcgcagttgttgaatgctttgcgtgtttccgtgggattgtcgcttgcgttgcgcgtccagtcttccagttttgacaggatgcggctgagggttgtttcgaattgtcggtcgattgggctgaaggtcacgtcgagtgatagtctgccgccttgtgggccgaattgttgtcctttgagcatgctgttgatgcggttgagctgttctttgatgttttcttcgtcggtgcgtagcgcgcggttgagctgttggaagctcatgtagagttttttgacgctgttggcgtattcttcgtcggttgcggcgcgggtgacgagcatgttgagttcgtcgagttcgtcgaggaagtatcggtagtcttccacgcttgccatgacggtgttgtcatctgtggagtggtttttgaggtagtcgtccatgatgcgttccgtgtcggcgcgcagttggttggatctggcgtcgatttcttggattcgtgtgcgtgcgatgcgtacgatgttgcgtagcgcgcgcgtgtggaatggtgtttcgctttcatggtcgaagaggcctgcgatgagttttggccggtcttgcgcgcgtacggatgcgccgaagcagttctcgtatgcgtcggcgagtaggttcgataccatgctggatagtgtggcgtcgtcgaagtcgtcgttgccgtaggcgtcgagccatgcttgttcggcttggacggcgtgttgggccttgtcgaggtcgtcttcggcttggtactggtttctgttttcggcggtggcctgttggttgagctgtttcagttcggtttgcagttggccgagttccgggtcgttttcgatgcgttcgatctgcctgcggattcgcgtttcctgttcccgtagtccgttcacgtcgattttgctccatggcatgtcggctacgattcgtgcgagctcgtgctcgtcttgcagcaggctgatggcgttggacatttgttcgcttcgacggtcggcgttctgcaacgcctgctccgccttgtcgagttggtttttcagttcggccaggtattgttcgttcatgaagccgatgacctggtgtagtcctttgctgccgtggaatccacggtcgccggatttgatttgtccgtcggcctgcacttgtcgttcgtcatggttcatgtcgtcgatggcgtgcacgcaacgcgcgtcgaaccgtggcgacgtcgtctggtttttcagccatccggcgaacggagagtcctcccggtattgcagtttcgacgacatccagccttcgctggcggaggattcgtattgcatgccggtgtcgatgaaccgccacgtgcgtcgtgtcatgagtttcgggtcgatggcgctgattttcgccgcgaatccttgctcgtggcgtttgtcgacgaggatggtctgcgcgatgggcgcgtaggtgacgttcattgccagacgccactgttcgtcctgttcgttcacgtccatcagttcggccacatacggcagttcggacgcgtccaatccggtcgcccgcatgataagcgcgcgcgcgtcgtccatgtcatcgctgatgcgcgtcctgtgcgtgagtttgcgctgatagtcccgtcgtaggctgtcacggtcgcgctggcggtcgtgacgctcccctaccagctgctggaatctggcgttcgcgtccttcaaccgttcctcgtacgtgtcgagcgtttcggcgagcatggcgcgtttggcgtcccatgtctgctcgctgtcgggaagcctgccttcgacctgttcgaatcgttcggctatgacatgacgttgcctgctcgcctcgtcgatgtcctggcgcacgcgttgaagatccttgccgagctgctgcagactgccgccgtcgatgccttggatacgttccttgacggcgtcgattcgcgtgttgagctcgccgacgcgctgcatcgcccgatcgatggcctcctgcgactccttgaccttgcgctgcgcggccggcagaccagcgcgcacttcgctggccatgcgcgagcgcgcccatgcggacagtgttgcgttgccatgttcgctgtcggggttgatgggttcgtattcgcgtcgttcgctggtttgctttgcgtattcgccgtagcgtgtctggatgttttgcaggatggcgacgcgggccattttgtcttccatgctgtggaagttttcgttgaaccggttgtagtcgtcgacggtttcgtgggcgaggcggatggattcgggtatgtcgagcacgccttgcttgaagatgtcgtcgagttttgagggggcgtccgccgattgtattttgtgcaggaggcggcaggcgtcggcgcttaggcccatgtcctgccagatggaggcgtggaatgccgcggcgttggtgtgcgtggtgcattccggataggttttttcgaacatggaccgggtgaatggtgtgttgcggtactggtccatgagtcgtgggtcgatggttcggttccaggtgatgtagcggcggcgtagtccgtcttgtccgtctccggcgttcaggtagaggaatttgccgcaggagagcagtcctccgtcggttttgttcacgtaggtgtcgacgattgcgccccagatgttctgtggggtgccgtcggcgtctttgccgcgcaggaagatcggcgtttcgccgttttcgctatcgcttacgccgatcatgccacgcaggtaggtgtagtcgttgcgttccgaacgtccggagttcgacgccttgttgtagggggttccggatgggtagaggagtgagatttgcgcgtcgacgagtgtggatttgcctgattcgctggcgccggcgagcagggtcaccggcatggtttcgtccatggatgggcggaattcgtgccagccgccgtatgagccccagttgacgatttgtcggctttgtagcatccacttgtcggaaacgatcttcatgccatctgccatcagtgttcctcctcgtcgaaacggttgtcgtcggtgttgaaatcgaatgcgtcttgttctatgtcttccatgggcctgtcgtccgggccggcgttggtgcggccgtcggcggatgcgttctcgtccgtggtttcggatccgagccactggtcggcgaggccgcggtcgagcaccatgggcaccagtggcgtgaggacgtacatgtcgtcgtcttcgatcggcgcgagatacccgtaggtgcgcatgcgtgagatgatggacgtgattttcttcgcagtgccttcctcgtcgttgctggcggtgaggaatcccgcgccggtggcgagcaatgcgcggatgtcgtcgaagctgataagccagtcgcatggttcggcgttctggttttcgtattccaacgctttgatgcgtagcgcggcaagcgtggcggcctcctcgcgggtgaggctcatacgtgttttcaacgaacggatgcatgtctccgagtcggtgaccggcgacgcgtacatgatgcggtatttcgtgttgtcgaccagtctgagcatgtcgttgttgagcgaacgttccacgacctcacggttctcgcaggcgaggtcatacaggctgccgtcgatgtagcgttcgcgtttgagcgcgatcgcggccatgcgcgcttcgacgggcatgtcgccggtgtcgccgttgaacagcgcggtcgaggcctgctggctgccggcctcttccaataccggctccccttctgtcaggatcgtttcctcgatgttggcttcgatatagtccgtcatgcttatctctcctcgatgatgtcgtcgagcgtcgtttcggtggtgagaatgggtttggtgcgccatacgcgttcgctgccgtcgatcgatatgcagcgccatgtcacgtatgacgagtcgtcctgcgtgcgcagggcgctgaggaagccgaccagttcgctttccctccgttcggctttcggcagctggttgaagcttgccgcgaggtccacgaacatgccgtccgatgtcgtcaccggattgctgcggataagcctgatcatgcgcgtcagccgtggcccgcatatttcgaccatgttcttgaggtccggcgcttcgatggtcgccgctggggcgtcgttcaggctggatgatgcggcgcgcgccattgatctggccggacgagatggcaatgtcgggaatttcgcctgcccggcgtccgtatggtagggccggctttggtcattgggatgggctttggcttcggcgctggtctttgcgaacagctggttgagtttggcgagcatggtccggtagctcgtgtcggtctgctggcgtacgagacggctgaccgcctcgtcggacgtgcggatctgccggcgcacgtcctcgatgccttcatagatgcgtttgagttcggaacgcacctggttgagcagcacgctcggctcgccatccaaataggggtttctggcgatgtcccgcaccgcgtcgtcgatctcgcgccggccttcgtcggtgacgatgacttggaacgcgtcttcgaaacgacgtccgctgtcggattcgcggaacgcacgtcggtattcgtcatggtatgcggtgaggatgctttccacgctcatggcgccggcctgcatgcgccgtcggagcgcgtcgccgttgtcccgttcggaaagggcgagctcgcgcaggtcgatgggcactcctcgcagagtgttgtgaatcacgccgatgatgtcgccgacctgttcggacgtgagcttttccaaggcctcgctatgttccagctcgtcgatttccttctgccgttcctcaatgtccctcttcagcaggcggatgcgctcgcgcggatcggcggtcaactgcatgcgagcatgctcgatttccatgatgatgctgttggcctgcgcgccggacagcgctttcgtggtgtcctcaagccggtcgagcgcttcgatggcacggtgcgctcgcgctgtgagacggtacaggtagcggtgcgaggccacgtccatggaattggcgagccaggcgtagtcgccttccctttcgcgggcgaggtcaagcaggaccgaatgcgcggcctcgcgcgcagtctgcccgtctttcagcgtgtaatcgtcggtttcgatgagccggttgagactgcgtgcgaaccgttcttcgacgatttcgcgcggcagctcccccgtcagcgggtcgaacgtggaacgcaacaacgcgacgtacagcatggaattgttacgcagcagcaaccgtaggacaccggtttcgtatacgggtcgaagccgttccatctcccgtctgatctcagccaacaatacgcctttccatgtgttcgatgccttggcggcaagtctccattctaaacgaaaacaaggaaaagacgccgcagttacagtacgaatgcgacgtcttttcctgtcatggaagagggaacccggccccatctaatttccggctagatgctcatgctcataagctgggccgcatactcctctacgagttcgctgtcccgttccgtccactcgtggctggcggaatcgtccggcacgaaaataatgtcgctgttctcgttcatttgttttacctccgtccgttccgctctcccccggcatcgttgcctgttttggcggaacttctcctagcctctcgcatggattatctcttttcaagagaacgttcacattgtggtcaaacgttttctcaacagaggaggattccagttcggatttcggtcgggatgaattgaggatgacgcccggatttgcggtcggatatgaaaaaagcttccttccggaagctttcgaatggagcggacaacgggactcgaacccgcggtctcaaccttggcaaggttgcgctttccgattctggtgaatcggacgtgagggatacgaatccgaatgtttgtgcgtccgtttctggtgaatcggacgcacaaggtgccaaaaccggtgttcaattgtccgtttctgcagaatcggacacgcgagatgggacggacattccgcaaagcgtgccccgacatatcgtgcaggatgtggctggctacgacagtcatatgagacgttttacgtggcttattgcgattggtgtggccgcaatcatcctcggcgtcgcggttggcatgttgttttcgccggaggggtctgtcttggggccgtcgccggtgaacgacgtgctggtcacggtatgcacgttggttggcgcgattgtcggtctcgctttgctgataccggccggaatcatgcatggcgatttccgccgtcgccacccgtatgtgcaggatttttacacagatgaggacaagtcacgtgcgtcggtcgtattggcgattggtgttgcgattggtgccgtgctgattttggcgggcgtgtgcgtgcgagtgttttgtgacgagtttgttgccgacggagacgcggggtggccggacagcgttctgctggcttgcgtggccgcggcggtgttctgtttcattatgtctgggatgacgcatgacaaggtgaatgtggacaaatacaatcgtgaagccgaagaggaaagcgcgcgcgagggacgttccgtgccgcacccgacgatgagcgagtcggacagattttacagaagacttaccagtgcaatttgtggcgtgatcatgttgttagcgactgttatcgcgttgcttatgctttttcttggaacggcgggcagtgatgttgacgcgtggatgaaggtgttctgggtcccgtggccgatcggcggtgtgctgtgtggcgtcgtgggcatcatcgtgccattggttaaggaggccaggcggcggtaaaccaacaaatagtgtccgtttctgcagaatcggacatgcggggtgggcggcaggtaggctggaatccgtgaatacggatcagaaacttcccgccgaatccgcaggcgaacgccccagtacccccctatttggtcatgccatatcacacgcggcgacactcatcggcctgttcgcaatcgtcctgtggggcttcatggccggcctcgtgcgactcgtttccgaatcgttcggcgccacgctcggctcggcgctcatctacactgtcggcggcatgctcctgctcatcgtgcgacggccgaaaccgattagccaagcgccacgcaagtacctcgtcgcaggcggactcatgttcattgcatacgagacgtcgatctcgctgtcgatcggtctggccacaacgaacgcgcaatctgtggaagtcagcctcgtcaattatttgtggccgacgctgctggtactgatgaccgccgccgtgtcgcacaaacgcggctcggtctccgaagcgctgccgggtgcaatcgtagccaccgtcggcgtggcaatggcggtcggcggtgaaaaccttgacgtgcaggaagcggttgccaatatcgccagcaatccattgccgtacgcgctcgcgttcgcaggcgcctttatttgggcgatttacgcgaccgtgacgccatcgatgtccgatggttacgatggtacgacgattttcttctgttgcgttgctgttgtgctgtggattatccatttcgtttcgggcgacggtttgccagctgtagcgcctggcatcggcggctatatttcgctgctcgcatgtgccgcgtcgattgctggcggctacgcgtgctgggggtatggcatgctacatggcagtatggaaacgcttgcgatcggttcgtatgcgacgccgctgttctccactgcttccagcacgctcctattgggcgtgacgttgggcatgccattctggatcggtgtcgcgctggtggtggtcggctcgctgatcaacgtgtggtttgcgcgacgccgctgattgtccgattctgcagaatcggacgcttgttggtgtgtgaggaggcgacatgtggggtagtggcggcgcagaggagcgccgggatggcgcagcggtacgtaagggaagtgaccgggcaagacaatgcccttacgcatccacgctagcttaggtttttgccggctggtatttggtgtgtgttgccgttggcggtgatggtgatgcgtcgccaatgacgcgtccatgtgtgccagccgaaaccgatctaaaccggcttaaaccagcccgttcaaatccacctcgtcacatcaccttggtggattccagattgcggctcacccagttgttcaaccggatcaccggcttgcgcaacaccaatcccagcagcagcgaaggaatcaggaacaaggcgagatacaccatgtcaagcaggtactcattgccgtacgatccggccatcgcggcgtgcatggcatcgatggcgtgcgggaacggtaggaacgggtagagcatttggaagaacttcggcagtgtctcgatagggaacgtaccgcccgaaccggcgacctgcatcaccagcagcaccacggccacggccttgccgatatcgccgaacgacacggtcagcgcatacacgatattcgagaacacgagtgcggcaagccaccccacggcaaggaactgcagcgcatgattcgcctgcacgccaaggaaatacatgtcacccaggcaaaccagtgtgccctgcagcaacgcgagcagtgcgaagatcgcgtaccgtccgaaatactcgtggtcgaggcgcagtccccaacgtgaggcgttccccgggccggacgggccggcgacgcgcggcagcgtgtcgcccaagcccagcacatgcgccttctcgcggtccgaaattgtcactttcagcatggcgcacaggatgatcgcacccacccagattgacaggatcgtatagaacggcgccatggccgaaccgtagttcgcgatcgggtacactgagacgcgctgcagtgcgacgggcgcggaaatcagcgtggacagtgtggacgcgttggcggtggccagtgcacgtagttcgtccgattcacccgaatcggacgaactggcgtcgttgtcaccgtcgccaccatcgctgttgccgtcaccggcgttcccgcccgtctccagcttcgtgatcagctccttcaccgtcgctgccgacgagtcgagtttcttcgcgatcgcgccgagcgtggaacggatggatgtcacattcgtccccacatcgcccgtcacatcgtccagatcgtcggcggtgccgctcagctgggtgatcatgctgtcggtttgggagatcagcgtgctgactgtggaggcgagcgcgtcgattttcggcttgacgttcgtggcgtaatcgtcgcgcacattgctgatcgactgcttcgcggaggtgatgcggttcaggatctccttgcgggagcgttccgcggctgcggtatcctgcgtgacctgcgtggaagcgtctttcagctgctgcgcgagcttctgcgaatcgcctttggcggcttccagcagcgtgatctcccggtcgatggcttccagcagcgcctgtttcgcggaatcactgtccggtagttgttccaccgattcgtgcatgtggttgaggcttgtgatgtacgtgtcgtacagcgattcgctgctggagacttgttcgctcaacgttgtcaactggctggctgcggtgtctgagtccttgccgatcgcgtcgaacgccttgttcaccttggcagctacttggtcgaacgcgcctgacacctggtcgagcgcggtgttcactgaggaggtgacgttcgcacctgccgaagtgaacgacgtggcacctgatttgccttgcttcaacgcgttctgggcctgtttgcccgccttggtcgccgaggcgagcagtttgcccgtggaatccacgatgtcgttcgccgagccgagcagctgcgaatacgacgttacctgctgcgatgcgccgctcaacgtatccgccatggtggtgagattgccgttgaggttgcgcatgtattcggccatttgcgggctttgcgaatagtgtaggatgcttgaggccaggtcgagtccgacttgcgcgatcgttttggcgaaggttttgtcgattgtgttgaccacggttgtcgcgccctgatcggtgatatgcggggcgatcgggttgattttctcgttcagatagtacttgagctgcgcgtgtttgatgtcgggggagaacagcgtcatcatgtcggcgctgaaacctttcggaattacgatcgccgcatagtattcgccggatttcaccccgtcgattgccttgtcgcttttcacgaactgccagtccagctggtcgttggcgtgcagtgtgctgatgatggtttcgcccacgttgacgcgcaccggtatgagatccgacttgtaacccttgtcgttattggccacggcgaccttcaatgccttggtgttgccgtaggggttccagctggccgcgatgttgaaccaggcgtacagcgccggtaccaccaccaggcccatcgagacgatcacggcgatcacgttgcgggtggcgtggcacatgtcccgcttgaagatgccccagatcattttcactgttcgttcccctcctcacgcagactcctgccagcatttccgtccgtgtttccagccgcatactcagccgcatgttcaggcgcatgtccggccgaaccaccatgcgcagcctcatacagcctcgtgcgtacggcatgcatcggcttgtaatgcatgcccggccggaatagcaggttctcgtgcaggatcgcgctgcggaactcttccgcactcatcgcttcctcgcccagataattcgcataccgttcgcgcagatactccaccacgatgagatacgtgtcgatggcgatgatcgaaatgatccaaccgagcagcatggcgagcttcatgcgcgtgatgaatagcaacagcaggaacacgaacggcagtaccgccagcgcgaggaatccccagcgcaccaggcgcgggtacaggcggaagaaatgaatcgcccgtctgcgggcgagttcggggaactcctcggcgatctgctgcgcggtctcggtgagccgcaacggttccaccgtgccttcgttatgttcggtgatcatcagatcagtgtccgccagacggttgtcgaacaggcggttgaggttcaacgccagcttgcggacgaccaagccgatgaacagcgccacaggcagataccagaacagcgagagcatgtcgatccaataatggttggcatacatgccgccgatcggcccgcgcatcgcgttgatgccgtaggtgaacggtaggaacggtttcagacggcggaagaattccggcatcatctcgatggggtagaggcctgccgcgcccggaatctggataatcaccagaatcacggcgacggccttgccgatatgccggaacgccacggcgagcgcgtaaatgatgttcacgtagacgaacgaggcgaaaatgccggcgaggatgaacaggaacggatgctcgcattggatgcccagcgcgagatcgccgatcgtggcgatgatcgcctgcaggaatccgaccgtgacgaacagcagccaacggcccatatagccttggcgtggcgtgtacatgcggatcttctcatcgcggtccacttcaagcttgtagatcgcgacgagcacgaatccgccgacccatagcgcaagattcgtgtagaacggcgtgaccgcggaaccatagtttttgaccgggtagaggacctgttcgtccaaatgcaccggctcgcccacgaacgagccgacctcgctcgcgtcaagtccgagcgcttgggaaagctgctggaacatcgccgaactgctcaacgcggccacatcggtgcgcgtggtgttgagctgtttggcgagattggcgagctgcgtctgcgtgccagcaatggtggtgttcgtttgggtcacggtgcgcgacaactggtcgagcagcccgttgccctgttccagtgtgctttgcagcgtggtaagcgtgccggacagcgacccattggccaggctgagtgtatcgagcccggtgttgagattcggcatgaccgtgccggtgatggtcgtgcgtgcgctcgccatcgacgccgtgccgtttttcgccagcgtggtgacatcgtcgttgaacccgttcgcggtgttcttccccgcgttgatcgcagccgtggtgtcctgatcgaaggcgtcgatgcgctgctgctggaacgtcagctgtttgcgggcttcggcgagttgcgcggaaagatccttatacgtttggttgttcggatccagctggctggcctgcaacgccttctccacgccgtcgagcacattgccggtggtggtgttgacgtgatgcatggtgctggacacttggtcgagcgcgtcctgcgtggtgttcagtccgctgagcacggtgccggtggcattgctcacgttgacctgcagaccggacagttgcgtgctgccgttgtcgagcgctccgaccagcgtgttcgagaatcgttcggtttgtgtgcgcgtctcgctcagcaagtcggacgccttgccgacggtgtcaagcgagttggtgattcccgaggcgagcgcgatgttggactgtttggccgaatcgatggtggtgagggctttgtcgagcgtggaacgcgtgccgcgcagctgctgttggacggtttcgagctggttgatggtgtcggtcagatcgttgatgacgtcgctttgcgcgcttttcatgctgccggtggtttctcccgctgcctccttcacttccttcgccacggcgtcggccacgctggaaacgaaagtggtgttgatctgctcgtcgatcgtggtcgcacccgtatcggtgattttcggcgcgatcgcgttcagcttttcgttgatgtagtacgtgatcgacggtcggtcgcctttaccagtgacggtgccgatgagtctggagctgaagtcttccggcagtacgatcgccgcatagtatttgccggattccacgccttcgatggcttgctgctcgggaacgaaacgccagccgagctgatggttcttcttaagctggttgacggtttgctggccagcgtcgagatgaccgaccagcgtggaggttgtgcccttgtcctcgttcgccacagcgacctggatgttgcccgtgttcgcgtacgggtcccagttggcgaggatgttgcaccatgcgtacagtgatgggatgatggccacacccagcgtgacgacgagcgccactgggttcttcagaatgcgtttcacgtctcgaaggaagatggcgaaaacctggtgcatcaagcctcctcgcgggtattggtcgcaacatctacgtgcggcggcatgcccgtgcgggaatacccggttgggctcttcgtcgcgcgatccggtggatattctatgacttccgatggaacgatcgcaatggtttcgccctgtttaatggtcggtcccgcaaatgtcgggatatgagacgaaaacgctcggcatatggccctagtggggcgggcgacctggatatggagcggacggtcgggaaaacggaaaggaaagatggcgaatgttgtcacatgacaagtgggatagggtcgggcgataatggaggcatgactattgcaacgccggaacgttatgcgcaaatgctggacgccgcacgccgcggcggttacgcctatcccgcgatcaatgtgaccagcacacagaccctgaacgccgcactccagggtttcgccgaggcggaatccgatggcatcatccaggtctccgtaggcggcgccgcctacttctccgggcaacgcgtcaacgaccgcgtcaccggctcgcttgccttcgcagccttcgcgcacgaagtcgcggcgaaataccccaacatcaccatcgccctgcacaccgaccactgcgccaaacagtatctggacgaatgggtgcgccccctgctcgaccatgaagccgaacaggtgaagcacggtcaggaaccgaccttccagtcacacatgtgggacggttccacagtgccgctgggtgaaaacctcgacatcgcagaagaactgctcgacaaatcccaagccgcgcacaccgtgctggaaatcgaaatcggcgcggtcggcggcgaagaagacgggcacagcgccgaaatcaacgacaaactgtattccacgcccgcgcaaggcatcgccgtcgcgcaacgactcggccttggcgagcgcggacactacatggccgccttcaccttcggcaacgtgcacggcgcatacaaaccgggcgtggtgaaactgcgccccgaactgctcgacgaaatccagaccacggtcgcgctcgcgattaaggccggcgaaatgcccgaccccgcgcactcgctggatgtcgctcccggtaagccgttcgccctggtgttccacggtggttccggctccgcgccggaggagatcgcgcaggccgtgagctacggcgtggtgaagatgaacatcgacaccgatacgcagtacgcattcagccgtgcggtggccggtcacatgttctccaactatgattcggtgctcaaaatcgatggcgaggtgggcaacaagaagatgtacgacccgcgttcgtgggggcgcgaagcggaaagcgccatggccgcacgcgtggtggaggcttgcaggcagcttggcagcgcgggcaaggcgttgaagtagtgtgatgccgcacgcgccgcgtaatgcatgcggcgtgtggcggcacggtgggtgtgtcgcgttgtatgagacgaaaacgatggaactgactagtttcaacggccgatcggtgcatatccggcagatatccggtagagggcgcaggatagtctttgtaaggccttggtaaggctttgaggcgaaatcgcatacgcgcggaggtgcaacaacatgcctggaattgttttgatcggtgcccagtggggagacgaaggcaagggtaaggcgaccgacctgatcggcacgaaggtcgactatgttgcccgcttcaacggcggcaacaatgcgggccataccgtggtggtcggcgacgaatcgtatgcgctgcacctgctgccctccggcatcatcagcccgaccgcgactccggttatcggcaacggtgttgttgttgatcctgaagtgcttttcgaagagatcgacggcttggaaagccgcggtgtggactgctcccgactgctggtgagtgagggtgcgcacattattgcgccgtatcatcgtgtgcttgataaggtgacggaacgtttccttggtaagcacaagatcggtaccaccggtcgcggcattggacctgcgtatgccgacaagattaatcgcgtgggcatccgcgtgcacgacctgttcaatgcgaagcatttgcacgacaaggttgaagcaagcctgcatcagaagaaccagatgctggtgaagctgtacaatcgtcgtccgattgatgtgaacgaaaccacggatgagctgctcaagctcggcgaacgtttgaagccgtacgtggccaacacctcgctggtgctcaataaggcacttgacgaaggcaagaccgtgctgttcgaaggcggccaggccactatgctcgacgtggatcacggcacatatccgtttgtcacgtcctccaacccgactgccggcggcgcatgcaccggtaccggtgtcggcccgaccaagatcacccgcgtgatcggcgtttccaaagcgtacgtgacccgcgtgggcgaaggaccgttcccgaccgagctgttcggcgaggaaggcgaatggctgcgagcccagggccacgagtacggcgtgaccaccggccgtccgcgtcgttgtggctggttcgatgcggtcgtcaatcgttatgcggctcaggtcaacggcctgaccgacatcgtgctcaccaagctcgacgtgcttaccggcctgaaggaaatcccattgtgcgtggcctatgatgtcaacggcgaacgccgcgacgatatgcctactgatcagtccgaattcgcggcagcgaagccgatctacgaatccatgccgggttgggacgaggatatttcccaaatccacgacttcaatgatctgccgaagacctgtcaggattacgtcaagcgtcttgaggaactgtccggctgccgtatctccgtgatcggcaccggcccgcagcgcgaccatatcatccagatcaattcgctggtcgactgaccgtcggcaacgagtttcccggcttgactggcaacgacgcggcacatgatatccgccggctgattccgcgattcgaccacttgaagtggaagatggcggcggccggcatagtcattggtctggtttcaggattgctggtcgtcgtataccgtctcggcatcgaatacggcacggatgcgtcccgctggatatatgcgcggattcgcgagaccccgtggctgattgcgccgtgggcggttgccgcggtggcggccgcgctggcgatcgcgtggatggtcggcaaggagccgatggccggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggagcgcagtgtgtgtcccaccgtttgcgcggccaccgccgtgaggacatgcaggagcattatctggtcaccgccggtgccgcggcaggcttgtccgccgcgttcagcgcgccgctgtccggcatgatgttcgctttggaaggggtgcatcggagtttttcccctgcgattctgatgggtgccactgccgcatcgctgaccgccgatttcgtctcgaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgacgtgctcggcggcggctcgaatctgattgataccgtcgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgatttggtgatctgccatccgacgcagtggcggtgtttgcggtgtgcgtgatgacgggcacgctcgccgcgtccgtgaaaacgccgatcacgtcgattctgttggctgtggagatgtccggaacgttgacgcacatgctgccggtcgctgccgtcgctttcatcgcgctgttggtgtccgatctgctgcgcaccaaaccgatctatggggagttgctggagcggtacgtgcgtgcgcaaggcatgcagatggcaatcgcaagccatgtgggcagcggcattatggaactgccattggaaatgggggcgattgcggacggcaagcgggtgcgtgacgtgcgttggccgtctgggtgtctgatcatcggcctgcgtcgcggcgaaagcgagatcgtgccgcgcggtgatacacggctgcgtgccggtgactatctggtggtgctgttcagtggcgaggaggagcgcgaggtacgacctgcgatgcggcggctgtgtgatgcccggcttgactgagcctggctgaattcggctggactctggatgtccgaatctgcggaatcggacatccagggtgcatacgttggcgctccgtgtaaactcatatgcgttaggaaggcggcaaccgcggcccagctcgttgttgcacggcctatgagcggaacaacgctgtccgcggaaggccagtacagggggagcgcaatggaatcgcaagaacaatcgccgggagacgtggtgactgcgggtgaggactcgcatcccatcacgcaggcaatcgacactgttgaggtgacgcatgctggtgcaaccacgccctccgctaacaccatggatccgcctacgattcccctggcaccgatgaaacgtatgcaggcgcggttcaatccgctcgccgacggactgatgtatgttgtggtgttcgtcggtggatttgttggagtcggctgtcggcatgcgttggatatgcttctgccgtcggtcagcgggacgccgttcgttgtgggcacgtttgtgtcgaatatggtcgcctgcttcctgttcgcgatgctgaccgaattcatggcgaccgcttcgtggctgcgtcgccgggtgcggcaggttgtcagccgtggtgttgggcttggcttgctcggtgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcagggtgcgttttcagctgtttccgtgtccgattctgccgaatcggacacgcagggcgtacgccatgtgaaagtggccgacgtggcgcgttctgccgcgcaggccgcaatggaagccgcgcaggcggcgcagcaggccgcgcaggcggcccagcagattgcacagacgggacaggctccgcgagtcgaaacaccaaccgtgccgccgaccgccagccagactatgcagacgggccgcgttccgcagattcctccgctggccgttcctcagctggcacagccatcgcagccgttgctgcgcgagcaggatacttcagacttggggcagctgcccgagccgattcagcagtcgcaaccaatccagcagccggctaacccgcttccgcccagcttcgagcccaaaccgatcactgcggagatttcgcttatcgccgacccggctaccggggaggtgcgctgatgatgtggatgatctgtctgttcggcggtctgggcgccatggcccgttacgtgctcgacgtgtcaattcaacgaggctggaatcgcgagaatcggagaacgaaccacaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgcgtggccaccggtttcggcattgcgctgctcgccaatccggcgtaattttcacgttacacggacggtcgctgagtaacatgaaagaaatctgagcgcaaccgccatcaaggccgccagcccggatgcgacgctggtgattgcattcgaccagaccaagccgctgctgaaggatggcaaggatatccagtaccagggccagaccggtatcggaccgttcaataagaacaatgatccgagctccgcgaacatcggcgtctacaccttcgacaaagacaacaagccggtcttcgaccacacccagtccggcgacgtgccgaccgactgatcgcaatgtaggtcatcatcaatacaagaagacggcgcaaagtgagtgtggatatcgcaagctttgcgccgtttcttttgttgtgctgtgctgccgttttccgtgtcgtgggcagcatacgaaaatcaatattgaaaatcaagtaaaggggtaaccccgttaagcgatatacacgccggactgtcgaacaggttcgagagaatgtaaatgaatgtaatatctcgcgagaagcgcacggaaagcgcgcggcaagcacgtgagaatacaacgatggaacagtgataacggggaaggtgcgatcatggtcggcatgcgcgatgtggcgaagaaggccggggtgtctctgagcaccgtctcactggtggtgaacggcaacgggtatgtatccaacgacatgcgcgaccgcgtgcgtaaggccatgcaagccctcaattacgtgccgaacgagcttgcccgcaacctgtaccacgatcgcacgaatctggtcggcgtcatcgtgcccaccattcgtcacccgttctttgcaacgtttaccgcgcacctgcagcatgcgctcgccgcgcaggggctgcgcaccatgctgtgctccaccaccgacgagacggacggcgaaatccaatacgtcgatatgctgcgcaggcacatgatggacggcatcgtcatgtgcgctcacacctcgcatcccggcgattattggacgtccatccaccgcccgatcgtcgcattcgatcgcgtgcttggaaatggtatttcgtcgatcggatctgaccacgagcagggtgggcgactgattgcgcagatgctgattcgcaatggcgcgcgccatgtggtgatgattggcggtccgcgcgatcagttcttcgatctggcggtccgcggcgaagtcgaggaggggtcgttcgatttgggaaagaccacgttcccgacggtgcgctactacctcacgttggaacaggaattgacctccgcgggcgtgaagtatgagtatatcgaggccggtgaggtgatggatttcgccggctatcatcgtgcggtcagccgtgcgcttgatggggtggcgaccgacggcgtcgatgccgtggtcagctccgatattggcgcggcgttctgcgtgcgtgaggcgttgagccgcggaatttccattcccgacgagctgcaggtcgtcgcctatgatggtacgtatttgaccgatttggccggtatgaagctgaccgcggtcgcacaggatttctcggcgatcgcgcagtcggcggccgaccatatggtgcaggcgatcgccaatgaagaggcggctgcggccaacgcctcgcgcaagaacatccccaagccgttcgagccgaacgtgcttattcccatgacgctggtgccaggcgataccacgcgttgatgctgcgcgttggaacgctgggttggggtcggacaggctgggctgcatagaacaccgcatcaaaccggttcgacacgcgcattccgctgtgtgactggacatcgacgcccctctcgaggtaatatcgaaccggttcgatacatacgtgagtatgcaaatacgtaaacaacaaacaggcagacgcgcacacattgcacccgcacccatgaaccaagggaggtcccatgaaaaacaaagtgcagctcatcacctacgccgatcgcctcggcgacggcaccctcagctcgatgaccgacatcctgcgcacccgtttcgacggcgtgtatgacggcgtgcatatcctgccgttcttcactccattcgacggcgcggatgcaggcttcgaccccatcgaccacaccaaggtcgacccgcgcctcggcggctgggacgatgtcgccgaactttccaagacccacggcatcatggtcgacgccatcgtcaaccacatgagctgggaatccaagcagttccaagacgtgcttgaaaagggcgaggaatccgagtattacccgatgttcctgaccatgagttccgtctttccgaacggcgcgaccgaagaggatctggccggcatctaccgtccgcgcccgggtctgccgttcacccactacaagttcgcgggcaagactcgcctggtctgggtcagcttcaccccgcagcaggtcgatatcgacacggattccgacaaaggctgggaatacctgatgtcgattttcgaccagatggccgcatcccacgtcagctacattcgtcttgacgccgtcggctacggtgccaaggaagccggtaccagctgcttcatgacgtcgaaaacgttcaagctcatctcccgcctgcgcgaggagggcgtcaagcgcggcttggaaatcctcatcgaagtgcattcctactacaagaagcaggtcgagatcgcgtcgaaggtcgatcgcgtctacgatttcgcccttccgccgctgctgctgcattcgctgaataccggtcatgtcgagccggtcgcgcattggaccgacatccgtccgaacaatgccgtcaccgtacttgacacgcatgatggcatcggcgtgatcgacatcggttccgatcagctggaccgttcgctcaaggggctcgtgccggatgaggatgtcgacaatctcgtcaacgccattcatgcgaacactcacggcgaatcgcaggccgctaccggtgccgccgcatccaatcttgacctgtatcaggtcaacagcacctactattcggcgctgggatgcaacgatcagcactatattgcggctcgcgcggtgcagttcttcctgccgggcgttccgcaggtctactatgtcggcgcgcttgccggcaagaatgacatggagctgctgcgcaagaccaacaatggccgcgatatcaatcgccattactattccacggctgagatcgacgagaatctgcagcgtccggtggtgaaggcactgaacgcgcttgccaagttccgcaacgagcttgatgcgttcgatggcaccttctcgtacagcgccgacggcgatacgtccatcagcttcacgtgggagggcacgaccactcaggccacgctcacgtttgagccgggccgtggtcttggtgtggagaacaccgcgtccgtcgccacgctcgaatggcgtgatgccgccggtgagcaccgcacggacgatctgatcgccaatccgccggtcgtggcctgattcagcctcgcctgatccggtcgctgcctgaccgcgcataaatccataaatctgtaatcgtccttcctgtcacctctccttcaggaaggacgattcgcattttcgttttttcgagaaatcgtcttatcgggaaaacaattttcccgggaatcagctgaaatcccagcaaaaacgggtaaggtgagcttatgtcaaagatgtcaaagcttttcgatcaagacaacatgtttttcgccattatgggcgtgctgttcgatctgattattctcaacgtgctcacgctgttgtgctgcctgccggtcgtcacggccggcgcatcgttcactgcgatgcacagtgtgctctggcgcatggtccgccatgaggaaacgtatgtggcgcgccagtttttcgactcgttcaagcgcaatctcaagcagtcgctgctgccgtggcttgcgttcctgctggcggcgattgtgctggtggtcgacggcatgctcgcccggtccatggggtcgatgcgcgggccgctgatggcgtgcgtcgcgttcatgggattggtgattattgcgattgcgcagtacttcttcccgctgctttctcgctatgagaatccgacttccgaaacgttgaagaatgcgacgaaacttgcgctcggctttttcccgcgcaccttgtgcatgctggtgattttggccgcgttcgccgtgctgtatgcgcagtttttcatatatatgattccgctgctgattttgatgggcgtcacgttgccgcaatactgttgcgcgtggatctacaactggattttccgccgtatcgacggtgagatcgacgccaaggggcgcaaggtagcgcagtcctgaaattgtttgctcgtaaaggccgttccgcagattgcaagttccgcggaacggcctttacgcgttttcgtcgccttgagtgtccgattctggagaatcggacaactggaacgtacttttgggcgcgtgaatgtccgtttctcccgaatcggacaactacaggtcaaagtggggtgcttgaatgaccgattctggagaatcggacaaccgtgggtctgttttggtgttccggttatccgtttctggtgaatcggacaaccggaacatgttttgaggcgcttggatgtccgattctccagaatcggacacgctgggggcaggattagcaggggaggatggtggcgctgcgggctgggacgtgcagttgggtgccgtcgaagcgtgcggggttgccgatgctcagcagtactgttttctccgctggttcttgcgatatttcctgcgctaagccgccagacagcagtttcacatagtcgctcggcagtgtgcagcttgcgtcggtgtttgacggattgatggcgacgacgatgcgctcgccacctgcttcgcgattaatcttgctgcatgtttcacaaggtgtttcacagctggtttcgtgtgctgttccgctgcgttcgccgtcagttgcgtcgcgttcggcttcgccggcctcggagcttctcgcgtacaccagcggatacgcgtgatcttccgcgtagaggaactcgatgcctccgtcggcctgcagtgcgggatgtgccaggcgtagcgtgttcagtgcgcgtacggtttccagtagcgagtcgctgcgtccggtctgcgaagccacgttcgggcgctcgctgtcggcatcgatcggcagatacagatcatcgggccgggctgcggagaatcctgcgttggttgcgcagctccattgcattggtgtgcgcgatccggtgcgctcgtatccgccttccttggatttgagcccgtgcatgtagcgcatgccgatttcgtcgccgtagtagatgaacgggcagccgggcatggtcagcagaaatgtgaacgcgagcttcatttcatcggtggtcaaggtgtcgcgcatgcggatcatgtcgtgattgcccgacggaatgcagatgtatccaggcgttccggcggtgctggcaagcatggccgtatatgtgtccgcaaacgccttgatgtcgccgctcgcattgccgacattgtcgttattgcaatttggattgtctccgtcgacgactgaattgccgttgctgtcgcacccgctgctgcccgcgccgtcgcattcgctgcgttcgccgtcgtgttccgtttcggcagtttcggcgctgcccgtagcttcggaagatccggccgaaaaatacggattctcgcggaacaggtcaagataatgcgacggcccgaaatgcagcaggaagtccatgtcgaatccggcgtgcagcgcctcttcggggtcaccccattccgatacgagcaccgcttccgggtaggtttcgtccagatgcgctcgcacttgctgccacaagagtttcgtccaatagtggtcggggtcttccttgacgaggctgcctgccatgtccacgcggaagccgtccgctcccaacccgagccagaagtccatgatgtcttggatgagcagccggccctgcaccgcttcgggggagtcggcggcgaactgccagtcttcggtgacggtgccgaatccgtagttgaggcatgcctgcgtggagaagcagttcacggccgccgcgtcgggacgttccgcaatgcctccgaggaatccgcggattgattcgtatggcgagttcagattcggcgattgcgtcatcggtcgccagatgtagcggtcggtccatgcgttgcgttcgtccttgccggattcaagaaaccatggattgtcgaccgcggaatgcccgggtacgaggtcgagcagtacgtgcatgcctagttcgtgcgcgcgctcgaagagccgctgcaggtccgcgttgctgccgtagcgttccgcggctgtgtagtagtcgcgtacgtcgtagccggcatcgtagaacgacgagtcgaagcatgggttgatccagatcgcattgcaccccagatcgtgcacgtattgcagtttgtcgatgatgccttggaagtcaccgatgccgtcgccgttcgagtcgttgaatgattgcggatagatttcataaaagattgcgttgttgagccagcttgccataaatcctcctgttttcgcatctttgctgttggtctaccgatgtatcgcaacgttggaaacgtcggtcactgcttttccgtcattatagcccgtgaagacactttttaggggtgtatggaatgccaatgtttgcaatacgtcaatcgattgacgcgacacgccgacggatggcactgtgcacaaggtttctcgaaccggtttgacacctctcgaaccggtttgatatcctgtataccaaggacggagagattccgacaacgcgagtcggggattcaccttcctttatcacctcattgggcagggctgctcggtgaatagtggatagaaagggattggaaaatgagcaagttctcttcttggaagaaggctggcaccgctattgttgcaacgctgatgaccgttggcatgctgggagcatgcggatcgtcgtccagctccagcggcaccaagatcaccatcttcaactccaaggttgaaatcgaaagccaaatggaagacatggctgcgaagtactccaaggaaaagggtgtggacgttgaggtctactactccaacgacaccgtcgcagcgcatctcgccaccaagtacgcatccaaggatccgtacaccatctccatggtcgacgccaaggacatctactccttggctgaagagcacgccgtcgatctgtccgaccaggattgggtcaaagacaccgactacgccatcagcattaacggcaagacctacggcttcccggtctccatcgaagcccgtggcctgatctacaatgctgacgccatcaagcaggtcaccggtaaggaattcaagcctgagaactacaagacccttgacgagttcaaggatctcatcgacgagctcaaggccggcggcatggaatccccgaccggtgtcatgaaggaagactggtccctcgccgcgcacttcctgccagaagtctacgaggagcaggaagatccggacgccttctgccatgagctcaaggacggcaaggttgacctcagctccaacgccaagtggaactccctgatggacttcttcgacgtgatgaaagacaacaactacgccaagtcctccgccatctccgccgagcgtgaggtgaccgagcagaagctggctgaaggtgaaatcgccttcatgttcggcggcaactgggattggtccgtgctgaaccagtacgactacaccgagaacatgggtctcatgccggttccgcagaataccgatgacggctccaacgagaagctcgtcggcggcggctccaagtacttcttcatcgactcctccgacaacacctccgacgaacagcgccaggccgccaaggacttcctgaactggctcgccgaagataaggcaggccaggagttcatctccactgatgctgctctgatctccccattcaagaacaacgagatcgaagcatccgatccgctgggcaagtccgtgaagtcctacgctgacgccagcaagctgatcgacaactacaactacctgcctgacgaccacttctctgtgctcggcgccgccttccagaagtggctcgcaggtgaagaggaccgtgcaggcctcgctcaggacatccaggactactggaagaccgctaagttcaccggcgcaaccgcctgaacttccaaataatgcaccatgatgcagggtccgccgcttccttcctgcggcggaccttacatccccggcacgtatgggatccatcatgaaacagaataagctttcctataaaatcggccagtttctgatgttcggtggtccggcgacgattcttttcttcgccgtggtgatcctgccgttcttctatggcctctatctgacacttaccagctgggacggcgtttcgacaacgaagccgttcgtcggtctcgaaaactacaaggcggctcttgccgacaccgcatattggcagtcgcttggacgcaccttcatctactccgtcatcgccgtcatcctcaccaacatcgtcgcctttctgctggcctacctcgtgaccagcggcatcaagggccagaacttcttccgtgcgggcttcttcattccgaacctcatcggcggcatcgttctgggctacgtgtggaagttcgtcttcaaccgcgcattcgtggccatcgccgaagtggcgacgcaaacagaccacgcatcgctgctctccacgccaaacggcgcaatgttctgcttgatcctcgtttcggtctggcagtacgcaggctacatgatgctgatttacgtggcaggcttcatgagcgttgaccagagcctgaaggaagcggccatgatcgatggctgcaacaagggcaaggccatgtggcacgtggtcatcccgctgatgcgctcctccttcgtgcagtgcatcttcctgagcaccacccgttgcttcatggtgtacgacctgaacctttcgcttaccaagggcgaaccgttcaaccagtcggtgctcgcggcaatgcacgtctacaaccaggcattcgtttacaagaactatggcaccggtcaggcggaggcgttggtcctcttcatcgtctgcgcagtgatcggcatgctgcaggtgtacttcggcaagaagggtgaggtggcagcataatgaagggtcaaaccagcactcgcaccaaggttctgcatgcactgatgatcgtcgttctgacgattctgctgctgctgttcatcgcaccgttcattctggtcgtgatcaacgtcttcaagaccaaggcggacatcaacaccgctccgctggcactgatcggcaagcacgggttcaccctggagaacttccccagggcaatggacaagatgaacttcgtcaccgtgttcggcaactccgcggtcatcaccatcagcgcaaccatactgaccatcctgttctccgcgatgtgcgcatacgtgatcgtgcgcaacccctcgtggaagttcggcggcatggtgttcgcacttatggtggcctccatggtcattccgttccaggtgctcatggtcccgctcgtgtccgtctacggcggcctgcttgacgtgttgaacagtcgtatcacgctgatcctcatgcacaccggcttctcggtctccctggcggtgttcatgttccacggtgcgatcaagacgaacattccgaacgaacttgaggaagcggccagcatcgacggctgttccaagtggcgcaccttctggacgatcgtgttcccgctgctcaagccgaccgtcgctaccgtcgccatcatcgacgccatggcgttctggaacgactacctgctgccgtccctggtgctgggccgtcgcgaactgtacaccatcccgatcgcaacccagatcttctacggcacctactccaacgatatcggcctgatcatggcggccctgctgctggccatgctgccgatcctcatcctgtacctgttcctgcagcgctacatcgtcgaaggcgtgacctccggcgcagtcaagggctgatcgaacggtacggaatccgcaatcataactgaacagactcacacaaccggtccggatgcgaagcgataatcgcatccgggcttttcttatgcgatatcgattcttatgcgatatcgatattgagattgccatcgcatgtttctgctgtctgacaggacgtattgatatgattgatttcgccgaaagaatcgctcgaatgcactggtgcagtgtgtccgggcgattttcatatgtgctgaatatcgtgtgacatttcgaaacgagcaacgaaatagaagcaagaacgagaagcgacgatacaaaacaggaaaaacaggaatagaaataagagatgactgaagacaatcaacataatgcaggtgagcagcagactccaatgcagccgcagccgctgccgggccaggtgttcgtgcgccccggtatcgatgaccgtcccgattacgaaaaaacgctgaccgaagagaccaaagcggccctgaagcgcttggccgtacagcagaatccgcgcgtgcccgaggcttccaacgagcgtccggaagtgcagcagaccctcatcaacacggaaggcggctccccgctgaccgcgttcgcccatctcgacgccgctgtgccgaacctcgaatcgtcgttccttgacctgcgcgatccgatgaccgcgcccgacggcaccacgcccaccaaaccgcaggtgcatcgtctcaccgccggcttcgcgcttggtgcgctgctgttcaccgcgccgatggccgcgctcaactctgtgctcattccgcagaccatcagccgtctttccggcaccgaccgcgtcaccgatctggcgctgctcagcgtcgtcggcacgttgttgacgttcctgatgaacgcgtggatttccgtcggatccgaccattcgtactgcccgctgggccgccgcaccccgtggatcatcgccggcacggtgctgaccgccacgtcggtggcgattctttccgcatgcgatttcatgccgttggtcatcgtgttctggctgtttacgctgatcggacatgcgatggtatcgatgccgctggcggccgctttcggtgagcgcgtgcctgacaagttccgtgatcgtgcggacgcgtggcgtggcgttggccaagcgttcggccaggtgttgggcattatcgcggccgtttcgattacgtgggctgccgacgattccggttgggatggcaccacgcgtttcgccatgatggtgtttgcgttgtgcctggtggtggctggtgtggctacgttgctggtgttgccgtttgagggttccagcagctatttgcctcgtgagggtgtgaagaagggcgattatttttcgcagtatcgtccgccgaagggcgctccgaagttcttcattgcgtttgccgcgcgcatgtttgccatcgcagccacttccggcattgcgatttaccagtggtatcttgcgcaggatggtttgggtgatgtttcgcaggtcaccatgtttggtttgtccggagcggctgcggttatgtcgatgatggccgttgccgcgttcgtcggctcgctgttggctgcgctgctgcttggccgcatcgcccgcgctttcaaagattcccgtattcccgcgattgccgcctgcttgttatttgtggttgctgtggtgcttccgttgacgccgatcgatagtgctatggcggtcgcgctgtatgcgctgtttgcaggtttcgcgtatgtggtgtatgacggcgtgagccaagggttgaatcttgcgacgttgccggatgtgcgttccgttggtcgttcgttggctgcgttcagtttggcgaatacgttcggttcgttgattggcgctgtcgtttgcgcgattgcgattgcggtgactggcgagtatctgctgattttcgctgttgccgccggttgcatggctgttgcgggcgtgctgacgttgctgctgaaatgatttggatgacctgagataatccgaaaaacgaatatcaaattcaaaattgcgcgtccacatagtgaacctttagtagaaagggtctgtggacgcgcttatctttacggcttagttcgagcggataatccgccgaatacaagactttgcgaaaggaggttcgccacgatgaacggaatggttgcacgcgtactgctgtccgcacgaattattattccgctttcgttggcggactgattcgagcaatgcagcttcaatccctcgccaacggaggcagggtttgaggcgcgcaaaacacacacgttgatggccctgcatgctgcggggtctttttgttgccgcccacaaggcgtaaggcaacgaaatgaagactgcacacaagagaatagaagaaagacgttatcggcgcatgttgggagccggcaacgcatgacagacgtaacaggagtaatccaatgagtgcagtcgaagcagccgctggcaaagcgcaggcaatggtgcgcgattcggtgaaaaccgttatcgccgcttccatggtcggcaccgccattgagttctacgacttctacgcatacggcaccgccgctgcgaactatttcccgaaggtgttcttcggagacaccaccaatccgactgtcgcactgctggccagcctgctgaccttcgccatcgcgttcatcgcacgcccgctcggatccttggtgttcggccatttcggcgaccgcatgggccgcaagaccacgctggtggtttcgctgttgaccatgggcatcgccacgttcctgatcggctgcctgccgacttacagccagtggggcattgtggctgtcgccgcgctgtgcctgtgccgtttcgtgcagggcatcggtctgggcggcgaatggtcgggtgccgctttggtggccaccgagaacgctccggaagacaagcgcgcgctgtatggctccttcccggaattgggcgctccgatcggtttcttcctgtcgaacggtacctacttcctgttggaaacgttcaacgatgacgatgcgatgctggcatggggctggcgtgtgccgttcctgctgtccgcagtgctggtgatcgtcggcctcgtcgtgcgcgtgcagatggaggagaccccgatcttccgcatggcccaggagcagaagaaggtcgtcaagtccccgttgaccgaagtgttcaagaagagctggaaggaagtcatccaagccacgttcctggtggccgtcacctacacgctgttctacacgctggcaacctggtccctcgcttggggcaccaaaaccgtcgagcagggcggcggagaccttggtttcaccaatcgtgaatacctgctcatgctgatgcttgccatctgcgtgttcgccgcgttcatcgtcatttcctgcgtgaacgccgataaattcggccgcaagcgcgtgatcgtcatctcgtcctgctgcctcgtggcattcgcgctgctcttcccgttcctgcttgatccgtcggtcgtcggccagcgtaacttcgccgccaacctgctgttcctatgcatcggcttcgcgttgatgggcaccgcattcggtccgatcggcgcgttcctgccggagctgttcgacgccaacgtgcgttattccggctccggcatcggctacaacctggccgccatcgtcggcgcggcattcgtgccgaccatcgccacttggctgtcccaccactggggtgtgcactccgtcggtctgtacctcggcgtgatggccgtgtgctgccttgttgcggtgctgagctgcaaggagactaaggatgttgatttcaccaagtgatcaatcgccaagtgccgtttgaccggctattcagcgacgtgtcaagatgacatcgacggaagccttactaaaaacgtttgacgcgaatataaccactatgtgaacgtcagcaaccaatataaagaaagcgggactaaaacagttccgcaggagaggcggggtggttcctcggacacaatccgggggagtaatctcctaggaaccatcgcccgctgtgaacaaccgaaacaagaattaaatatcgcgagtttgttcggggatgcaagtcccgaatcgctataaaaagaaaaataaaggagcgcctattatggcagcaactatctggtacgagaaggatgccgatctgtccgtgttcgatggcaagaaggtggccatcctcggttacggttcccagggtcacgcccacgcgctgaacctgcgcgattccggtgtggatgtcgtcgtcggcctgcgtcctacctctaagtccgtggaatacgccaaggagcagggcctcgaggtcaagcctgttgccgaggccgttgccgaagccgacgttgtgatgatcctgctgcctgaccagtaccaggccgccgtgtacaagaaggacgttgagccgaacctgaagccgggcgctgctctggctttcgctcacggcttcaacatccactacggctacatcaagccgtccgaggatcatccggtgttcatggtcgccccgaagggcccgggccacatcgtcgatgtcgatgggcaggtagccgagctcgtcgatgatgaccagcccggccctgcctatcgacttgagctcggcgtccaatctgttgtcgtccttggccttcctcaaccgcatgaccaggctggaggcggtgaagaacctcacgggtatcatgcgttggcatgcgagcatgccgatcgcgatggcgaggtgggtcttgccgcagccgacgtcgccgtagagcacgaggtcctcggcccggtcgacgaattccaggctttccagctgttcgcggccccagtcggcgggaaacgaggccatgctccagtcgtatccctccagggtcttgctctgggggaacccggcctgtttgagcagccgccgccgtttggattcggcccggctcgcgttctccttctcgaacaggttggccaggaagccgagctggccgggcgtggcgtcctccagggccttctcgagcacgctgtgtgtcaacggcaggttgcgggcgaggcccatgacctgttccggcgtggccttgtcaagaacgcggccgccgcgctgccgcggtttttgctggctcattcggcctccttcatgtatttgtcgtaacgcttcaaatcctgcccgccttcggttcccgcaccctcgaggatgcgtttggcacatgtgccgatcgccgcgcggtcgacggtccgtcccgcgttgatgacggtttccaccgctttggccgtggcagcgaacccgcagtcggcggcaacggctcggatgtcgtcgagcagattggagcgcgtgcgtgcgtccatgcggtcgagcagggctcgcacggtttcggggaaatcgttcctgatcgggctttcgccccatatgcggggctttcgcgcgatgatcgcgagcaggctcgccggatccacctgggttttcgccgaatggccccagatcctctccagcgtggtgatcgtttcgccgtcggggccccgcagttcgatctcgaagacgcgcaccccggcctgcaggcgcatggaacgccatttcggtccggccagataccggttcgcgtcgatcgtggcggcgccggtcttgtcggttttcacgctcctccagtcgcacgggtcgaaccgcacgccgggcaatggaagcatgtggtccttctccgcctcgaacagttcgatcaccggaacatcatgccggtagtgatccgatccggcgatgcgttcgcacgcgtcgagccacacgcgcgtcagcgtttggaagctctcggccgacggcatcggcaccatcaggttgcgcctgacgaagccgacggcgttctccacactgcccttctcatggccggaatacgggttgcagaaccgcggctcgaacccgtaatgcgcgcagaacagggagaacaagcgggtctgggtgaccgtgccgtccggcctgcgatggcccacgccggtggcgttgtcgaacaccaccaccctaggcgccatgcccatgcgctcgaagatccacagcaaaccctggcacacgcactccgaggtctcgccgggaagggcgaccacccagcgcatgttcgaatacgggaacgacaccaccaggaaatgcaccacgcgttcgactccggcgatcacggccctggcctggccgaaatcgacctgcgcgcttcccggcgcccactccaactcggcgaagccgtccgactccatgcgatgctcccgccgccagcgcttgacccagcgctgcaccgacgaatacgagcccgtgaacccgcactccgccacgagccgctcgtacacgcgcgtcgcggtgtggcgctgcttgacgggcatgcgcagatccgcggtcagccacccgtccacgacggccgaataccccgcgtcgaccagcgacctgcccgcatgccccgagccaaggggcttgggagagtaatccccgtggttggcgtacttgaccacggtcgtgcgcgatacgccgagtttccgcgatatctccctgtggctcaagccctggcggtcgagctgcctgatacgctgttgaacacacaccggtgtcgtcatttcctttcctcccgagaaccatcagtttggttgataagcactcgggaatctaccaaggaaccggacgatgccggtgttctcattccaccggcgccatcaccgccgacaccgtccaaattgaacgctcagggtgttcaggaacaagtgccgacagtgaacacctttattcgatcacacacagttgtcgggagccggcgtcgtctcgcccccgtatgagccgtacccgcgtcgttcgggaacatgcgccgtcagaccatcctcggccatgatcccgcggagcaccttctccgagacgccggtcctgagcatggccttgaccctgcggtacccgtacccgcccttggaagcggcgaacgccccggccaccaggacacacagcccggcgtatctgtcaaccccgggcctggcatggtggcagtaggtggccgctcggtgcgatgccgggcaagcatgtcatcgagctgagtgaacacgtcgggcgcagacggtcgaccggaagcgtcctctccctgttcgacaggcgccgcaggtcggcgtccgggtctttttctgcgagcctccaccacctcccgcatcaccgcgttccccagttccggctcctcgatccgccggcgcagggcctcggcgtcgccggcgtcccgatcccgtcgcatcgctggcttgctggtctggccggcgttcctgtttttgggccgcaacgcggccataccgccctcgcgatacgccttgacccagttgcggaccgctccgagccgtccggcaccggttcgatcgccttggtcctcgtctccagtgggatgatgggtttcgccatatggccggcatacctggaatcctttgccagccagcgttccaggcactgcctggccggatagcccagatgcctcaccacccgggccgtggtcatcggcgtggcggaatacaagtccaccgcgcgccgccgttcctcaggaccgaacatacgataatcctttcgttcagtctccaagaaaacgtccgcagccccttatcagaaagagaaccacggagataattccttgcctgctaattaagccatgaagtgatgtcgggccacacgtacggaccatcacgattcaactggtataaatcttttcaacattctctcgagcattgcgaacaacacaaacaatatgattgcaatgccaagatagacgataagagcgtcggcgtagacctcactgtacttaaagctttctgatccaatgatggtcgcccgggccatgatgtccatcacggagatcgtatataacaatgaagtgttcttcagcatatcaatcaccgaattcgaaatgttcggcacagcgttaatcgcagcctgaggaatgattatacgagacactgcatgtacggcaggaaggttcagtgatttgattgactccctctggccctcaccaaccgtgaagtaagcgcttctgaaaatctcgcaaaaatacgcactggcatagagcgtgaacgtgacaatcgctacagtgttcggatagatggtcacgttactgacgaacttcggattttgatgaacgaaggccacgatacggggcattccataacagaccacatacagttgcacaagaatcggagtagaacggatcagagacacaagcaggccaacgatcgtattcagcaccgggatccgtcgcagacgaacgacacagaaaagcattccgccgaacaaacccaaaaaagcggaaaccactgtgaccagcactgcgactggtgccgcctgaagaatttcatagaaatgattaaaagcgtattgggaatcgaatgacatatcaagcaacctttttcaatgaagcgtcatagactaccgaaatcaacttgtcgataagcgcggcaattacccagtaaatcagcataagagctacgtagatttccagttgccataggccaaagtcatccgcggaaagcgtgatcgccttctcataaatatccgtgataccgatagtgaacaaaatcgaagattgcttaaccgcagtgattaacagattggcgaaattcggaagacaattaattagagcctgaggaatgacgatacgcctgtagtaggtcagtctcgacaaagagagggatttcgccgcttgcacttgtccttctgatacagcatcgaagccagctctcatcatttcttcaaagaaagccgacaggctcaaggcaaaggcaatcaaggcatataccaggggatcatccgaatcgacatcgacaccaagggaagcaagaagcgcgggaagagcgtagtaggaaatgaataacagcagaagcaatggcgtgccacgcatcaaccacacataacctgtgacgatcatttttatgagtcgattgcgggaacgcccaagacaggtgagcagaatcccgatgaacatacctagaaccacagattccagaactatgcctagcgtataaggcaaacgcgttagtagcggcgggaatgccgataagaatgccgatgcgttgaaataagtattcattctacttactcctcgccgtgatagcgacgcaggaattcctcggtacgctgttgttccggtctgttgaaaagcttctccggggtcccctgctccacaatggaaccgttttccatgaaaataacgttagaagagatacgtctggccaaagccatctcatgggttaccaccaacatggtacgcccctccgaggcgagctgctcaatcactttctccacttctccaacgagttccgggtctaaggcacttgtcggctcatcaagcagaagcaaatcaggattgaccgcaattgctcgggctatgcccacgcgttgcttctgccctcccgatagatccttgggatatgattgagccttatcagcaaggccgactttgtctaagagttcaaggccgagttgatatgcttcctttcgaggcattttctttgcataaatcaaagcctcagtgacattctggatggctgtcagattcgcaaaaaggttataagactggaaaaccatagcagtcgcgccacgtacgaaagcaatgtctttacgatctctggtagcaaggtctatagtctttccagctaaagtgagtgttccggaatcggcggtttcaagaaaattcagacacctcagaagcgtggttttgccggagccactcggtccgataatagaaacaacctgtccctcattttggctgaatgaaactgattttaaaattgtattgccgttaaagcctttaaccagattcctgattcctattgacatgtcatcctctgtttttgtttatgcaagattgcgaaattgccacatccatcactgcagtcgatcgataacagctttgtcgaaggatggtccttcgaatggatcaccgaaataatctctataaatcgttagcagcgcttcgcaggttggcgtaggaacccccaatagattccccaatgcaacaagaggggcaataccatatgggatgtcttcttgaatgaaccgatgccgtatatctttgggaccaatcaatgaggaatagaccggattgtttttaaataattcagtcaatgtgaggtaatggcttccccaaaacccgttaagttgcgccgtgatgggtatgtacgggctttttaatgcgtttgcaagattgtgccgttccccatcaatatgcctgacaagttgctctgtacgttctgtgaatccgtcggacagcatgtaatactcagatccgctttcgattcgagtcatattcagaaggcaaagtggagcatggatgatgggattcggagccatcaaagaggtggcgaacaccgtgtcatagttcagcacgttcgaataagcggatgacaaaaaacggttagtttcctcatgagcgtccgaattaatcgcataggcgatctcgatagatgatttgagtcctttgaagagcagcgaagcactctgttccggtttttcgttatcgaacatgaactttgagacatacggcattcccgtggattcagcaatcgttaaccgttccttctggatgccatcttctccagccaatatctggaaagcctcatacgcgccccaattcccgttgaacacgataagacgaattgccgagccgggattattttttgcccagtctcgcacgttcttaaaaacatcattgtgattattagcccatgtgcagataataatgaagtcggcaccatccaaaacttcagccagattatcgctcgcatgaatcttccataatccatcaatcacgcctgtggaagatattgcagagccctgcaacgccgccagtttcgccgcattacgtgtatataccatcgggttatatccgagagagcttacatgcaaagccgccgcgatgccggtgtttccagcagacagaatagcgattttccccataacaccaccaaccacaaaatgaatttttaaaagacataaatctgccgtacggggaaaccgtacggcagaggcttcaatcgtcaatcacttccaatagataacgctatcgaccttgtctgcgcccggtagtttaaagacgtcttcgccataccacttctcggacagcttggacaaagtgccattattgcggaaatcatcgagaaccttgtccacatccttgcggagcttcgcagtgctatcgcccttatgatacaggaacaccgttgggaacaatccgatggaatccgtcgtagtcagatcaaggccgagttcatctttaatgctttggaaagacgtgtaagggtagatcgccgcgtcatatttgccagcaccgacggctttaagcacatcagcgaccgtggcggatttttctgtagcaccttcgaactcaattttgttgttaggatgcttttcattgtattgattaataagagtgtagcgtgcatcatccgtcggaatcggtgcaagtttcttaccggatttcgcaagatcctccagagaattaatgttcttctcatccgatcggataatcagtctggcatcactgagacccgtaggattttcggaataatcaaaagtcttaaaacgctcggcagtaccgtagaaagagcacgttgccgcatcatacttgccactctgcaatcccgtaagcaaagcatcctgagccagcgcggtatacttgaatttgtactggggcagtttttcatcaatcttcttcagaagttcgaaatcgtagccagtgtagttattgccgtcaacgaatgtatacggttttttccctgtcacaccggcaatattgacaacctgaacatctttcgatgcttctgtatcattcttagatgttccagagccgcaggccgtcaaggagaaaacggatgccgccgctgcgatcacggctacaatacgcttattgatgaggctgttagacatttattttcccttcctcttggcataactatccaactgatgagaagcatgctatctgaggaatgaacccaaaatgcctttcgcgctatcttatctttaatggagaaactataagcgtgatttataaacgccaacgagacaaacggtctcggacagatcagacgctaccgaagtaaataacgcaaatacccaatcagcagcctagaagcaaaagccaaaaagatgaatgaaagcaaacccatatccaacttaaatcgaggtgcgagcggattcccagactggcacggcggctccaatgacagacaacagaaatagcagcggaacaggtttctcatgagtgtgaagcccaatcggaattccagggactttgatgagaaatgtatggagccgaggcggatgattcaatgacggcaaggagagactgtttggggagtatcgacatgaatgacggtatcgtgcgtcgtccacggtacaggggatggacccgtgatcgctacgactgcagtcgggcttctccattccattcccatgagagggcgcacgctccaaagacgtgcgccctctcatgggaatggaatggagaatgaaatcaacggtcttctatctggacatgacccccgttctcgcaattgaccccagccagtccagggatggcttcggatgacgttcgaaggtgtccttgtcccaggaagccagaccgaacgtcggagcgaacgacccccactcgtagttgtcgagcaacgaccagtggaggtatcccctcacgtcgatgccatcgtccatcgcgtcgtgcatgccggctatggcgtcgaaggtgtagtcgatcctctggcggtcgtccgcggtggcgatgccgttctcggtgacgattatcggcgtgtgcccggcgacgtcccatgtgtgccggatggcgatgcccaacgccggcgggaagtactcccagccggtgagggtgcgttccgcgtcctcggggatcggcacggggccatccttgccgatgaaggtcctcagataggcctgcacgccgataaagtcgtccccggccgcggcttcggtgaagtagtcctcgcgcgggtactggtattcctccatctcccgttcgcatcccggcatggcatggaacgcctggcaggcgatggtccatccggacttgatccgagggttcccggacagtatttcccgagccttcctgtgcgcctcgacgagcgtgacggagatgtccggatcgggcgcgggcagcgaggcggccacgaagtcgctgccttcggttccgccacgggtcagcgcgaccatgttcggctcgttgatggtgcatacccaggtgacgtcgtggagtatcgtcatcacgtaccgcacgtacctagcgaagtagtcgacggcatcggcgttgagccatccgcccttggccgcaagccactgcggcagtgtcatgtggttcagcgtgaccatgggctcgacgccgttctgatggcacacgtcgatcatatggcggtagtgcagcagctgcgctttggagaagcatccctccgcaggctcgatgcgggcccattcgatggagaagcggtacatgcgcaatccggcgtcggcgagcattctgatgtcctcgccgtagcggtggtagctgtcggccgcgtctccagacggttcgttgaggtccgtgcgttcggcatgctccctggcccaccagtcgctcgcgacgttgttcccctcgatctgatgcgcggctgtggatgcgccccagatgaattccggcgggaactcgtattgttctttcatgacatgtctttctatttgatgcccgttccggcgacaccttggatgaagtagcgctgcaggaatacgaacaggaggaggatcggggtgaccaccagtaccgctccggcgagcaggacgctgtagttcgtggcgttctggccggtggagtagagggacagtgccacgggcagcgtgtacttctcctcggtctgggccgcaaccaacggccacaggaagttgttccaggaggacaggaacgtgaggatggacagcgtcgccagcggcggcccgcactggggcaggacgatctggaagaatatgcgcagctcaccggcgccgtcgaccctcgcggcctccatcagcgcgtcggggattccggagatgaactgtctcatcaggaagactccgatgggctggcacaggaacggcaggatgagcgccgcgtaggagttcgcgagtcccatgttcgagatgatcacgaacagagggacgaacgtggccacgctcggaaccatgagcgtcaccatgacggcgccgaacaagatgttcttgccggcgaagtccatcttcgccagggcgtatccgaccatggagcagaacaccatgttcccgaggacggtgatcacggcgacgaccatgctgttggtgaagtaggtgccgaagttcagctccccgaaccatttcgcgaagtttgcgagcgaggcgtgctcgggcaggagcttcggcggtttggcgaggatctccctctgggtcttcaacgagcccaacgccatccataggaatgggaagatccagaagactccgatcaccgcgaggacgcagtaggagaggccacgtcctttgacgaatcggcgccagatcggctgcttattgctttgcggcttcgatgccgcgactgtcgtggctgtcatctcaatcctccttgagaatgcggaactggagcacactgaccagcgcgatgatgatgaacagcacccagctggctgcggaggcgatgccgtactgtccgaaaccgaacttctggtacacgtagtacgcggcggagagcgtcgaatcgagcggtcctccctgggtcatcacgaaggattcctcgaagaactgcaggtaggcgacggaaagaagcacggcacccagcagcagcgtgggcttgagcagcgggagcgtgatgctacgaaaggtgcgccatttgcttgcgccgtcgatggccgcagcctccttcaattcctcggggatggcctgcaggccggcgaggaagatgatcatcagcgttcccatgttgcgccagatcgtcatggccatcagcgcgggcagggcgtagcgggtgtcgtgcagccagtccggtccggcgataccgaagacggccaggagcgagttgagcaggccgtccttctggaggatgtacctccacacgacggagaccgcgaccacgctggcgacaaccggcgcgtagaacacggccctgaagaacgcgttgaggtgcttggatcccttgttgagggccaccgcgaatgcgagggcgatcgccatggtgatcggcaggccgacaagcacgaagattccggtgacgcccaacgcgtgcaggaaacggtggtcgtggaacagggtgatgtactggtccagtccgacgaagttgacgttgaacggggtgcgaaggtccttggaggtgatgtcggtgaaggacatcgccatcgaggacaggaggggaatcagcatgaatacgcagaacacgactgcgaaaggcaaggcaaatccccatgcgagaatcgtacggcggcggcggaggacgttgcccgagccctccgtcttcgtctttcttgtcccgaggctcatgggatcagtttcccgttccgatggagtcggcttcggactgcaggttcttcaagccctcgtcaacggagacctgtcccttgtttatctgctcgaggatgcggtcggcagcggaggacacctgcgcccaggtggacagcgccggcggagccatggtgtgcttcagctggtcaccgaacgccgcgagcttgtcgttgccggagagcacgtcctcatcccatgccttctgagaggcgggcaggtcggaggacttcttgtaccattcgacctgcacctcgggcttgcttgcccactggatgaacttccatgcggactgcttgttcttggagtccttgaacgtcacgaagttgctgccgccgacgaaggacgtggcaggacccgaggattcgttcatcgacggcagaatcacggtggcgtacttggattcgaagccatcgccgcccaattcgttgatctggctgacggcggtcggcccctgcagcatcatcggtgtgctgccggatacgaaattcgctatgtcggcgccggaactcacgtcggcattgacgtccgctatgccatccctgtagaggctagtggtaaagttcaatcccttctttataccgttatcttcgaaagtccatttcgtctgttcctcattagtcagggacgcccctgccgagtaggagaacggcagagtcccaaggaacgcatcagtgccagatggattgaggttcatgccatatttgaccccgtcgaccttctgcatgtccttggccatccgcttaagctcattccacgtcttcggagctttgttccaaccagccatcccggcgatgtcggtacggtagtacagcactcgggtgtcgatgtaccaaggcacgccgagctgtttcccgtcgacctggccagcagccctagacccgtcggagaagtcggacatgtcgaggttgtcaggcacggtggagaatgagttggagaaatcggccatccaggtagtgcccatctgtgcaaggtcgggaccgttgcccgcggcgatggcggtctggagtttatcgtgcgctgaggaccatggaatcgcggtgaccttaaccttgacgtcagggttctctttctcgaatcccttagcgaaatcatccagcagatcgccctcgttgcccatggcccagatagtcaggtcgccggtggccttgcttgaattgatggtcttgaccgcatcggaatcggaatccgcgttgttcgcggaccgtccgcacgcggacataccggcaatcatcgccacactggccatgccggccacgaccgctttgaaaaatggcttcctcattaaaatctcctttgattcatatcaatctaaccgcttagatttaaggaagtcaaagcgacacgcccatatgatttatgcgcttagattttttgattgcatccgcagctgccgcgcacaatgaggcggaccgggagtactcgtctttcagccttttcccaaggctccccgttcctggaaagcagcatgcgagccgcctcgcgccctatgtcctccatgggctggcggacggtcgtcagctgcggttccatcagccgtccggcgaggattccgtcgaatccggtgacgatgacgtcgtcgggaacccggacaccggcctcctcgaggagtctgatcacgccgaaggcggtctggtccgtgccgcagaccaaggcctgcggcagtctgccggatcctatcgcctcgcacagacccaccatgtattcatcggacgtggcgaaggagtcatccagcagcgcgtcgctggaatcgagaccacgttcctcgaggcatttccggaaggcgacgtagcgggcgacgacgtcgtccgaatcgaagccgccgacgaacgccatctcgtcgacatgatggacgtctacaagatggtcgacgatctgtctcattcccgaggtgttgtcgcattgcaggtacgcggcaggcaggttctcgtcggacacacccaccatcacaagcgggacggtcttcgccagcacggcgaggggaagtctgtcgttatatccggtcggtatcagagccagcccatcgacccgcccggcgatgtcggtcaccgacttatggtcgtccctcgccaacgcagcccccatgagcatgcccttgccgcttttccagcattcaagctcgaaaccgcggagcacctcgtcaacgtatagaggataggtgagaacgtctggctcgtcgtcatcggacatactggccggcatggaggatacatcggacctatcttcttcgagaccactcccctgcggcttctccagcagcatatcgaacgcgtacacgcccaacgtgcccgtcctgcctttggcaaggctacgtgcgttgccgctgggaacgtagccaagctcctcggcgaccctgaggaccttggccttggtatcatccttcactttgtcgggatgcctgaaggcgaaggagaccgtcgcggtagacacacccgccttctctgcaacgtcatacaccgtaactcttgccataagaccagtctaagcgctttgacatatgagacacacggactgaagtccaaaagcttcctctgaccgttcgcccggaaaccccggggtccgggctccagccggcaggccggcacaacaaacaaaaaaagggggttcccggagccgaagctcgacgggaacccccaacgttgaataccggggaaccactcgccgagcggcagcgaagagtcaatttacacgaaccccggcgatcacgcaaatcgacccttccaaagataccctagaaccgttgcaaataaacacatccctcggcgtgtcccgattccgtccatctgaatcgtctttctccttttccacagaaaccagctcatccttccggaaaacatgttcgtcgtatgagtcgccttatcaggaattgacggaacgatacgttgaggggattctgttatcctgtggggcgcagcggagcaaaatgacctgccaagacgggatggtccctttcatgagcaggcttttgactcaaaatagaagacggatcgaatattccgcagtgataccgtgaagggagggaacggcatggaggcgcagcctatgaggctacaggacctgagactcaaagaaggaatgtctctagaacagctggccgagctctccggcgtggatcatgatcgtctcgtcatgttcgaaaacaatccggaaaccatacgcaatatgcatttggacaccgctcgccaaattgccaaagcattgcactgcaacgtgttggagctccatcccgacgaaggttggagaggcggaatccactgcgctgaatccgggctaagagacattcgtcggactcgcggctatacgcaaaacgagttgtcagagatgacagggattccccagccgaacatctcttggtttgagacaggctatcgctcgacctcaggcatgcggctggatacagccaggcgtctgtcggaagcgcttcgatgcgatccgacagatttcctaaaagaagcgtatagccgatatgaaaataaatgttgtatctgatttcattataaacacttaaatttcatcggacgccatacttcaacaaacgaatgcatcccgcgcacctcccatctcaccaaaaagattaggcaagaaagaagcccatcaatcattgacttcacaaacctttcccttccagaaagctggataacgtccgagattttgcgcactttcggacgttatctggcgcggaggacgcatttgcgcagttcggaagcgatgagcacgatcatggcaaggccgaggcattcgacccatgcgccgacgctgagcggtaccgtaccgaaagcggtgttgaggaacggaatgtaaatcaccgccagctgcaataccatgctcagcgcgatcgcgccccatagccacttgttggagaacagtccgacgaacgctgactgcaagtgcgagcgcgaggcaagcgcgttcagcatttgcgcgaacacgagaatcgtgaagcccatggtgcgtgcttccgtcatttgtgcgtcgtgaccgatcgcatcgacggaacggtcggtgaacagaccgccgtccaagtgcatgtccatgccgatcagggtgacggccgccataatcacaccgatgaaaatgatgtcgccccacatttcggcgtcaatcacgcgatcggtgagtttgcgcggcttgcgcgccatcacatcgtcggtggacgggtcgacgcccatggcgagcgcgggtgccgcgtcggtgagcaggttgatccacagcagctgcgtggcaagcagcggcacggtcacgccttggctgccgggctgggtgatgccgaggaatccggcgagcatcaccccgccgaacacggtgaacacttcgcccacattggagctcagcaggtagcgcaggaacttgcggatgttgtcgaaaatgccgcgtccttcacgcacggctgcgacgatggtgctgaagttgtcgtcggcgaggatcattttcgcgctctgcttggtcacttcagtgccggtaatgcccatggcgacgccaatatcggcggttttgactgcgggagcgtcgttcacgccgtcaccggtcatggccacgatattgccttgccgttgcaaggattcaacgatcttcaacttgtgttccggcgcgactcgcgcgtagacggacactccgctggtcaccttgtcgaatgccgcttcgtcgggcagttcgtcgagttggctgccggtcatggccgtgccgcccttgtcgataatgcccagatcggtggcgatgcgcgccgcggtcagcgggtgatcgccggtaatcattaccgtacgaatgccggcgcgatgcgcttcggcaaccgaatcacgcacttccgtgcgcggcggatcgatgatgccgatcatgccgacccaaatcaaatcgttctcaagcacatcgctttgttccgcaatatcggcaacatgacctgcggaattcagcatgattcccggcacttgcgcaagagaagcggtaccgagcggacgataagcctgtcccagcgtgcggtatgcatcggaagaaagctgttcgacagtcgcaagaatctgctggcgatcgccttccgtaagtggacgtaccgcaccgccgacagcaatcctgctgcaatatccaagaagcacatcgggggcacccttggagaagacggtcagacggccggcgtcagcgttgtcttgcgccacgatggacatgcgcttacgttcggaagtaaacgggatttcgccaacgcgctcgtagttggcgtacttgcgattcgccttcacttttcgtgctgcgacgatgagtgagacttcggtcgggtcgccgaccgcctcccacgttacgttttccgcatttccggcagaagcagcagattcgcgcagttcgccgtcgttcgccaacgcgcccacggcaagggtcgcaacggcttccgattcgatgatcccgcgtatttgcgcatgttccatggtctgtggatcgaccaccatgcggccttccggcgcatagccggtgccagtaagctgcacttcgccgctcggcgtgaccacacgctccacggtcatctcgttgcgggtgagcgtgccggttttgtcggagcagatcaccgacgcagatccgagcgtttccaccgaatgcagcttcttgacgatcgcattgtgcatggccatgcgctgcacgccgagcgcgagcaccaccgtaagaatcgcagccaaaccttccggcacggccgcaaccgccagagaaacggccaacagcagcgaatcgatcacatcgtgaacgtcttggaagccttcggtaagcgcgagcgcgaccagcaccacgaccgcgatgatgcataccgcgctgccaaggattttggaaacgtagttcatttccttttgcagcggggtttcgtcgtcttccgtggcttgcagcagatcggcgattttaccgacctgcgtgcccatgccggtgctggttacgatggcgcggccggtgccttgcgttacggacgtgccgttgaacaccatgttggcgcggtcgccgagggccttcgcctgtgcgagggtgtcggtctttttgccgacgggcacgctttcgccggtgaggctggcttccgcgattcgtaggctggcggcggcgaagaggcgtccgtccgcggaaacggagtcgccttcgccgagcacgatgatgtcgccgggcaccacgtcaaccgtgttgatgcgttcgattttgccgtcgcgcagcacgttggtttgcggcgcggtcatgctggagagcgcttcgacggcggcttccgccttcgattcctggatgtagccgagcaccgcgttgacgatgaggatcagcacgatgacgatggcgtcgaacggcaatgcttcgccgccttccgcacccggtacggcgttggctcgttcaatgaaccatgcgacgagcgaaatgccggtcgcagccagcaacaggtagacaagggggtctttgaattgttcgaggaatttcttccatttcggcaccggtggtgcggacgcgagttcgttcggtccgtacttgtcgagtcgacgcttggcttccgcttgactcaggccggtattcaaatcgacaccaagcgattgcgctacggtttgcgcatcggcgagcgacggatcgacttgcgtttgcgtcgcggtttttgctgcttgttcgaaatttcccgaactggtatcgcggaattgggtggattgatcttccttgcgatcaaccatgatgatctccttgggagcgccgcggagtagtcagcactcccctgccgttgcgatagtgcgaaatagcggaaaattgcgattttcgcaaccactcgccgaactgggcaatgctgcgcggttgtgggcaccgggcgtacgccatcggtgcattcctgccattattacacaccgtgcccattttgcaagactgcaacgcaccgtcttttgtcaagatttcacaaaatcgtgaaacataatctgcaatcttatttcgaccgcgcattcgattacacggcaacaccgacggcaatgtcgctaccatctttggcggaagtgtgatatgttatcggatgttagtaaacaaaattacttacgctatgattcgtagcgtacattggcaacgtcgcaatggataggggtagttatcatggcagctcaagaagccgcgcaatcacagcaaacgcaaggggttccggaatcgcgcatcctgcaggcgcggcaggcgaacgcaagctggctcaccgatccgaccgtattcgcggtgaatcgcaagcccgcgcactccaatcatcggtatttcctgggcgaagccaccgaaccaaagcagaatctcgacggcgaatggaaagtaaacgtcactcaggcagccaacgtcgacgtggaaaacgcgccgttcgccgcagctgacttcaacgatgccggtttcggcgcgatcaacgtgcccgaacacctgcagatggccggctatttgaagaacaaatatgtgaatgtgcagtatccatgggatggccatgaggatccgcaggagccgaacgttcccgaaaacaatcatgtggcgatctaccgccgttccttcacgcttgaccgtccgctcgccgcgacgctggaaaatggcggcaccgtcagcatcacgttccacggcatggccaccgcgatctacgtaccggggaaccactcgccgagcggcagcgaagagtcaatttacacgaaccccggcaatcacgcaaatcgacccttccaaagataccctaaaaccgttgcaaataaacacatccatcggcgtgtcgaaaaaggcctccgaacggccgtacagccagtctagaccccgaagacaacgcctacatgaaccaaaaacaaactataaacggcgtgtcatacccatatacatctcattcccatgtgatgaatacccaaatgcaatcgcaaatcatgattccagcggaacagaaagagcagaaatacaaaagagacgcgaagaagcatgaaacctggctgcacttgcgacggcacgcacgctgaaatacaacaagagccgccgactcagggaagtcgacggctctcgctgtttcaattgttattcagttatgttttgacctgtgagaaggaagtgagatcaggcagtgacctcagccttggccttcttgcgatccatgtagcgcttgatagccagagcctcaagtgcgatcaccaggattgcggtcacgccccaagccacgtacatggcggtcttccagatcggggtggcgaccttcggctcaccgtctgcatactgccagctgttggcggcggtgtacagaatattgtgggcggcggtacgcatggccttcacggaggttgcggacttgtcggtgatgtggttggtgatggaggtggtagccagcatggaatcgttgccgttacggatctcctgatcaccattctggtagccgtagccgccgaagtaatcggtcagaacgaagcccttgaagccccactcgtcacggagcacggtgttcagcagagcgttattgccaccggcataggtgttgccgatgtagttgaaggcgctcatcacggcctgtgcgccgccttctttcacgctcatctcgaacggcttgaggtagatctcacgcatggcctgctcgttggtccaggtgcagagcatctcggtacgcttggtttcctgatcgttcagggcgaagtgcttcatgaaggagtacacgcccttctccttggcaccggcgatctcgttggaagccatggcaccggagagcagcgcatcctcagagaaatactcgaaggtacggccggagaatgcgttgcggtggatgttcatggccggagcgtaccagccggcaacgtgcatgtcgtgagccatatcgccgatcatctcgccgaactgcttggccagatccttgttccaagtgcaagcgaatgcggtggaagccgggaagccgatggagccaacaccagtgaagttgttgttcaacgaggccgggccgtcagcgtcggtgagctggatcttgccgacggaggagacggccggagtgccgtagccgccgttggcaatgaggttgtccatatcgtcgaaggtcagctcgtcaagcagcttctcccaatcagcatcgtcgtaatccttgccgtacatgtcggccaggcggaggccattcttggcaccggtggtcggcatctcgtcggaatcgtcgttgaactgagacggatcgtagttggtgttgttgtagaaggtttcctttgccttatcagacatttcgaagttggtcggagcggcggtgacttccttgtagtttgcgaaatgtcctgcacggctcaggtaggtcacatcgcctgcagcatcatcgaactggttggtggccacggtctggtcgccattgtgggtgttcgaatcggagtcgtaggtgatggtgtcgtccacggtgatcttcttggagccgatcacagtgtgggagtcggagttgatggagatgttgtaatcgcccttttcgagcacgtatgccttggcattcttgtaatcataggaagccatgtcatcgtcttcgaattcgacggtcacgtcctcggaagcgcccggctcaagcttctcggtcttctcgaagccaaccaggttggcactggccttttcgatgccaccttcggtgtacggcgggttgtagtagacctcaacaacatccttgccagcggtgtcgccggtgttggtgacggtcacatcaacggtgaccttgccatccttgtacgtcacatcgttgagcttctgctcgaaggtggtgtagctcagaccgtaaccgaacgggaatgcaaccatggaatcgtaatcgatggcaccttcggccgctgcggtctcatagaacttgtagcccacatagatgccttcggagtagttcacaaagcccgggatggcggtgacttcgtcaccagtgaagcccgtgtacttggcggccttgtcttccatgttggtgtattcgaacttgccgaagttgttgtaagacaccgactgggtgagatccttcaggaaggtgtcggaagtcttgccggacgggttggtatcgccggcaagcacgtcaccgagtgcggagaagccggtctggcctgcaggcgggcaccacacgacggatttgatctgcggatagtcgttcaggaagtcgaactggaaggtgttggcgccgttgtagacgagcgtgaccttgttgaagttcttggtgaccaggtcgagcatatcgcgctcggtctggctcagctgcaggaagctttcgccgtccttgaagtcctcgtaatccttggagttgttctcataggtgatgccttcggccttcatgttcatcggaaggtcagcgccctcgccaccgacgcgggtgagcactacaacagcctcatcggagaagctcttggcatcggagatcagggaatcggaatactggtcggccggaacctcaggcagggtccaatcctgtgcccacatgccaacaactgggcgatctgcacggtaatcggtgtacagcttggtcaggtcggcgttggtctcgatgccggcttccttcatgccatcaagcagggaaacggtgtcatactggtcagacatggagccggagccggtgccgccgtataccgggttggtggagccccaaccgaacacgttgaccttcttgttagccagcggcaggttggaatcatcgttcttcagcatggtgatggcttccgactgcacttccttggccagctcgttagccttggaaacagtggtgtcagacagcatgtacttggtgatggtcgcgttgttgagcagcgtcgacagcggaccggacagcatcatggaaaccgcgacgacaatgccgaccaaagccacaagccaagactcggagtggatgatcttacgggtcgccacttccttcaccgtcttcttgttgacggcaaaagtaatgatcagcgcgagcacaaatagcacgccaatcgcaatcaggtacggcgtcaacgaaccgataacgttcatgacgtcagccatgttgatttgcagcatggtctgcctcctccttgattctcataaccaaacgacatgcaggctccgatttcctcatcgaaaccagaaatcatgcaacgctgccccgcgtcacgcaatttccagaagtgaagacacttcttcatgtcgatgtttcgatttcaccaaaatccgcgaaaaaagcaccctgatttttcccagcctgtcgtttcgcgtgcataatctgcataccacctgcgcatgtaaaactaccattcgtgcacatataatcccgttgcgcgcatgcatctggcacaatgtgcgctcatccgcagattgttgcaacatccttgccttgattgcggaaatcatcgatcttcattgcgcttccaactccataatcgcaattcctgcgatattttcggcacactacagcgagctgttccagcggcaacttacgtaaggcaagtaccatgggtgccatgagcgacttaagcgcattgaatctggaggcaggcagcctcgttggcggatacacgttgatttcccggcttggttcgggtgccatgggatcggtatggcgggtgcgagatgacggcggccatcagtatgcgatgaaaattttgcgcgattcccttgccgaggacgatgcgtccagcgaacgctcccgcgatcagctgaccgcacgcgagcgcctgcgtagggaggctatggcgctgcagaaagtgcgtcatccgggcgtgtgcggcattgtggatatggaattggatgatgctctggccttcattgtgaccgagctgatcgagggcaagaatctacgtgaagatgtgcgtaccaacggccggtatgtgggcgatgatttggaacggttgggacgcaagctgatcgaggcggtgaaggccgtgcatgcggccggtattgtgcatcgcgatatcaaaccgacgaatgtgatggtgtcgaataccggaccggtattggtggatttcggcattgccatgggcgagggcgaaagtcatgtgactcgtaccggattggtgatgggcacgcctggattcatcgcgccggaaatcatcgacggtgccgaatccgatgagatgagcgattggtggtcggtggcgagcgtgctggcatttgccgccactggcgagccggtgttcggcacgaaaccgatgatggcggtattggagcgtgctgccgcgggaagcgcgaatttggcgggattgccggctgggaccatggccgcgttccgttcggcgttggatccggatcgtacgaaacgttgcactccagacgagttgttgcaggcgattgcgttggatgcgttgaatccgcaagcttggatttcggggaatacttcggatgccgccgatagtgccgggtcggaggcgatgctcccttttgatggatcgcccgacaatccacgaatgctttggcgggcgttagaccatgtgacgggagaagacgccatcggcacgcgcaccttgccgcaattcgttgaggccacgcaggcaatcggcgcaaccgttattgctgacataaccgataccgttattgccgatgcgcccgatgtcggcacctcggtcatggatatcaacgcgcataccgcaaccattcctcttggcaccggcacgctcgtgctgcctgtcaatagtggggataccagtgtgctgccgcaagatacaccgcaatccacgcgggtgatgccggtccaggacgcttggaatcccgctcaagaggctacacagatcgacccggccatcaaacctgcattgcagcgcatcgccaaccagcggcctcctgccgtaataccgaacgcatcggttgaaatggcgcaaagtgcgcaaccacaagacatgcaaacatctgccgtgccaaccgcaccggtcactccggccgcgccgctcaacccgaacgtgccgcagagtgtactgcagccgccgaatccggccgacgtgcaacgcggcgaactgctaggcagaggcgtgcccctctgcgtgctgatggcgattcctgtggccgcatgcggcctgttctcgccatggatcgccctgatcgcgggcgcgctgctggcctggttgctcgccaccattggattcaatatggaggcgcagctggaacgcgaaggccgccgtgggggcagccgcaggacttccgactggttcgcccgcgccgccacgctgccttggcatgtgctcaaggggctgggttatgcggtgccacgcgcactgatcatggcggtcatcgccgcattaggattgacgattgccacagtcacgctgcaactgccgtttgccatggttgatacgtcgatattcggattcacgattccgctgccgacctggattgaagggccggtttcgcaaagcggcgtcgcccaggccggttgctgcgccatcggctggctggtatgcgccctcgctccgggagcattggtgctgcgattgggtgccggcgcattgcgcggccgcccgaaatccggcaccactgccgaatcgtacgatatgtagtgacgccatctcacgaaatacgcagcgaaaatcaaaaatcggcaaacgtttgcaatcatcagaaaaacatcagataatcgcacgtagtatggcaacgtgagcttttacgaaatacttcattcagcaatagcgtgcccacactactatggtgcacagcatcgtgatgtgaacatcgaaaggaatgtggatggcccagaacagtaaggatgcgcagaagcgcgccagccgcgccgagcgtagggccgctgaggccgcggagatgaaggctcgcgccgaacagatggagaaggagcgcaagcagcagaccctcatcggcgccatcgtgatggcggtgctggtgatcctggtggcgatcggcgcgttcaccgtgtatcacaacatgcacaagaacaccgaaacgcaggcttccacccagaccgtggaagaagcgtacgacaagctgcagcaagtcgaaaacacccctaagctcgtcgataagaagggcggattgctgatttcgaaggatggctacggcaagtccgtcgaaggcgcaccgactgttgagatctacatggatttcctgtgcccgggctgcggcaatctgcatcgtcagcttgatgaggatctgcagaagatggtcgacgcgggtcagatcaatcttgatttgcatttcatggcgtttatggacaagtggtccaccgacgattattcaagccgcgcagcgaatgccgcgatctatctggccgagcatgacagcgatccgagccatctgatcaccttcctcgaaaaaatgtacgccgaggatttccagcctgaggaaagctcgaattacaagtccgtcagcgacgatcagatcaaggaacagatgatcgcctcgggagtttccgaggatgtggcggacaaggcgttcggccgcgactaccaggattggcttgacgccatcgacacctatacgccgaagcgctccgaactgtggaacacgtccggaacctacaaagacagcatgaccaccccaacggtgaccatcaacggcaagttctgggatatgaaccagttgagcactgcgcaggagaccattgaggaaggcctgctggaggccatcggaatcaagtccgacgacatcggcaagggaggcgtgatgccctccatcggctccgacaaggatccgatctccaacaccactggcgagtgatcagccctacgcaatcctcataatcgaaaaattatacccccctactcgccagcgtgccagccaaagcgcagttccaagttgacggcatcgggcacgctggttatgctattcaatcgttgccgtttttatgcattatgctagaaagcggcacaagcctccttagctcagatggccagagcggccgccttgtaagcggcaggtcgtcggttcgatcccgacaggaggctcgaaacccgttttgacgggctttgacctcttaccatgggtaagtgatccagaagccttcccccaacttatggcttctggcgaccggacgaggcttcccccaacctgcctcgtccgggcagggggcaggacatccccttccctcctgcccccttttttctttactccttttcctcgaaaatgtggcggtatagataaagccagcggaaaccatgccattcgtcccgatctgaccgttacaatgacggcgatgtaggcagtcgctggaaagaggacgtatgacaagaaggtggaccccccggagattcgtgacgcttcggcgtgttcgagtgacggcatgcgtggtctcgttgacgctcgcctcgacgctcgcattcggcgtaggcgcgcgcaaaaccgtggctctgaccatcgatggcgaaaccaccaccgtaaccacatacgcgatgagcgtcgaccgtctgctgcaggaacgcggcgtgaaggtcaaaacgcatgatctcgtggaatccaccagccccaccagcatgctgagcaaccatgacgtggtgacggtacgaagcgcctaccagaccaccatcaccatcaacgggcaggaagtgcccttctggacagtggcgaccagcgccgaacagctgatcggattcttcgaacaaaacgaagcagacgcggcaaaagtcaccgtcaatatcgacaacgtgtacaacaaactcaccggcggactgatcatcaaccaaaacgggccggtcaccgtcatcgcagacgggcaaagctccgaatcgccgaatggcaaactgccggcggcctccattcttgactccaaaggcatcacgctgaacaaggaggatcgcgtcagcgtcgaaaaagacaacggcgaaacgatcctgcgcgtccgccgcgtgacgcacggcgaggaaacacgcacgaaagcggtgcctttcggcacgcaaaccatcgtcgatcccagcctgcagcccggcgaagtcgtagtcaggcaggaaggcgaggacggcgaaatccagcaaacgtacgacgtcacgtatgtggacggcgagaaggaaagcgagacgctgaccaacgaaacgaccacgaaaatcgccctcgatcagattatcgcagtaggaccggcagcatcttccgacgattcgggatcggatgacggatccggcaattccggagataccggcaattccgataattccggaaagaacgacaattcgaacaagaacaacaattccgataattccgacaagaaagacgattcgaacagtaattccggcaatacggataattcagacgacaacaagaaggacgattccggatcgaaaacggacccggatccgacgccaactccagacccgacccccacgccaactcctgacccgacccccacgccggatccgacgcccaccccgacaccgcaaccttccgatccttcggcaggatgccgcctctatcacccctcccccgcgcaggcacaggcctacgcggccggagccgcggcgcaatatggctggaccgggcaaaactggaccgatctggtgaaactgtggacgcgtgaatcgagctggctgtggtatgcggaaaacgcatcttccggagcctacggcatcccgcagtcgcttcctggcagcaaaatggcggcattcggcgcaaactggcgtgacgatgcggccgtgcagatcgactggggcctgagctacatcgcgcaacgctacggcagcccgtcgaaggcatgggagcattccgagcaggtcggatggtattaaacaacgccgatcgcaacaatacgcaaacgcaacagcgcacacttttcataccagttgaacggataatgaggtaatgacagaacacgcgaacgaaaccaacgcaaccgacgaaaccgcgcaaggccgcctgttgggggctgccgacattcggcgtatcgcggccgaggccggtatcagcccgacgaaaaaattcgggcagaatttcgtaatcgacccgggcacggttcgtcgtatcgtgcgcgaggcaggtgtgaccgccgacgatcatgtgctggaagtcggacctggactcggttcactgacattggcgattttggaaaccggcgccacgatgaccgccgtggagatcgacccgcccgttgcggaacgactgcccggcaccatcgccgaattcatgccggatgcggtggatcgtttccgcgtggtcaatcgcgatgcgttgaccgtgacgccggaaaatctgcctgatttccaaaatgatgattcgtttacactggtcgccaatctgccatacaacgtggccacgccgattctgctgaccttgctggaacgtttcgacaatctcggcacgttcctcgtgatggtgcagaaggaagtcgcggaccgactgagcgaaaagcccggttcaaagatctacggcactccaagcgtgaagctcgcttggtatggtaccgcggaacgtgtgggcattatcgggcgcaatgtgttctggccggcaccgaatgtggattccgcgctggtgctgttcaaacgatatgagggcgggcacacgccttcggccaacaatcccgacggttccgtagtggaccgcgaaaacgtgttccgtcttatcgacgccgcattcggccagaggcgcaaaaccctgcatgccgcgttgaagaagatcgtgccctccgaagcgttcgagcaggcgggcatcgatccgacgcgccgtggcgaaacgcttgccatcgacgaattcgtggcattggcacgagccgtgggcgaggtgtcgcaagcatgagcgacactaataccgcaatcaacacggtcagcgtggactgcccggcgaaaacgaatctgaccctgcacgtaggcaggccacgcagcgaatggggtggccgacacgagctcgacaccatctactgcgccgtcggcgtgtacgacaccgtcaccaccagtcgcaaaaagcccggatccggtttctccctgaatcttgaaggtgcctatcttggcgatctggcctcctccggcagcgacatgcgacgcaaccatgccgtgctcgccctgttcgccatggccgaagcgagcggccatgaaccggatgtggcgttgaacatcgaaaaacgcattcccgttggcgcgggcatggcaggaggttccgcggatgcggccgccacgattctggcattgaacacgctatggaatcttgattggtccattgaacggttgcaacaggttgccgccacattgggcgcggatatgccgttctgcctgaccggaggctatgcgcgaggcaccggcttcggcgagcagatcgaacaactcagcgaaaacagcgacgccgtgctggaactgacggatcagggctttgcaggccgtctgctggtcggcgcgtatcaggcggaactgcgcacgccggaagtgtatgccatgttcgaccaaatcggcgccggcgcaaccgacaacaatcatctgcaacaggcgtcgatctcactgcatccacgcagcggacaggcgatcgacgaagcgttgcaggcaggcgccaagcaggcgttcgtctccggatccggcccttccgtaatcgcattcgtgccaaccgacgatgcggcacgcgccgtgcagtcggcatggcaacaaagccgttgcgtcgaccgcatcatcgccaccaaggcaccggcccatccgattgtgcatatcatcgcgtaacagtaaggttgaagtcaaccgatttttggagaaggactcgtacatgactcaggctaacgacgagcgcgccgcgcgcaaacagtacattcgccgccgtcaaaaggtggtgttcaccatcaccggcaccattttgacgatcgcattggtgatttccctgctgttcttcttccatgttggaggattgggcaatgtcaagtcggccgcggtacagccgaattacggccagcaggccccttgcgcagcacaggaacaggacggcagcaaaggcaagtacgtggaaaaccgcaacatcaccgtgcgcgtgctcaacggcactgaattcgccggcttcgcgcaagccgtcagcagcgcgttgcagaaccgcgagttcaacacccaggcagccggcaactacaccagctccaaagtggaacgcacgatgatcatcttcggcaagaacgccatcaatcaggcgtacacggtgaacagcaacttcaccgacgcgacgatggtgatggacgatcgtgaggatatgctgatcgacgttgtggttggcgcgactttcgacaatctgcagaatcagaagaaggtgccgaccgccggcaaggagatcgacagcttcgagggatgcgttaccgtcgacaagatgaccgacgtacagaaggcccccgaacacgacgccgtgtgatttgcagattttttgatttgcagattttcggattgacctcacgatttcgatttttcactgaaaatcaagatcgtgaggtcaattcttatattcgtgggttaaatcgcgggcgaaatcctccagagaatacccccgaaaccgcacttttcggaaccgactgacctcacgattctatttttgcccgaaaaatcgaatcgtgcggtcatagaatccaaatcgtgaggtcagcaagcagactactcggcctgctgttcctcataccaacggttcaactcggcaacagcgacatcacgctcgaccgggccgttatcgaggcgatattccagcatgtgcttgtacgccttgccaaccagcggccccgggtcaatgccgagcagctgcatgatttcgtcaccgttcagatcagggcggatcgcgtcgaaatcctccttctccttcagatcgcgcacgcgctgttccatctcgtccatcgccgacgagaacaccatggccttgcgcttgttctgcgtggtcgcgtcggcacgcgtaaggcggttcaggcgctcatacagcggacccgcatccttgacgtaacggcggaccgcggaatccgtccacggctcctccacgtagccgtggaagcgcaagtgcaaattgaccagctcgctgacgtcctcgaccatatgatggtcgaaatgcaatgccttaaggcgcttgcgggtcattttcgcgccgaccgcatcatgatgatggaagctcaccttgccacccgattcgaaacgacgcgtcttcggcttgccgatatcgtgcatcagcgcggccaaacgcaacgtcagatccggtgccggcacagggccgtccgggccggtttcgagggcaaccgcacgatcaatgacgatcatggtgtgctcgaacacgtccttatgacgatgatgttcgtcgatttcgagctgcaatgccggaatttccgggaagacgatatcggcaagaccggaatcgaccagcgcttcgatacctgcgcgcgggcgatcggacagcagcattttgaccagttcgtcgcgtacgcgctcagcggaaacgatttcaatgcgatcgaccatgtcggtcagcgcttcagcggtttccggttcgatacggaagcccagttgcgccacgaaacgtacggcgcgcatcatgcgcagcggatcgtcgtcaaacgactggcgaggatcgaccggcgtgcgcaacacgcccttggccaaatcgttcgcgccgccgaacggatcgacgaattgcaattccggcacacgcaacgccatggcattcaccgtgaaatcacggcgggaaagatcgccttccagcgtgtcgccataattgacttccggcttgcgcgagtcggggtcatacgtgtcggaacggtaggtcgttacctcaacctgcacttccgtgccatcctcacgcctgcgcatggcgcccaacgtgccgaatttacggcccatatcccaaaagccatcgcgcccgaaacggcgcaaaatgtgttcaaactgctcaggacgcgccgatgtgcaaaaatccaaatcatgcgatttacgatgcaacagcaggtctcgaacgggacctcccaccaacgccaattcatagccttccgcggcgaacatacgccctaattcaatggcctctggccacacttcgaagttcacgccatccctttccggcaccacaagtttctgccttaccagcataccgttaccccacctgcacacagaattgagtatggttggaatcatgattacgcccgcagaccttgcacgcatgcttgcccatgctgcggacgaccatgcccaaaatccgatggaaccggacaaactgctgtacacatcgcagtccgtttccttgcggcaagagaccatcatcacgcccaacgcacccaccccggcaataatgccgcagcggcgcgccacggacggtccgaccacgttcgcctcgctcgacgcgcaggaactgccggtagtgcgcgaatattcggcgggaggtctcgtattcgacgacaagggccgtgtggcgatcatcgcacgccactcgcgtagcggacatttggaatggtgcctgccgaaaggtcatatcgaaaaaggcgaaacaccgcagcaaaccgccgttcgcgaagttcacgaggaaacaggaatcctaggtgaagtggtcgattccatcgccaccatcgactactggttcaccggaaccagccagcgcgtgcacaagctggtgcatcatttcgcattgcgtcagatcggcggcgagttgacggtggaaggcgacccggatcatgaggcggaagacgcgatttgggtggattttgctgatttggacgacgttctcagctacccgaacgaacgaaagatagcatggttgtacgcaaggaaactcaacagacaggcgtgaaggtgaatcaacccgcacaacggaacgttccgcacggcatgcgtgcgctttcggcaatcctcgccatggttatgaccatggcgttgatgttgttatacgcacctgtgccgaaagccgaagccgaagaaacacaggaatcgcaatccgacaccatgctgtcgatcgactcctccaccgccgtgctgaccgacacttccggctatcatttgagcgcgacggtgaccaacaccaccgatcaggaaatcccttcaggcacgctcacccttgccatgaacgccttctacacgttcgtgtcgcgcaacgatatccaggaatggtcggaaggcatcgggcagattcccacgcccaatatcgttgggcagagcgaggttcccgcgcttcaaccgggagcttcggcgaacgtgcacatcgacgcggactcgaatcaggagacgctggcgtccgtcaactcctgggggccgaaaccggtcacgctcagttatgaggccaatggcgttcaacaagacgaagcgcacactttcgcaacacggaccggagctggaatcaatacccccgacacgcccgcgatgaatatcaccatcgtgcagccgctcgaagcgcaaggatggaccaccgacaacaccatgctggaacagctcgtcaacaaaggtggcgtcacctccgcggaactctcgaaaatcgccgttcccggcaaagaagacgaggcacgactcaagtcgctggaacagacgttcaccaagcatgacaaactgcaggtggtggccgatccaacctatctgaaggcgatgccgatgccgacgcaagtcgacggcatcacgcaaccggccctgttcgacatcaccgcctattccgcgctgaacgacagcaaaacctatgattcggcaggcgtcggcacctcgcaatggaacgccgaacaggccttgaaaaactatcaatcggcgttgggtgacccgaacgcgagtatgaccacgtatgcatggcagggcaccggcaattggaccgccgacgcgctggcgaaagccaagcagcaggggtacgacaccgtcatcgccacgcatgatttcgaagaggatgatgcggccaccgcggaaaccggcaagaccgtagtaaccaccgacgccggcgacatcaccgtactgaccgcgcaaagcgtgctttccaaccttgcacaaggcaaggcgaccagtgccgacgccgaagcggacggcgagggaacaacggccgggcgtctcgcgcgattcgtcgcgcaaagcgcgttctaccagatggagcagccgtattcggaacgcaatctgctggtctgcctgaacggcaactctgatccggccgtcgtggacgcactgatgacggacgtcgaacaatcgccatggctgaacatcaccgatctgaacacgctcaacaacgccgaccccgccttgagcggcgacgatgcagcctcgatcgtgccgcaatccgacggaatcaatgatgcgacgcaagccaatctcaggcagacgctcaacacactggcagcctcgacaaacgacatcaaacgattcaacgcatccatcctcaccgacgtcgccgacgatgccaagcagacccccgcaggcctcaaagcgtggcgcaggcagctcgtcaacgcgcacggcatcatggccctgcacgcgctaggcggcgaaaatccagccggaagcaccatggtggaaggagccgggcaactggcgtccctgctcatcaacggcgtggccatcacaccgacggaaaacgtcaacgtggtcagcgaaaccgcgcaaatgcccgttaccatcagcaacagccacccctatccggtcacggtaaaagtctcatcattgaccaactccatgcagatcgtcacttcgcgtttcgacaccgtggaagtgcccgcgcacagcgaagcccaagtggcgttcaccatccgcgtggccacctccggcaccgcggacgccacgctcagcctgcaggacaggcagggcatcacattcggagcgacacaaaccacccacatcaccagcgcattgcagatcagcgacaaaaccggcttcatcatcatcggcatcgccgtgctgcttggagctttgggactgtggcgccaattccaccgtaagaaggatccagacgaatgagttcttccgttggccgtaattcactgatcatggcctccggcaccgcggcctcgcgcgtgaccgggcaaatccgtaccattctgctcgcttgggctttaggcaccaccggctatgcggcgaacgcctaccaagccggatccatgattccgcaggtgatctacaccttggtttccggcggtattttcaacgccgtgctcgtgccgcagatcgtgcgcacgttgaaggcaaaagacgccgaaaccaaactcaacaagctcatcacgcttgccatcaccatgctgttggcggtgacgatcctgatggccctatgcacgccgctgctcaccaagctgtatgtgaacggtagccccgaaaccatggcgttggcgacctcattcaccctgtggtgcatgccgcagatcttcttctacggcctatatacggtggtcggccagattctcgcggccaaagaccatttcactgcgtatgcgtggagttccgtgggtgcgaacatcatcagctgcatcggcttcggcacgttcatcgcgctattcggccgtgccaccgagcatccgcttgatttttggaccgccgacaaaatcgccctgaccgcaggcacgtggacgttgggcgtggcattccaggcgctggtactgttcattccactgaccaaaatcggattgaaataccgccccatcttcggccttcgtggcattggattgcgttccatgggaccggtcgcggcttggagtgtcggcattgtcgtaatcgaccagctcgccaatatcgtaatcacgcgtacctccactaacgcgccgatgctcgcgcagcagcagttcggcatcaatccgctctacgtggccggcaatgcttcataccagaacgcgtacacgatttacatgttgccgtattcgctgattgccgtttcgctggcaaccgcgattttcccgaaaatatcccgtgcggtcgccgatcataatatcgccgaagcgcgcatcgatctcagccaggcgctgcgcaatatgggtgtgatcatgtgctatttcgcggtcgctttcgtggtgatgcccgttccgatcattctcgcgttgctgccgtctgtgagcgtcagagaggcgattcttatggcgggaccgttggtcacgcttggcgtgggacttccgttcgccagcgcgtatctgattatccagcgcacgttctatgcattcgaagacggcaaatcgccgttcattttcatgctgttcgccatgggcattcaagcggtaagcgtgatcatcggcgcgaaactactcccccctaccgaatggacgacaatgatcggcatggtaggagccatgagctacatactgccgatccccatcctgtatgccatgctgcgcaaacgattcgaaaacaatatcgacggtccgcgcatagccatctcgtatctgaaatcgattggcgcggcagtagctaccatgttcatcggcgtgacggtacgtgacagcgtctaccagcttgtcggcgcccaaatcggagcggtggacggtcatatgaactggattcaggcagtggcgtgtgccgcactgctggccatagtggccttcatcgtttacgtaggcatgttgcggctgctacgttccgaggaattcaaggaggcgatcgcactgatttcctcacgtattcccggacttcgcaagccgaccagccccaacgatagactggaacaggacgacgccgaaaacggcgagtgaccataggcagaacaaacgtttacaaaaagttgaaggaacccatgaaacctcagctgggagataccatcagcaatcgctacgtgctcgtttcgccattgcgcgaagaaaccggactgcaggtctggaaggccagcgaccatgtgctcgcacgggattgccagctgtttattgtcagcagcagcaaggcattgcaggaagtcaacgcaaccgcttccatgctggctatttcgcatgattcccacttcacgaaagtgctgcagctccagcatgccggccaggtcgcgctggtggtgacgcagcttgacgaaggcatgaccctcagtgaatatcttgcgctgaacgccaaccagccgttgagctatacagccatgcgctccatcattggcgaagtcatcgaatcattgcatgcgctgcaaaaagacaatctcacgcatttctccatcagcaccgacacggtgcgactgacccgttccggcattcagatcgcagatgctccagtgagcatcatgcttgccgacacttcccgcgcgcaggctttggaaaatcgggaacagcttgcgatccgtcaaatctcagcgctgttgtacgctatgctgatccgacgcccgtccacgctgtcgacggatttccgtcttgaagcgctcgcgccgaccacgccgatggaattccgcgtgatctgcaagcgcggtctcgaacttgaagaggacgacggcttccccaccgttccgatggcaaccattgcggaattggaagcgttgcttggcgagtaccaaccgctgtcatcgttgggaagcatggatatcacgttgccttccatggattcggaatgctcaatcgccaatgttccgttactgcagattcttgagaaggatgtgctcccgctgccggatacgctggcagcggctggaagcattccggaaatgacgttcacggctcccgaaccgcataacgatttttccgatggcaaggaggctttggcgaaaagcgtcgcggccaccagtggagcggtgaaatcgttgtggagcagcggccgtgaactgctgagcgaagaagacatcgatggcgtgaccgacaccagcgattctcccttctccttccccatcagggtttccgtaccggacgatggcatgtcatccgacgattcccagttggaaaaaaccggtcgcattccagtgatcggcgcggatggtcaggtcattcagcccggcgaggagtccgcccgtgcgttgaaagcagagcaggaggcgatcgatgccgcgtatgccgccggtcgagccgcggttccgccgagcttcacgccaaagaatccttcttccgcttcggcgaatactgacgttgccgacgcgaaactgtttggcaagctgaaaacgaaggtcgttgcgattatcgtggcggtcatcgttgttgcggttgcgcttgggtttgcagttcatggtttgatgcagccttcagattcggttacgactgattcaaaaggaccatggccggaaataaatcttgacgaagtgccgttcggcgagggagatcagtcggatgcgaattccgcggattcttccaattccgatacgtccggcaataccgattcgtccaattccaaggattcttccgatgcttccgccaatacgccggcatccggcgagtctacggcgtccaagcaacccaagaaaaccgaggacaaggtcgtgaccgccgataagcagtcgaagaaagtgccggatccgaagcagccggaaaacacgaccgcgtacgaaatcgacaatcgtcaattcctgtcgaatcctgacggacagcagggctacggatattacgtgcatctgagccagccgcagaaggcgtatcgcatggtcatcaaaattcgttcttccggtggtcagggatatattcgcgtgaatgcgacaaacagcccgtcccaaggcgaacaggtggcgcagttcaagtttgacgcttccggcacgaccgacatcaagttcgacaaggccgtggaaacgcaggacatcatgctgtgggtcccacttgatagcctgccgggcaaccagctgtacatcgaaagcattcaagtgttctgatcgtcagcacatcgcaatatccgattacttctgaagattgcgatacgaaaagagcctgccatgcgtcacctcacgtatggcaggctcttttcgtatttatttttggaatatggtcgtagtcgaaaagcgatggaacttggctcaagaatcgacaaccaacttttcgccatttttatcactctgatgtcagaactctaatgtcagattcgggagcttgctcgcggatgattttatgctgcgcgacggctacccccgtctctacagttccgaaatgccgcttgaactcttcttttcgtcatatctcagcacatatgtcgagcgagacgtggccggttatctcaatgtgcgaaacgtgaccgctttccacaaattcctgcgtctttgcgctctgagcggcgctttgtggcggctcgcgtggaatcaagttttcaagccaaagacgagcaggtatattccgccgcagactggctgacgcgctgaaacgtctaccccagcattagtctgacccatgatctggtttggctgacctcatgattgtgatctggcgacctcacgatttcaatcggggacactcttttccagatcgtgaggtcgccaaaacaaaatcatgaggccagatagaagaaatcgtgcggtcaactgacaaatcatgcggtcgctcacataatcccgtccgcacaacccgcacctaaaaccgattaccagagtcacacggacggaatcgcagctaccgccagcacaccccttactccggccaggattcgaagagggtgaggagcgtttcaacgttggtgtcgctccaactgtcgattctgggaccagcatacgtactgttgtacggctgatcgaacacgaccacatgctgccctgcctcacgcaaagtttcgatattcgccggcgaatcgtcaatatgaatcgtggcctgcatactgtctttcagcccagtaaagcacagactcatgtacggaatgcggttgctgtccagccattgcgcagtgtcggaaacgaccatctgatgctggccggacacgaacagccggtgcgtgacaatgcgaatgtacacgtgctcattcgccaatcgctgcaatgcctgcgcgacccccggaagcggcttcatcgtcgcatacagatgctcacgctccgcggctttgtgcgtttcgatgtaatcgtcgagcgtctcgaacggccatccgtcctcgcgcgtgagattgtaatgcgcggtctgcagcgcacgttccggcacgtcaatgccctgccgctgcaggtaatcgcggatcgcgcccttgtaatccgcgcaaacgccgtccaaatcgagattgagcacgcgatatccctgcacgcccacgcgctggctctcatattgttcaggaatagtcgccatatcacgttcctttcttatgcccgacaccaatcagcctgtcgaacagccacaccaatcagcccagcccaatcagcccgatatcaatcaatgtaacctgacattcgccggcaacaagcgcaaatactcccgcaaataaggaagatagaaaatggatagaacaatgccgaccttgcgaaaagtcttacgggagaacgattttgagactttcatagaaaagatagaaaagatagaaaatctgaagatcgcgccgtttcttttgcgacggcaatactgccctgcaatcgacgattgatgttcatcacagcatcgttacgtttatttcaagattagccgatgaaaatacaaaagaatcgacgatcgttgcatgacatcgacggttgagcctgcctatgatgaaggcacaacagaacaaagagacacgatgcggcaggaaccggagagaaaaccggagccgcaccccacacgcggggaaacggcaacgccacccgcgctgaacgtaaccaaaaagcaacagacttacggcagcggccagaggaaagaacagaaaacaagaacgccgccaagccgaacgaaaggaaacatcatgaagaacaacactttcaaccagatcatcaacgccaacctcgcttccgtcgatccgggcttcggccagttcgcactcgccaaggccagcgccgatctgttcaagaaggtcatcaacaagtgatccaaggcccgcacaggcaggcgtcacattaacacgaccgaagggcttgcgctccatgtggagcgcaagccctttctcatgttccgatcaagcgacgccaagaatccagccaccccagcaactgcacacacagcaccgcacgcaaccacgcacaacagctggtgtttcacgtgaaactctgtagatgatccagcttggaaagcacttgataatacgccataagaaaaaggaatgcgtgaaatcgtgcagtgcgcggctggttgctttggtggttcgctacagtgggaatatgagtgatttgcgagatgtgattattgtcggatccggccctgccggatataccgcggccatatacttgggccgggctggattcaaaccactggtcatcgcgggtgcgctgaccccaggcgggcagctcgtcaacaccactgaagtggagaattttccgggtttccccgacggcgttatgggaccggaactcatggataatatgcaacgccaggctgagaagttcggcgcggaaatcgtttgggatgatgttgtttccgtgagcaacaatgacgtcaccggcgtgaaaaccgtgagcgtcgatcagggagacgtttttgaaacccatgctttgatcatcgcaaccggatcggaatatcgcaaactcgacatccccggagaggcggaatattccggcaagggagtgtcatattgcgcgacctgcgacggcttcttcttccgagataagccgattattgtggtcggcggcggcgatagcgcattcaccgaggctgattttctttcacgatttggatcgtcggtgacgttgattcatcgtcgttctgaattccgcgcatcgcagattctcgtggaacgcgctcagcagaatccgaagatcaccatcgtcacggattccgtggtggaggaaatcttgggtgacgacaatggagcccaatccgtgaacattcgcaacgtcatcaccggagagaccagcacgattgccgcaaacggcatttttgtggcgatcggccactcccccgccacagcttttattgacggcattgtgcagcgagatgcgggtggatatattcaggtggacggcgccagcacacgcaccagcactgccggcatttttgcagccggcgactgtgttgatagtatttaccgtcaagcgatcagtgccgccggcatgggctgccgggccgccctcgatgcccaagcctacctccagcagtaacacttcccatcacggtcataccctacaaaaacttgaaaaacgagcggaaggggcggcatattctgttcacgactgtaagcttggccaaacggccttgagtgtgtcgtgaacagaatatgccgccccttccgcggacaccaaaaaacttaagaaatactatttttcggcagtgggcatgagcaggtcgacaatgcgcttcatgtcgtcttcggatttgaacacgatttcgatgcgtccatgctccttggatcccttgatcgacaccttcgtgccgaacctcttttcaagaccgacctgcatcggcgttccggcccaagggttcagcttgttggttttcgctttcttcggctggtccgattcagcgaccttcatcgacacgatttcctcggtgctgcgtaccgacaacccttcggaaataatgcgcgtcgcaagctgttccatgtcagcttccgtcggtaatccgagcaatgcgcgcgcatgaccggccgacagcaagccggaagcaaccttcttttgcacggtcgcaggcagattcagcagtcgcagagtattggcgatttgcggacgcgacttcgacaccgactttgacaattgcgcctgcgtcaagccaaaatcgtcgatcatctgctgataggcggccgcctcttccaatggattcaacgcaacgcgatgcaggttttccagcaaagcgtcacgcaacatatcgtcgtcggcagtggttttgacaatcgcaggaatcgttttcaaacctgcgatctgcgatgcgcgccaacgacgttcacccataatgagctcgtacatgctatccatgcgcccgtcgaacatattgtgcgactcggcatctttagcggcgttctccttgcgagcagcctcaatctgcgcgagtggacgcttccgtacgacaataggctgcagcacgccgacttctttgatggaatcggcaagctcacgaagatcatcctcatcgaaaatggtacgcggctgatgcaggttcggtccaacatcactcagtcgcaattcaacgagataaccgccctgcaccggcaacagttcaggttcgtcattcttcttatcttcggtcttttttaccgcagcggtttcacgtgaaacactttcctgcttcacttcggaagtggcaacaggactggtggaaccgaagaacatgtcggcaggatgagcagtctcattcaacgtgatggaaggcatactggctcgatggccactccccttcttggtttcacgtgaaacgttcttcttcatgtcatggacggcatcgacggaagccttggcggttgccacggaactcttgaccgcggtcttccccgcggattgcccggcaacagtcgcaccaccggctacgttttctgaaacctttccagcgatcttgttatcagcctttgcacccgcaacagccacagccggttcagtagcggcttccgatttcgccgactctcctggaagagacggaaacagtgcgccgagacccttgcctaaacgtgatttcgtagccatgatcagttctcattccttcttgcatcgatagccttcagcaccgtctgcgagcgacgtgcgatttccaatgcggcctcacaataggcaatcgctcccattcccttgggatcgtaggcgatcacgctttgattgaagcttggagcttccgatattttcaccgttcggggaatcgtggtattcagtacgatagtcggataatgatttttgacttcgtcatgcacttcacggctgagtaacgtcctcttatcgaacatggtgatcagcatggtggaaaccagcagcgacggattgaaatgctcctgcaccagtccgatggtattgatgagctggccgagaccttccagcgcatagtactcagcctggatcggaatcagcatctcatgcaccgcacacatggcattaattaccagcaggccgaggcttggcgggcaatcgataatcacgtagtcgtagtgctcctcgctggtttccagaaactcgtcaaccgcggtcttcagaagcacattacgattttccatgtcggcgacttccagctcggcaccgctcaaatcgatcgaagctggaaccacatcgagcagatcaaaatcagggcatgtgcgcttgacttcggcgatggtcttcctgccttcgatcacgtcgtacaccgaaggctcccccgacgcatgcggagcgcccaacgcggtcgacgcattgccctgcggatccatatcgatcagcagcaccttggaaccgaactgagccaacgcagcggaaagattcacggccgacgtggttttgccaacgccacccttctggttggcgaccgcgatcaggcgcgtctgctccggctttgggcaaacggccttctgcaaggcgcgatagcgagtcgattcgtcggcaatctgcgaaccaagaggggaatccgatcctccgaaaattcgtttgatggtttccgttgccgattccatcgatgtcaggttatctggtccttcaggtccagtcatacactagccttccttacgatatgcttaacattcaagtttcatcattcgggtggacagaatcagctcatctcacccactgtgcacaaatgtgaatagctgtggatagtcggtggataacttacgttgttcgcaaaaagttatccaccgatctttcgttgctacttcaacatttttccgccgctttttttagtcgattttccagttgtggacaatgtgcataactcaccgaaatggtggataacttactttttatccaccatgagcacatgggtcgattccaagcccggaccaacctcggcatccaccacccgcggacgaatgccaccgcatttggcgatctctttggaagccttttcgatctcctcttgcgcggaccgccccttcagtgcgaccaaacgtccaccgcgctcaagcaacggcagcgtccaccccgaaagtttggtcataggagccacggcacggcacgtcaccacggcaaacggacgtttcgcctgaataggcttgccatccaaatccagtacaggaccgcgaacggccactcccctgccgttcttgccgcctttgccgttcctggcgctgccattgccacgattgccgccttgagcgccagcagcacccgcaatggcctcgatcatctcattggccctggcacgcaccacggtaacgttattcaactccatatcggccacgcactcgttcagccattcgacacgacgttccatcggctccacaagcgtgaaccggtgatccggcaggcaggcggccgcgacaataccgggaaaaccgccgccactgccgatatcggcaaccgtcttgaactgctccttggccgtggcttcctttacgaaaggcacaatggcggccgaattcagaatatggcgttcccaaataatgccaacatctcttggcccaatcagaccgcgaggttcgccttcttcggcaagtttcgcatggaaaacacgaagcttgcccaacgcatcccccagcacttcctcaagcatcggcgaatcatcaagttcgtctgtcacatcactcatgggcaccatcctatatcctgctcttcctcattgccggtattccagcaagtactttccgaccattgacggcaatatcacatgtccggcgcacagccagcatgaagtcactcaaaaaatcgcaaaaaaaagcgccaccaaatggtgacgccatgtttcacgtgaaacgagccgaactcaggcctcatcctcgtcttcagcatcttcggcagcggaagccttgagatacaccgtgacgtaacgacgcggttcctcgccgtgggaacgggacttcatgccctcctcacgcaccacatcatgcacgatcttgcgttcgaaggagttcatcggcttgagatcaaccggctcccccgtctcgcgcacctcgtcgatggcgtccagcgcgatgtcgtgcagacgctggcgcttgcgcttcagatagccgtcgacgtccacaatgagatgggaacgctcgccggtcttctgctgcacggccagtcgcgtcagctgctgcagagcgtcaacgacttcgccgttgcgtccgatgagatgcttgatgtccgtatcatcatcggcgacgatttgcacggtagggcgattgttgcgcacgcccatttcgatatcgccttcgtaatcgacgatatcaagcagtccttcaagataatcggcagcgatatcagcttcctcgttgagctgatcgatggtcttttcctcatcttgcgccatagtggttgtactcctttgagcggggtttctattactaaagtcttattgtgtaaagtctaattcctgtttaccacgtcgacaataaacgctgataaaagtggtgtgtcccgcgtttcacgtgaaacacgggacacacttttactcacttctttttctttttacggctcggctgctgacgctggtagccgctcttttccttcacttcggcggcttccttggccttctgcagcgcctcttcctcgagggatggcagaccggccttggctcggcgggcgttctcatgaacatgatcacgcttttccttcgcttcggcggccggagatcccggagtcgggaagacgtggatctgccagatggaacgcaacagattgcagatgttgttggtgagccagtacaccagcacagcgaacggcatggcaataccggagaaaatgtacatgatcgggaacatccacaacatcatcttctgcatcatttcggtctgcttgtttgccgcagactgagccatgttacgcttcatgctgttgtactgcatgaaccacaggcagaagcacatcaatgcaacgaagatggcgataactactttgccatgcacggcggcggtcgtgaagttatcagccacgttcacaccgaacactgtggtggacgtgaactgcttggctgtggcgatgtcgaaagcgccaagaccctgtccgtccctgaatttgccgcgtgcgatgtacggaatggctgacagcgtatagaacatgcacatgaatacgggaccctgcacgaacatagggagcatggaagtgcagccacccatcgggttcgcatcattgtcctggtagagcttcatcatctcgcgctgcatggcttccttgctggcgggatcgttcttgcccttgtatttgttttggatacgctgcatctttggctgcaggacggtcatctgggcctgcatcttgcgcatacccttcatggacttgtagaacagcggaaaaacgcatgcctggaccacaagtactaggaatacgatggacatgacccacgagaaaccgatctcgttcatgcccagcatcaccaggaacttatggaatacggccatgatctgcgtcatgagccactcgacgggatacaggagcttatacagccagccccagaaaccgctgtcgaggaggaattgattttgattcattacaggccagtctccttatcgcctataggtttttctacgttcagaggcgtgagccgaggttcctcgtgtgtcttcgaccacgaacatctgtaaaacaaggaataaagctgcggaacgtcgtcaattcccccacggttccactgattgcagcgaagaaggcgcaataacgcaagaaggccacccttaaggcggccaaatcgttcaatcgcctgaatcgcgtaattggaacaacttggataatatctgcagcaaggcgcggtattcgcggaaatatgacgttggtaccagcgaatggcacgaatcatccaatttccgttacgaccggcgttcattaccgacgcacggccttacgattcaccgcttcaaaacatgctgcgatctgctgttccaacgatagaaaatcggcatgcgcagcacttggcttggcacgcaacacgatatcgcaggattcaggtaaggcagattcgtactttcgtgcaagcacgcggaaacgacgcttgacggcattacgcgtcacagcgttgccgacagccttggaaacggccaaaccgacacgtcggccccgcatcgccgcagaatcgtcgataatggcatcgtcgtgcaccaaataatgcacgacgatgtcttctcgcgataccctacgacggcgtttgagcaccgcgacgaaatcgcgatggcttttcagccgttccaccgctctatgccgttaaatcaggcagcgagggacttgcggcccttggcgcggcgacggttgatcagagcgcggcctgcgcgggtgcgcatgcgctgacggaaaccgtgcttcatgtgacgacgacggttgttcggctggaatgtcctcttcataattaatgctcccggtgttttttgccatgccaaggcacggctcctcatgagtcaagctctaccaagttactctgacccctgaacagagatgaatacgcatatcaaatccttcacattttcatggggattctccccacaaaacaatccacagaaacgttggtatgtcgccaaactccccacaaaagttatccacaaactacaatgatgttattcacaattcagtcttttcaacacgcttaccggtggataacttggggaaaagagagtacaaataaacagttgcacacttggaaaaagtctgtcgagaaaggggaatccgtggccgacacgacaactgaccctctcgagcaggctcggggagtctggtccgacgcgctggcgttgttgcaccagaatccggcgctgtccatccgagataaaagctggctggaaaacgtttttcccgaaggcatgtggggtcctaccattgtcttatgcgtgccaagcgcggccgcacagcagacgttgcagaacgaattgaaccagcccctgctggaagccttgcgggaagccgccgaacaggatattttccccgcattcaagattgtggaaaagaaggaaccggcccaacctgccgtcgaggaatacccccacttctcccccgcgccacatgcggaggaaaccacgcaggggcagctgccgattccggttgttatgccgccggagcgccacaacaacttccaacgcggccaaaacaggcctctgctggatcctaagacccatttgaataagaacgccacgttcgacaccttcgttcctggcgattccaatcgtttcgcacgtaccgtcgcgttggccgtcgcggaaggttccggtcacgatttcaacccgctttgtatttacggcggatcaggattgggtaaaacccacttgctgaacgccatcggcaattacgcactggtcaaggatcccacgctgaaagtccgttatgtgaccagtgaggaattcaccaacgaattcatcgaagcgttgggcgacaccaaccagaattccggtcaaatcaaggaattcaaccgtcgctaccgcgaagtcgacgtgctgctcatcgacgatattcaatttctgagcggcaaggacgcgacgcttgaacagttcttccatacattcaataccctgcatcaggcgaacaagcgcattgtgatcgcatccgatgtgcctccgaaggatctgcagggattcaacgaacgtctgatctcccgtttcgaatccggcctgaccgttgacgtcaagccgccggatctggagacgcgcatcgccattctgcgcatgatcgcccacggcaccaacgttcaggacgatgtgctcaacctcatcgcggagcggttcaccgagaatattcgcgagctggaaggcgcgctgaaccgcgtgaccgccatggcatcgctgagcggccagccggtgacccgcgcgttggcggaacagacgttgcaggactttttctcgaccgatgtggagatcaagcccaccgacatcatcacccaggtggccaagtacttctacattacgttcgatgacattgtcggacgttcgcgtacgaagaagatcgcgctggcgcgtcagatcgccatgtatttggtgcgtgagctcaccagcatgagcctgaacgacatcggccaggtgtttggcggcaaggaccacaccacggtgatgcatgcatacacccgcatcagcgacgagatgcaggaaaagcaggagatctacaactacgtgacggaactgaccctgcagctcaagcagcgttccggcgaaaaataacgttttctatgcgactttgcgcgtttgcatgtgtttccgtgcgtctcaaaaaaacgattttaggcgttttctgcctttctcaggcgattttcacaagccaagtatgagtatcagtaaattctttatcagctgttttaccgaccatcctgacacgccggcctgtggaagattttcattgaagttatccacatggttatacacaaatcaatgatttctcggtggaaaacccgttggaaacgccagaatcgccggtggatgaattgtggactatccacatggttttgtggataactttttcaaagcgacgaggctgtggataacccgatgatttgtccacacttcgtccaaaagttatccacaagcaatgagatgttgcgagccattgcaaaacgtggggtctgagcacttacccacattatccacaggccttattatgacgaatgtaggttgttataagaaattcatcatcgtcgtcataagtggggaattccccacgcttcgtcaaacgccgacagtctcgctagaatgacttatggaccgaacgaaacgaggaaactagccatgaaagttgaagtcaattcccaagcgctggcagacgcagtagcctggaccactcgcgtgatcgacgctcgtcctgcatcccccattttggcaggcattcgcttggaggccatcgacggcaccctccagctttccgccttcaattacgccatttccgcacgccaccatatcgaagcaggcgttgatgaaagcggatccattctggtgctcggcaagctgctggcagatatcaccaagtcgcttcccgccgcgaaaacctacctatccactgacggatccacactgaccatcacgtcgggcaagtccaccttcaccatgcagctcatgccggataacgaatatccggatctgccggtggttcccgccaaactggggcaggtggacgcccaaaccttcgcacaggccgttgcccaggcgtccgtcgccgtttcccgcgaggagaaccgtccggtactgaccggcattcgtgtgcagttccaaggcaacaaggtgatcatgagctccaccgaccgattccgcttgtcgcgttcgagcttcacctggacgccggaaaacccggacatcaacaccaccgcactcgtgcgcggcgcactgttgcgcgatgtggcccgttccttggacgagcatcaaaacatcgtcgtggatttcgatccggagaatccgtcgctgctgggctttgagaacgccggacgcgtatccacctcgcagctgatcgacggcgaattccccgcggtggaccgcctgtacgctgacgaatacccgattcatgcggtcatcaacaagcaggatctcatcagcgccatcaagcgcgtgtccctcgtggccgaacgcaacgctccgatccgcatggccttcaccagccaggaactcacgctgaccgcaggctcggtggatgaagcccaagccaaggagatcctcgacatcgacatggatggcgaagacatcaccgtggccttcaatcccgcctacctgatcgaaggtctgagcgccatcagcgagccgttcgtacgcatgaagatgaccaccgcggtcaagccggtggaattcaacggccagcaggaatcgaattccgaagaatccatggactaccgctacctgctcgtgccgatgcgcttcaacagctgaactaagctgacctacacgaaaacgcggatacatcgcaaaaaatagggctgaacatggctgttattgccagttcagcccatttgcatgattaattgcgattatttacgtaagaaattcgcactatctcaaggatcttgcatgtatatttcccgactggcactcgaccactatcgatcgtgggaacattgcgtgctcgatttcaaaccgggaatcaacattctgcaaggtgccaacggactcggcaaaaccaatatcgtggaagccatcgaagtgctttccacaggatccagccatcgcgcgtcatcatcactgccattaatcgaaaaagggtgcacgtcggccaccatccgagccaacgtggaagacagtgaaacgcagcacacctacgaggcgaccatcgtggcacggggtgctaaccgagcgcgcatcgacggcggaaaatctcaatatatgagggatctcatcgggcgcacgccctccgtctcctttacccccgaagatcaacgtctggtagcaggggatcccgcaacccgacgcaacttcatcaaccaggccgcgtctctgctgctcccccactatgcgcagaccctgcaacagttcacgcacgtggcgaaacagcgcacggcactgctcaaacaactcggcgacggcacgaatctcgacccgcaatacggccagcaggcggtcttaagcgggctggaaatctggacggggcaattcatcgacctcggcatgcagctgacgcgggaccgcaacaacgtgatctcacgcttggaagagccttttgcgcggatctacgcgtctttggcgggagatgacgaacgggcggcgctcgcctacgagccgtccttcgacgaagtgatgctgttcgacgatccggccgcggagatcagccgccatttccaacgcatctaccccggcgaagtggcgcgcgggcagaatctgatcggtccgcatcgcgacgacctgactttgctgctcaacgatatgaacgcacgcgaattcgcgtccaacggtgagatgtggaccatggctttggcgttgaaaatggcgctatatgaggcggtttccgcacattttgaaagcaagccaatcgtgattctcgatgatgtgttcgcacagcttgacgaggcccgtcgtgggcagatcctcgattttgcgatgcggcaggaccaggtgctgatcaccgtcgccgcggcaagcgatattccgcgcatggatgctgggcgctttcacgcggacgcgcatgtgatcgacgtggccgcgttgcgcaggcaatcgcaagatggacagcatgacgatttgacggcgatgatggcgcaacttgtcgcgggacgggaatctgcaacgcaatcgtctgcagcgcaacagtcggtgaatcgacaggagcagcgctgatgccgaatcctccaatctgcgaaacattgcatctcgaccaacgcaagttgcccgccgaagtattcgaacgtatcagccgacgtgccggccgatataaggaacgtgaggaacgtgcgcggcaggcgtgggagaatttcggcaaacccggacgcgacccgcagacggtcggcaatattttcaacgtgatcgcaacgcaaggttcttggacgccgcatctgaaaatcgcgcagatgcagaatcattgggatcaggtggtcggcgtcgaaaacgcgcgccactcctaccccgtcgacctgcgcgacggcattctgacgatccgatgcgacagccccgcatggaccaccaccttgacgtacatgattccgctgctgaccgacaccattcgccgtaggctcgaggggctgaccatcaacgaggtgcgcgtcaccggcccgcaacaacagggattcagccgaggacgaatgacacgaaggccgcgatattagcgcgacaccacgtgctatcagacgttcgttgaaggcgcttcgtcgaagaattccccctgcgacgcttccaagcgggccgttcgcaacggtcgaatgttgttttccgaaagcgaaaaaacaggggtaaacggctgaatttcaaggataaatgcctctggtgcgctgtccccctgcatgagtagaatatcaagtagtgtatgtaaacgcctagaaggggcctttatttgcgttctaggtggtatcacctgcgtgaatgaccctcattggcgggaaaaatgcaggaaggaatctctgtggcagaccttgatgcggattcgctgaacgaatcagctgaaaacacgcaggaagatcagatccaaaacgatcagctcgaagatgcgcagctcgacgacaccttggctccggagcattacgacgcgtccgatctgagggttctggaaggccttgaggcggtgcgaatccgcccgggcatgtacatcggctccaccggcccccgtggcctgcaccacctggtgtatgagatcgtcgacaactccgtcgacgaagcgctggcgggctatgcctcgcatatcgaagtgacgattctgccggacggcggcgtgcgcgtggtcgatgatggccgaggcattccggtcgacgaagtgccgggcgaaggcgtttccggtgtggaaaccgtgatgaccaagctgcatgccggcggcaagttcggtggcggcggctatgcggtttccggcggtctgcacggcgtgggcatctccgtggtgaacgcgctgtcgacccgcgtcgacatcgaagtgcgccgacagggcttccactggacccagacctacatcgaccagaagccgaccgcacgtcttgccaagggcgagccgatgggcgaagacgagtccaccggcacttccgtgaccttctgggcagacggcgcgatcttcgaaaccaccacctacgatttcgagattctgcgtaaccgcttccagcagatggcattcctcaacaaggggctgaaactgtccctgaccgatttgcgcgaaccggatcaggccggagacgaagtcgcgggcgaaagcgacgacaatgccgaaccgaagcatcagacggtcacctaccaatacaacgacggcatcaaggattatgtcgattacttggtgaagtcccgcaaggcaaccccggtcgaaccggacgtgatcgatttcgaagcggaagatctgaaaatcggcatttccgcggaaatcgccatgcagtggaccaccgcatactccgaagcggtgcacaccttcgccaacaccatctccaccaccgaaggcggcacccacgaagaaggcttccgtgcggctctgacttcgctcgtcaatcgttacgcacgtgagaagaacatcctcaaagacaaggatgagaacctctccggcgacgacgtgcgcgaaggcctgaccgcagtggtgtcggtgaagctcaccaccccgcagttcgaaggccagaccaagaccaagctcggcaattccgaagcgaaaaccttcgtgcagcgcgtgatgaccgacaagctcggcgactggttcgattcgcatcctagcgaagccaagaacatcatccagaaggccattgaagcctcccgtgcgcgtcttgcagccaagaaggcacgtgagaatacccgccgcaagtcaatcttcgaatccgcgggcatgccagacaaactgaaggattgccagtccaacaatcctgaagaatgcgaactgttcatcgtggagggtgactccgcaggcggctccgcaattcagggacgcaacccgatcacgcaggccattctgccgctgcgaggcaaaatcctcaacaccgagcgtgcaagccttgaccgcatgatgaagtccgaaaccatcgaatcgctgatcaccgcggtcggtggcggttacggcgaggatttcgacctgaacaaagtccgctatcacaaggtcatcatcatggccgatgctgatgtggacggcgcgcatatcgcaaccctgaatctgacgctgttcttccgctacatgcgcccgatgattaccgctggttacgtgtatgtggccatgccgccgctgtaccgactcaagtggaccaaaggcgcgcacgacttcgtgtacaccgacgccgaacgcgaccgcgtgctcgccgaaggcaaggccgccggccgtcagttgccgaagggcgaaggcatccagcgttacaagggtctgggtgaaatgagctaccaggaactgtgggaaaccaccatggatcctgaccaccgcattctgaagcaggtgcaaatcgaagacgcggctgcagccgacgaaaccttctccatgctcatgggcgacgaagtcgaacctcgccgtctgttcatccagcgcaacgcacgcaacgtcagctggatcgacgcgtagggatttcaaggacttcaggcaaggtttcataaggatttagaaggacttagaagttggcagacgaaaacaacagcaacgaagacggccagttcgtgcctgatggctccatggagccgttgagcccgcaggaggccgacaacaccgattacggcctgatggtgggcgaacgcatccagaagaaggatctgcagcaggaaatgcgcgattcctacctggcatacgccatgtccgtgatcgtggaccgtgcgctcccggacgtacgcgacggcatgaagccggtgcatcgccgtgtgatctacgcgatgtacgacggcggctaccgccccgaccgtggttactccaagtgcgcccgcgtggtcggcgaggtcatgggtaaataccatccgcacggcgatttcgcgatctacggcacgttggtgcgtatggcacagtcgtggtcgatgcgttacacgctggtcgacggccaaggcaacttcggctcccccggtgacgatccggccgcagcaatgcgttacaccgaatgccgtatggctccgctcgccatggaaatggtgcgcgacatcgacaaagacaccgtcgatttcctgccgaactacgatggcaagacgcaggagccgaccgtgcttccggcacgattcccgaacctgttgtgcaatggttcgtctggcatcgccgtgggtatggccaccaacattcctccgcacaacatgcgtgaagtggccgaaggcgtgcattgggcgcttgaccacccggacgcaagccgcgaagagctgctcgaaaacctgatccgcatcatcaagggaccggacttccctactggtgcaacgattctcggacataagggcattgaacaggcctaccgtaccggccgtggtttgatcaccatgcgcgcggttgtgaacaccgaagagatcaagggccgtatgtgcctcgtgatcaccgaactgccgtatcaggtgaacccggaccgactggtcgtttccatccgcgaagcggtgcgtgacggcaagatccagggcatcgccgacatgcgtgacgaaacctccggccgtaccggacagcgtctcgtgctcgtgctcaagcgcgacgccgtgccgaaggttgtgctcaacaacctgtacaagcattcccagctgcagcagaccttcggtgccaacatgctggcactggtcgatggagtgccacgtacgctgtctctggacgcgttcatccgccattgggtgggccaccagctggaagtcatcgcacgccgtaccgcctacctcaagcgtgaggcggaagagcgcgaccacattctgcagggctacctgaaggctcttgacatgatcgacgaggtcatcgcgcttattcgtgcgtccgaatctgcggaagtcgcgcgtacgggccttatggacctgctggacgtggacgaagtgcaggccgacgccattctggccatgcagctgcgccgactggccgcattggaacgccagaagattctcgacgaacataacgagctgatgcgtcgtatcgccgactacaacgacattctcgccaagccggagcgtcaacgtaagatcgtgggcgacgagcttgacgaaatcgtgtccaagtatggcgacgaacgtcgaaccaagatcctgccgtactccggcgaaatgaacgtcgaagatctgatcgcggaagaaaacgtggtcgtaaccgttacacactccggtttcatcaagcgcaccaaggccgacgaataccgtgcgcagcatcgcggcggcaagggcatcaagggcgccaagctgcgcgaggacgacgtggtggaccacttcttcctcaccagcacgcacaactggctgctgttcttcaccaacaagggacgcgtgtaccgcctgaaggcgtacgagctgccggagggatcgcgcgattccaagggacagcatgtggccaacctgctgcagttcgggccggacgagacgatccagaccgtgctgtcgattccgaactacgaagtggccaagtatctggtgctcgccacccgttccggcaaggtcaagaagaccgcgctcgccgaatacgattccccgcgtcagggcggcctgatcgcagtgcgccttatgaccggcgagaacggcgagaacgccgacgagctgatcggtgccgcactgtgcaacgccgaggatgacatcattcttgtgtcgaagctgggcatgagcctgaagttccaggccaacgacgagcagctgcgcccgatgggccgtcagaccgcaggcgtgcagggcatgaagttccgcgaaggcgacgagctgctggccatggacgtggtctggggcgattccgacaaggatctgttcgtggttaccaacgagggcttcgccaagcgcaccgccatcagcgaataccgtttgcaaggccgtaacggctttggcgtcaaggccgtgcagctcgccgaaggccgtggctccctcgtgggcgcggtgatcgttgaggaagatgaccagatcatggccatcatgaagtccggcaaggtcatccgttccaacgtcgacgaggtcaagcgcaccggccgcaccacccaaggtgtgacgttcgccaagccggacaagaacgacgagatcatctccatcgcacgcaacgaggagaaggatgacgaatccgcggaatctggcgaatctgcggaaaaaacggaatccgcggaatctgggacgaacgcaaccgtgaacgagggtgcttcggcatcgtctgaagccgctactgaagccaacgctggcaacggcgatggcgagaatgtagaggcatgaagacaagacaggcaatcgtctgcgaaaactggtagcctcagctaagaactgggcacaatcttgcaaggagcaacgatgagcgagaacatcgaaggacagcaaatgccggaggttgggcaggcaccgcgcgtggcacgttccgcttccagccagccgctgattggtgcggatcaggttcaggcgcacgagggtgcctcctccgcttccggcggtgtgaaggtccgtgagaagcgtcgcggcggcgctccgcgtgcacgccgtatgagcctgtctctgacgcgtatcgatgcatggtcggccgccaaggtggcgttcatgctttccatcgcgggaggcatcattcagattgtcgcggtggctttgctgtggggcatgctgaacgtggtcggcgtgttcgaccaagttacgcagattgtgtcttccactggcttggacgctggcggattcgacctgaccaacgtgttctcgttgggcactgtgctgagcgccgtcaccatcttctccattgtggaagtggtgctgatcaccgtgctcgtggtgattttcacgctgctgtacaacgtggtgagcaccctcgtcggtggcatccacgtcacgcttggagatgattaatagcgcagtgcgctattaatggcagcgagcggcgatagcgtccgcgagcgtcgcatgcaatgctgaaatagcgcagtgcgccgtcagtagcggcgatagcaaactcaaacgcaacaagacggtctgtgtcgtgattcccatcacgacacagaccgtcttcgtattttctagaccagtctgtctcttaccgtacgccaaaccctatctgactctcccctgcctgcaatctgcccatatctgccctatatatggcagattttgccttccgacctgtaccatctcgcttatatatggcaggtcaacttgcgaaaaagccagttcgggggtatattttgggtcatttttcctaccaaggctgccatatataagcgagatatcaccgtacgaactctcaaatctgccatatataagcgagatagcggagctgcgcgagaggaagttgcggttatagctgaaactattgcgatttttagagatagtttcagttataaccggaactatcgtgattttgagtgattgtttcaaatgtaactgcacctagattgggtgcgctgaagtacgtgttgaaatacgaaaagagggcctgtctggaatgaaaccagacaggccctcaatgtatttcgatgagccagccgtattggctagattggctaaaacggctagatcagagcacgccctgggcgaccatggcgttggcgaccttcacgaagccggcagcgttggcgccgagcatcagatcaccctcgtggccgtattccttggcggcttccagagagttggcgacgatgttctccatgatggacttgagcttgccgtcaacctcttcaaaagtccaggaaaggcggtaggagttctggctcatctcaaggccggaaaccgccacgccacccgcgttcgcggccttggcggggccatagagcacgttgttggcctggtagacggcgattgcctccggagtggaaggcatgttggcgccttcgcacaccacggtgcagccgttggcgacgagagccttggcggattcctcgtcgatctcgttctgggtggcgcacggcagggcgatatcgcacggaacggtccacacgcccttgcatccctcgtgatattcggagcccggcacacgctcggcgtattccttgatgcggccgcggtggcccagcttgatgtccttgaccacgtcgagctgaatgccgttcggatcgtagatgtagccgttggaatcggaggcggtcacaaccttcgcgccgagggcctgagccttctcggtggcgaagatggccacgttgccggagccggagatgaccacggtcttgccttcgaaggaatcgttgcgcagcacgcgcattgcctcggcggtgtagtagcacaggccgtaaccggtggcttcggtacgagccagggagccgccgaattcgaggcccttgccggtcagcacgccggaatactcgtcgcggatgcgcttgtactggccgaacaggtagccgatctcgcggccgcccacgttgatatcaccggccgggacgtcggtgaactggccgatgtgacggcacagttccgtcatgaaggcctggcagaaacgcatgacttcggcgtcggacttgcccttcgggtcgaagtcggatccgcccttgccgccgcccatcggcaggctggtcagggagttcttcaggatctgctcgaagccgaggaacttgatgacgccttcgttcacgctcgggtggaagcgcagaccgcccttgtacgggccgatcgcggagttgaactggatgcggtaaccgcggttgacctgcaccttgccctcatcgtcggtccatgcgacgcggaacttcaccacgcgctccggctcgacgatgcgctcaagcacgcccgccttctcatattccggatgcttcgcaaccaccggctcgaggctttcgaaaacctcgcgaacggcctgcaggaactccggctggtcgccgtcgcgcttctcgacctgcgcgtacacgcgcttgacgtactcgtcagtgagcatattcttccccttcgggatagttgggttaccaatagacggtctcattctatgtgcacgaatatggacggcacaagaccttgttcaggatttggagacgctttttgcgagtgctggttctgaacctgcttctttttacgggattgccgtgccttgtgttgcctataggatggaaatgcggaaagcgtgggagagagtacgtccgcaataacatctcacgatctcacataatgggagaatcatcatgattgaaggatttaagaaattcattgcacgcggcaacatgatcgacatggcggtcggtgtcgtcatgggcggtgccgtcaccacagtggttaactctattgtcaataatgtgattaatccgttcatcgccatgattttcggcaaaccgaatatggatggtctgctggcaatcacattcaataatgcgacggtttcgttcggcgcggtacttggcgcgatattgaatttcctgattatcgcggcggccgtgtatttctgcattctcgtgccgatcaacaaattccgtgacgtgaccgaggcgttgctcgccaaaaccaagcttgcggaagaacggagcaaagccgaggaggaagctgccaaagagccggaaatctccaccgaagagcagacgatcctgctgttgcagcaaatccgcgacgaacttgccaggcagaatgcacggaatacacagaacgtgccgaacgattccgacactgttgccggtgcagtcgcagtgcggtagtcatcgcaagcgatcgtaagtatcgcaagcgatcgtaataatcaataattcaaggccgtttcaagcggtgacgcaagccccgcctgagacggccttttgcaatggtctttcagcggggtgattcttccatgcgctggaataatacggactctggaaggtgcctcagcgggtcatatgttccagtgactggagggatctggactgtgaggtgcttggttgcgtctagttttttccagtgactggaggttttgggatgctgggaggcttgttggtgggaggattcctccactcggtggaggtttttggactgtgaggtgcctggctgcgtccggttttctccagtgactggaggaattgggatgctggtttggatttcggatttgggtatgaaaaaagggtttccggaaatcaccggaaaccctatctgtggagctaaggggattcgaacccctgaccctctccatgccatggagatgcgctaagctaaggcctggcacggcgatggtactgcactcgagagggtgtgggagagtagcgcgccgccgcattcaacttatggaccttccggtcgagccccatcggggttcccggaaggtccttttttattcccgcgcacgggtgtcttcctccattcggtggagggaaacggacgccggaaggcccgtgggcgggaggattgttccagtgagtggaggaatcgggactactgctgattcaaccaggcgtggagtttcagatgattgagcgcggtattgggatcatacgtatcatccaagcgttcctgatacatggcaaccagttcgtcgctgcgtcccagcgcttccaaagcggcctcgcgaatcgtctcccactcgtagggcaccacttcttcggggaacatcatcgtgacctgattaggtttgtcccgcaacaccagatcgacaaaatcgagcagatcctgccaacgttcggcagcaatcagacgtgccgcatacgcatcggcgagcggttcggaagtatgattgtcacgcaggaaacgatcagcctcatcaatgtcaccactaatccgcagcaagtcatgtcgcaaaaactgtacggcatgatcgaactgattctgcgcggcctgcgcaatctccttttctgaaagcaaagcaggatcaagcatcgcgagattattcaaatcttctgcggataaggaatcagcgtcttcaaacaaacccaaatcggttttcacttgcgcaacagactgcgaatcagtttgcatgtcgcggctgtcggaatcatctgccgagtttgccaacgtcgaagcagacgtggcgaaatcactcatcgtggcaatgcccttattcaacgcatcgtaagcgaacatgcgcgtatcgtcccattgcgcgaacgacaggccgcacgaaagcagttcaaccatctgcatggcgttaagacggaaatcctcattgcaggccacttgcgtgatgatattcagcgcctgttcgccggtcatgggatcggcattgcaggccacggcgtccatgtacacgcgcacggtctgaatcaggtctttcaaatagtcgaagccctcattgtctcgatctgcgacgttgccaacgaatcgcgcggtcatttccactgccttggcgagattgccgacagcatccagccaacgtgtgcttacgatggcattgcaggccacggcgtccacgccggaaagcgcctgcgaatcaagatggaacgttggcatgtcgattcttggaatctccacgccggtatcggtgcgttcggctgtgggcaccatggcggcgatggaatcgaaataccattgcatgggcatactgattaccatgtccgcgtcggaaagctgtgctacgggcacattattgcggttttcggcatcttcctgactggcctcgcggatcatgtcgttccataggaacgtcgggccgtcggattcgccggaatgcagccatccattgttgatgtactcggtgagatcctcgacttcctgcagacggttgatcctaccgtgttcgttgctcattgcatgcctttcctttaaaaacatggattgcatgtgccgcgttgacgacgggtgcttcgtggaacaagacatatccttattcagcctatatcatgctgccgttgtcgcgcatgtttttttgctcttttcacggcgaaaagccgatgattttgaatagtcgcttgaatgctgttgcatttctttttgattgagcgaaaagattatgccgaaatactgtgtgaaacgatgtgtgaaacatgatttggaatgagcggcatggccgtacggcggcgcccggtagaatggcagtgttgccgcaacagggcggctttccatcgaaggaaaagggaatgatatgaaggttgcaagcggtaatgttctgtggcgtcagcgcaagcgtaattggtgtcgtacgccgttcacgttcaccgtgtacatgctcactgatcaggaaatgagcatcaaaaccggcatccttaacgagaaattcaatctcatcaaactattccgcatcgtggatattagtgtggagcgcacgttcctgcagcgcctgttcggtttgagcacgctggtacttgatacgcgcgaccagtcttccggcaacggtgttgtggtactgaagaacgtggtgcatggttttgaggttcgccgggtgatgcaggaggccgtggactcatcccgtaaggaaaatggcatgtcagcgcgcgaattcctcggaggtccgggcggtccggggccggaaggacctggcatgggattcgatgcgcctgatatgggcgatttgtagagacgcgcggtagtttcgtttcagcgcatacgaaaggcgcttgacttgagctggtttttctggctcgagccaagcgcctttctttttctggagagtaccgccgcggcggtatgggaatcgttatatgtcctatggggcgctcatacaacgtcctctggggcggtcagtacttgttggcgccgctgccgacgaagttgacctggaagccgcggtggtagtgcaggaacatgtcggcgccgtagcggtcgacagggcggtgggtgaacagcatacggatggcgaaagcggtctgcacgtcttccggcaggttcatgaattccttgtgcgcatcccaatacgggttcatggtgatggctgcgtccggcacataggcgtagccgtaaccgtcttcgttcacgtagcccatgaacggcaggtcccaagcgttatgcgcggtgagggctgccttgaattcctccacctgagcgagggcttcgtcgctgatgccgaggctcttggcaacctcgttggctgcggcggtcttggcgtccgcgtcctggccgaacatgttcagatccacgttgatgacggtcttttcatctgccatgatgaattcctttcctgcgatgtgttcgcataatgtcatgaacatcagtagtgttcgttttaatgttcgtttagataagcaaacgaacatcatttcttgaagtctggttcatgttgttgatggatgcttgctgtatccgtgactaacgatagcacgcttttttagctgtgataccgcggaaaatactgtttttgcaattgatgatgctgggaatcgttgatgttgcaatgattgcaggtcttgaaaatgacattgtaaaaagtaacattgagcgtgttctttttgttctgcaaaaacatgttacttttctgttcaaacgaacatctgcatatgattgtagggtggattgcacgtgtgaaaaggtggtttgaaaaggcttgagcgatcatcgacgatgcactgtgtcactttttgcggatgaggtgacattttccatgtctgaggcgtggcggccgtcggttcaacaatgacttttcgccacgtcagcaattttctggaactagaatgctgggttgccggtgaggtgacggtagagttcggggtcaaccggtttcgcgagtttcagtgtggaaatcacgacctttgattgggttccgtcatctgcgatattcactgactcatgcgcatcgtctacagctactgccgaaccgacataatagtaggatttctccttttcctcggccttacgtcgaataaaaatgggaacaaaatgacgattcttccattccgacgtatgctcggttccatcaagcagccatttgaattccggagattgcaaagaacgattgtttttgctgaaccattcaatttctccaggattcaagaaacgatcgccatactggcttgcctcatatttaatgaagatcggcaaagaattcgtgtcggtgtcaagcttatatccgcccacattctgcggaatctgctcatccttccacgcgcacaatcgcatgacatcggcaagactatatttctcgccatatatgaacccatgatccggcatgatgcgacgcttgcgagcttcccttgacagtgcaagcgcattgaacaagctggcttcgatggtatctgtaaagaacgttcggaatgttgcgtgatgcagcattgactcgcattcctgggtcaatgcatacgattcattgtcgcacatacaaaccaaagaagtattgccgaaacgagtgcgattcgcacttgtgaaatacgaataattcaatgtggaaaaagcagaaccgcactgctgaatattattatcgacatacggaaacagcgtagacaataatgtttgcaaatcaaacaaactcaagctgtgctgtgtggaaaaacgttcaaacagtgacgcatcatcgtcggaacaatccggattgatgcgacgccaatccaaatcgcacaacaccgcaagaatcagcgactcatgcgggcgcaaaccacgcaactgagtcgcagtcaacattttcagcacaccagactgcgcgtttgacaccggttcaagctgctccacatacgaagccgacgcatgcttgccgcgcgacagactcttctcacgagagaccacgaacgacagataatcgttattcttcgaagccaacgtgaacactaaagacgcatcgcgatgcgcgaaatccatcagcatcggaatacgacccaactcatagcgcatctgctgatactgcttgctcagcagcttcatatccgacaaatcagcggtatcgagtgacgcgagcacgcgctcgcgggcgattttatcgaaactgatcgaagaaatgccgatggactcgcgttgaagattcttacgggccacatcacgatcgccagtattgccatacaatgcgatcggaatcaaataattattggcgtaattgccaataaaatcaatcactacaaccgaatctttaccgcttgccttacgtaaacctcggccgagctgctgtgtgaaaataatgctcgactgcgtttgacgaagcataacaatttggttgatatgaggaatatccacaccttcattgaataaatcaacggtgaagatatagtcaagttcgccattttcagctgtttgacagcttcgtcacgttcggcttgcgagttttcgccggtaatggctttcgtgcgatacggtcgttccacctgctgattcacctgctcgttgaacatggcggacagacgtttcgcctcatcacggcgagagcagaacaccaaaccgcgcacatcggttccggcttcgctgtaaatctggattttgtcgatgatatagcgcacgcgattagggtcggtgagctgttcgagccaacgggaaaactcagtgcgatccttgtctgtcatggaatcagcggaaacctgctgccccataaacttgccgtccggcgcttccttaatgtattcgccaaccccgtaatagtggaacgggcagagcatatcctcttcaagcgcctgccgcaagcgaatctcatacgcgacgttattgccaaataattcaaaaatattcgcaccatcagtacgttccggcgttgccgtcataccaagcatgaaatcaggtgtgaaataatcaataattctcttatacgaatcagcggcggcatggtgaacttcgtcgatcaaaatataatcgaaatcatctttgctgaattgtgtgagaatttccggccgagacatggtctgcacggtggcgaacacatatttacgatcgtgctctttacttgttccggaaaataatccaagctcatcatcggtgcaacaaagcactttttgatatgattcccgcgcttttttgagaatttgctcctgctgagcgatgtacagcatgcgattcggcttatactggcgcacgtcgaatgcggacagatacgttttgccggtgcccgttgccgaaataataatggcacggctttcgccctgtttgcgtagttgcacaagattcatcaaagcctcggcctgcatggcgttcggggcgatagctatgtcggaatcgttgcggtgcctacgattcggctggcggggaggcgcgtatttcttgaaatcctcctcatacaaggcgagccacgcgtcagtaagcggcttggattcgctgatttgcgaatcgatttccgctgcaagttgctccgcaagaccgctattatctgcggtggcgaccttaagattccactcgcgattggaattcaatgcattgatggtgagatttgaactgccgatatatgtggcatacagcggttcgttgcctgcggaatgacggaaaacataacctttcggatggtaaggatagtccgctgtcgttccacttacttctgtacctgtttcttctatgatttcatcttggattgttgtctgctgtcctggctgccagacctgcacttgaatgccggtatcctgctgcaatttcaggagttccttgaatgctttcggagagttaaaatagttgaacgtagatgtaataatgcgtccggaatcatgattgttattatctgcaaaatcaagaaaatgctgttttaatgtttgtatcgcaccttggctgacgaacgcgaccgacatgtcaaaatcctggctgcgttccagctcctctttgagcgccttttccatggttcgcccatcatgattggcaatcaaagtcggctcatattcggaattcgcgttatcgtttttcttaacaaaacccgacatgacggcttcggccagagacgaatcagccatacaaatcacttccttgtttttatagaatccgcatgctttccgcttgcaatgtgccgtgacatgcttttcacaaggctgtcgattggttgtttgatgaaaaatcgtttttcttcaagtccatgatggaaatgcgttgaacggcatcgcggtcggcgggtgcccactccagcttcggcatattttgagggctcagccaacggatttcctgatgttcggtcagtcggggagtgccgttcagcaagtggcatatgaatgttgtgagtacgacggtgccgaagtcgtaatcatatgaagcggtgcacacttcgctgccgatttcaatttcgcagagcagttcttcttcgatttcacggtgcaatgcctgacgcgcgctttcgtgaggttcgattttgcctccgggaaactcccaatatccagccaacgacttgccttcgccacggcgtgcgcacaatacttcgccatctttgataatggccgcgcccacaacattgatgatcttacgtgacatcgcggcttcctctcttgtcggaaaatcagatccaggatacaacgggggcgatcgcgccaggcccaaaagattgaaacaaaatagcagtatagggcatgcagacattgacgaagagctggaaatgatctttggaagaaaaaactttcacatcacgtatgccacgcttattttgcttgttgggtgtagcggcagtttgggaagccggtgcacccgtagaatgagcggttcggatcgttgcgattgtgccgcaagcttagggcttcgccgcaattcgggcattgcggaggaagcttgactcctcggaaaatgttcggacagatcttgctatgcagttcatacatgaatcgcgacggacgggtctgatccacgatgaagaacagtttcttcttgcatcgggtcatcgccacgtaaaacagtcgccgttcctccgcatgcgggcatcgctccacctccggcaatagcagaccaagcagcggctcttcgggaatcgtgcttggaaagcctttcaatccgccggaacagcacagcagaaatacgaaatcgcgttgcaatcctttggacgcatgagcggtcatgaaacgaatatccatatccggtttttcgagaaaacgaatatttccagtgctttggtcgatggagaacagaccttcttgatcgcaacgaatcatgagattgatatcgctgcgataccggcccagcagtagtacggacgcggttttcggtagtttgcgcaactgctcgacaatcacattgaatcgttcttcctcagtatgtccgccaagtgctttcaacgaataatccttcttatcgctgggattattgagatgtttgacatacagattggtatcgcgcatcacgaatgctccgcttgcgtcaataaggctttgacggaagcgccgtgtggtggtgatctggaacatgaaggtcggaccccaggcgcgccaaattcggtcgaaatcgagaatgagatgaatgtcgctgcctgcaaaacgataaatcgactgccaatcatcgccaacgcagaatagtgagaaatcatgttgtaagcgaagcgcacgaattaattcatagcgcggtcgtgacatgtcctgatattcgtcaatcagcacatatttatatgggtgccggtacgagccattattgacgcaactgatggcatcaacgatcattcccggaaaatcaatgccattattggttttgaaattctgtatataggcatgataaagcggttctatgagctgcagcatctcacgattgcgaccgatgtttttaccgccataacgttcgttaagggtttgcattccagcaatgtcaatattgtttgatcgcatgtgctgaataatagtttgtgtggtatcgataagattctgacgatattgattgaatgcataatcgtctgttggaagctggaaattctcaagtcgtgcagctgtggaatatttatcaagcaactgttgcgacataagtttaaatgccagaagacgataggaaacattgtgttcaagcaggtattcaaatgcgttacgcaccacattgtttgacgtgtgcccgtcaataattggacgattggcaatggtggaggaacggcagatttccagtccgaggctatggaaggtgcatgcgcgaatgactttgccggtgctttgcgtgatgcggctcgacatttcgtcggcggaagctttggtgaacgatagcaccagaatctcttcgggagtggcggttcctgtgttcagcagccatgcgatatagccgacgatggtagtggttttgccggttcccgcacctgcgagcactagcgtattgtgacccgctccggcgatggcgctgatctgctcgtcgcttaactcatgcttttcgattttgccgatgatatttcgcgcccgttcgatctgctcggcagggagcattggttgcggcataagtttctgagccggttgtgaattggcatgagattgcgctcgcgaacgattcgttgtgacagaagtattgcgagctgtggtttgtgtttgcgcgcggtatgacgatcgcgccaactgtgatgattgggatggttgcgtaagctgttgcgtttgacgtgattgtacagtggacttgcgttgcgtcgtctgctgttgcgtgggattgggaacgttttgccgcgcaagcttgggcccgggctgagtcgccgttttggagacgggcggttctccaataagcgcgttcatgaacttgctcagcaatcccataatgttcctcctcaaccagtgcaaggagaaattatatgtgctgccaatgaatgcttcagcgtcggctgtgtgaacggaatcgcaattcgccgacgctgaaactaatattggagcttaacgttcgaaggggtaggtgaggttccagtcgcggcgcagggagtccatgagttccatgatgcgcagggtgtctgcgtggggcatttcctcgcattcggtgcgaccgtcgattacggcctgtgcggcggccgccacctcgtattcgtagccggtgagctgggcgggaacatcgtaatgtgcaacaaccgtatgattgccgtcatacacgtcaatcgcctcaacattattaatgttctggcacaccatataaccatcggttccccacacggatcccgtgcggtcgctatggcacagaatcgaactttgcgcggtcgccatcacaccgttctcgtaatagaacgtcatggaattatgcgcatccacgccggtttcgtacgctcgcatcgacgattcaatgcgagcgattggcgcattatgcatgatcatgtcgatgaaattgatcggatatacgccaacatccaacaatgcgccaccggcaagcgcgggatcagtgattcgcgtcttcgcggtggtggggtaacacaggttcgcatcgatcgcctgtatttcaccaatcgcaccggaggcgagaatcttatcgataatggcgcgggacggcatgtatcgcgtccaaatcgcttccgcgcacagcatgccggtttcttttgcaacggctaacatctcacgggtctgtgccgcattcgcgccgaacgctttctccaccagcacaccctttccggctttcatgcacaatatcgcctgttctgcatgcagattgtgcggcgtagcgatgtacaccaagtccacgttcggatcggccacaagttcctcatatgaaccgtatgaaactggaaaaccgtatttcgcggcgaaatcagccgcacgacccgcatctcgtgcggcgacagcatacggttcaaccaaatccgcataacggctgtccgcggccattttcaccaacgtgtcagccatatgttgtgcgatccggcctgcgccgagaatcgcgacatgaatacgagccatatcaactcccatctttcgtaaactgcatgaatagtgttgattcatttatattgctgcgttgcaagttccagcgtacgccatgcatgatcgcaacgcgcgttgatccatatcgcacttgcacgcgttcgtccggatgcttttctgatttgccggattttgccggatcttgccataatggtgtgctgtggcagcgcaggaacacgttaagaagaccggaaaacctcggaaatccgcaaaaaaagagaaatacgagcgtggcacgagaagctacatcatgtcgcatatccgaggcaaagacacatccattgaaatgatggtacgcagttttcttttttcgaaaggtctgcgattccgcaaaaacgacaagcggtatccgggacatcccgacgtggtgttgccgaaataccgcacgatggtgttcgtcaatggctgcttctggcatatgcatgaaaactgcccgaaagccacgcgcgtgccgaaatcgaatgtggaattctggagtgcgaaactgctgcgcaaccacgaacgagatgtcaggcagcatgccgaacttgaaacgatgggctggaaagtgatcgtggtgtgggaatgcgagctcgccaaaaaagtacgtgaggaacggctggaacggctttatcatgaaatcgtcggcacgcaacctgcttgatcgacatttatgcgatctacttgcaattgcgtgattcttgccgaacatacgtgatgtatgctcgattaatttcttgtttttcttgatttcgaaacggtatgtaacgtcggtgagacgatgcttgtgattcagcgtgatttgtcgtgtctgaagaatacaaacgaactatgggaaatgctgagaacagcgcgctgccgcagatgtcgcaccgcgcccagattgctaatccgttccgtgccatggtgtttggtgcgatggccgacgagatgatcgccgcaggcaccgatgtggtcaagttgagcttgggggagccggatttcggcgctccgctcgcggtgcgtgatgcgatgcgcgaacagtatgatggccgtccattgccatataccgccgcaatgggtttgccggaattgcgtcaggcgatttccgatttctacaaggaacgccaccatgtggacgtcgatccgaaacgtatcgcgattacggccggaggttccacggcactgctgcttgccgccgcattgacggtgaacgagggtgacgaggtgctgatcgccgacccgtcgtacccgtgcaatcgcgaactggttcgcgcgttcggcggcaaagtcgtggacgtgccgacgaatgcgaccacccgattccatctcacaccggaactgtgccacgaatactggtcggatcgcaccaaagcggtgatgatcacctcgccgtcgaacccgaccggtaccaccatcgccttcgacaccctgaaatccgtgtgcgacctggcgaaagaacgcggcgcatggcgtatcgtcgacgaaacctaccttgacctggccgaccgcgaaccggacggctccgacgtgaaatccgtgctcgcctgcgacccggacgccatcgtatgctccagcttctccaagttcttcggcatgaccggctggcgactgggttggatggtcgtgcctgaatgcgcgctcgaagccatggacgatctcgccaccaacttcttcctgtgcgcgcatactcccacccagcatgcggcgctcgcgtgcttcactccggaaacgttggccgtgtgcgaggaacgtcgtcaggagttgctggagcgtcgtcgcattgtggtcgacggattggctgagatcggtctgccgctggaggttgagccgaatggcgcgttctatgcgtacttcaacatttccggcaccggtcttgacgcgtggacgttctgcgaacgtgcgttaaaggaagcgcacgtggcgttgacgccgggccgtgatttcggcgaggccactgccgacacccatgtgcggctttcgtatgcggcctcccgtgaggcgcttcgtgagggtctgaggcgaatcggagatttcgtagccgaactgcacggatgatgtttgtgagcgctttgcaatcgttgtcggcgctgtgaatgttgcgtggccatcctaggtgaataggatggccactcgaatatttgcaaaggttgtcaatgtaatgtcaggtgaaagggggagtgcgatgtcactatgcttgaaatcatggttagtttacattcgcatgtcactcgtcttggcgtgcttgacattggctccaataccgttcacatgctcatcgtcgatgcggcgcctggcgcccgtccggaacctgaggccagcacgaaaagcactgttcgattgatgcaatatctcaaggccgatggcacaatcaaaaaggccggagtcgaagctgtggtcgcagctgtggaaaaggccatggggctggtcaaagaatatgagattacccaactgctcgtgctggccacatccgcattgcgtgaggctccgaatggcagcaggatcctcaaacgaatcgaaaacgtcgtcggccagccggtcacggtgctgtccggtgtggatgaggccagactcaccttccttgcagctcgccgctggtatggttgggatgccggtcggctgctggtcatcgatatcggtggtggctctctcgaggtggctatgggttcggatgaggatcccacagtagcgctgtccgtgccggcaggtgccggtcgtgtgacccgtgaattcctaccggaaaacggtattgcgaatgatagggatttggaagacgcgcgcaggaacatccgtaagattcttgagccgatggtcaaggcgttcccgaaatcgaagcacccgatgcatgccgtcggcacatcgaagaccattcgttccctggctcgtctcgccggtgccgtggtgcgtcagcccggccgcgtggacacttcgatcatgacgattgaccagcttgaggattggcttccccgtcttgcggccatctcgccggaccagcgtaccgcattgccgggcgtcacgccggagcgcacgtatcagatcgtcggtggcggcttggtgatcgacgagatcatgaaggcgcttgacgtcaaggaagtggaaatctgcccatgggcgttgcgggaaggggctattctgcgctggctcgaccagtttggccgcacgagccttggtttctagcggttcctaggcttccagcttcctcagttcctccaactggttcttcgccttgtgcagcttggtgaagatttcgttgcgctgttcgggattctttgcccgttggtgatcgcgcgtgagcttatcgatctgctcggtaagctgtgcggcctgcatacgccgtgtcatgcgcgcgtccagtgccgtgggagaggcgctgccgagcgtcacctgcgagcataacgactcccacagcgcgtcgatggaatcgaccgcaggatcgccgatgtccagcatcgcttcgccggccggtttccaatctgagacgaacactttgaatgtaggtgtgtgaccggcgcgtcccggcagcgcgcgtctcacggcgaacgcgcactcctgccgcttcgtaccttcgaagtcggcgtcgcgcacgcatacgaacacgattcccgacttgcgttgcatggcaatcagctcgacgatatccgtcggtatggcggcgttcttggcatgcaggcgcaatccgattgccagtacttccggaatgcgtgttccgacggcaagccgtgtattgcttggccgcagcagagacaacatggtgatcgtctcgatgtcgttcgccaatcgttgttttgttttggctgaaaccggtattctcgccatgaacaggcctttcggcaacgttgccttttctgcgggaaccgcagaggagttcggcagacccaatgtgagtgcggaaacggaaccgcaggaggcgatcgtcattgctggccttctttcgtgctttcatatcggttattggggcaacagtagtcgcaagagccgcaaattttgataacggcgcgtcggtatgtgactggcgggaatctataaaactgcgcgtggatgatgtctccatgtattgagcaaaagaatgcattttttcggccatcgcgggaaccggtatcggcggatcgttcgtcaagcccgtcacctccagtgtgcaagtcgcctctttggtcaaagccggttgtggcgatccggtcgacgatcggggagcacccaaattcacctcctgtgcggccaacggcgccgactgcacacgtgccgccaccaccgatccgacatccgcgacgcaagtgggatggcgtatcggcgcaagcgcgctctgttcgccatgccgtgcggctgtgatagacgattgcaatctgcgacacgccgtgatttggtgattgaggcatgtgtgcgtattatttcgtcttgcggtgatcagagcctaggtgagacgcccggtcccattccgaacccggaagctaaggcctagcacggcgatggtactgcactcgagagggtgtgggagagtagcacgcatcaccatgttgaactgcatggacacctggccaagcgggttcacgaaagagcgggacagcgtcaacagcgagatcagcgtacccagggtgagcgggccagcaccggacaatccgaagttgccaagtccggaaatcgctgcggatccgccgaaaatagccagcagaatgtacagcaggtaacccatgttgcctacgattggcatggtcacgttgccccacgtgttcgcttcggcggaagcttcgaacagttcttcgttcttcttgtcgaaggtggtttgggtggcgtcttcatggttgaagaccttgatgaccttctggccgttgaccgcttcctccacgaatgcgttcacgtcgccgatggcgatctgctgcttgacgaagtagcgtccggagcgggaaacaaccttgcgtaccaccacaaacagaatcatggtgaatgcgagcacgaaaatggtgacaggcaccgacagccacagcatcgacacgagcgcggcgattgcggacaccgcggacgagaacatttgcgggaacgactggctaatggcctgacgcaatgtgtcggtgtcgttggtgtaacggctcataatgtcgccgtgttcgttggtgtcgaagtagcggatgggcagggtctgctgatgggcgaacatgtcgtcgcgaatcttcttcaacgtgccctgttccacagtgacgataacccactgccacagccagctgcagaaaataccagccacatacaggcatgccataagcgtcaacgcacgcagcaacggcatccaatcaggattggtggcaccaaccatcggcagaatgtacgtatcgaccagcgactgtaggaacagcgacgatccggcctgggccgcggcaccgacgagaatgcacactaccacaagtgccacacgccacttgtattggaaaatgtaaccgaagatacgcttggtggtgcccggtgcggctttctgcatcggcggcttgccgtgcgattgctgcatgccggccgcgttgttgttgtctttggatttcaatgcggaagtttgttcagtcatctgttgcctcctttcactgcagttcctcaggctgggcctgattcttggtttgcgattcatagatggagcgatattcgtcgcaggtttccagcagttcgtcatgcgtgccggccgccatgatgcggccatgatccatgacgagaatcatgtcggattcctgcacggaggccacacgctgggcgatgatgatcttcgtggtgtcgggaatctcatgatggaatgcggcgcgaatcagctgatcggttttggtgtcgaccgcggacgtggaatcgtcgagaataaggatcttcggctttttcagcagcgcacgcgcaatgcacaaacgctggcgctgaccgccggaaacgttggtaccgccctgttcgatgtacgtatcgtacttgtcggggaattcctgaatgaagccgtcggcctgcgcaagctggcatgcgtgacgaatctcttcatcagtggcgttcggattgccccaacgcaggttttcggcaatggttccggagaacagcacgttcttctgcaataccatggcgacctgatcgcgcaatacttccaaatcgtaatcgcgcacatccacgccgccgaccttcagcgagccttcggtcacgtcatacaaacgtggcacaagctgcaccaaactggactttgcggaaccggtgccgccgacgatgccgacggtcataccggaacggatcttcaaatcaatatcgtcaagcaccggcttttcggaagtggcggaataacggaaggtgacatggttgaaatcaatctcaccattcttcacttccataaccggattttccggattcgtaaccgtgctttcctcgttcagcacctggcagatgcgttcggcggaggcctgcgaaataatgcacatcacgaaaatcatggacagcatcatcatggccatgagaatctgcatggcgtaggtgaccaatgcggtcagatcgccggcggtcaatccaagggccgcattgttgccggatgccacgatctgctgggcacccatccaggcgataagcagcatggacacgtacacgcacagcatcatgagcggattgttgaagctcataatgcgttcggccttggtgaagtccttgaagatgcgctcggaaatgcggttgaacttttcggtttcgtggttttcgcgattgtaagacttgaccacgcggatgccctgcaggttctcgtctaccacgttgttgagcttgtcgtacgtgtggaacacgcgctcgaacaccggatgcaccagtactgccagaccgcacaggccgatggcgagcaccggaatgcaggcgaggaacaccagcgaaatggatgggctgatgcggaaggagaagatccacgccacaatcaccatgatcggagcgcgcacacccatgcggatgatcattgaatatgcgttctgcaggttggtcacatcagtggtcagtcgcgtgatgatcgaaccggtggagaaacggtcgatattggtgaagctgtagccctgcaccttctcaaactggtcgtgacgcaggtttttggcgaatcctgcgcccgcaatggccgagaactttccggccaaaaagccggatgtcagcgaaaccgccgaacaaatcagcagaatcaagccgaatttcaaaatcgccggcatgctgccaccgctgatgccctcatcaatcagcgatgccatgacagtcggaataaggatttccagcacgctttccacggctacgaataccggggagagcaggctggcttttttgtattcgcgcagggatttgcccagtgtgcgaatgacgtgttgctttggttttgacgttgtggacgtcgttgcgtttgccgctgtcactccttgtcctttctttttcgtacttacttgcttgcgtgtgttacctgaggttgtttgcgatcgccattttctgcgacattcgcagtatgcgcgaaacgtattcatcatgagaatcgcgattatgcggattccgtacatcgcatgattcttgcgattcttgcgaaacctgcggcttttgcgaaacctgcgattcgccaaaatcctgttcctgtatttccaagcttgaatatcggctttcgtctccgatcaaacctgttttcaccagattcgtctgcatgacgtcaagcatgtgcatgaattggcggatctggtcgtcatcaagaccttccaacaggattcgttccatgtttttcgcattgtcgtgcagcacttcggcaatatgcctcgatttgtccgtcaatacgatctttttcagacgtgcgtcacgcttcaccgactcgcgggcgatcagccccttctgctccatcagtcccaacactcggcatgatgtggatcgggtcacgccgaaacgttgctcgatgtcttgagggaagatctcctcgttatcatgtcttgccaagtacacgatgatgtcaacgttgccgttgctgacgtcttccgcctcttcgggacgggtgacgcgcaaataccggttgaccacgttgtgcagcgagcgaatggccacgctgggaggcttggtcaggccactttcccagacttcggcaagtcgtgaacctgacggttccttgtattgttcattcgtcacttctgtcacaccacacatgctaaaccgttgcatatacaactgttgtacatgcaacgattagcgtgtcgcgcatctcatcgtccgcgacaaaaaaggccgaggaatcagatccgcaccggttcagcgttaacggatcgaatccctcggccttaagccttgaatcctacgaaactacttggtgagttcagcgtacttctcaagcatgtattcgaagatctgcttgccatcggcgcccatcagcaccgacatgctgttgatcggcatggaatcgaggaacaggcgggtcatgtcgttgtcgggcaccaccggcatgcggccggcttcgccctcggcacgcaggatttcaagcaccttggaaccgagcggatccttacgccattccatgaagttggaccattcggtgagcggctgggccttgccgtcgccgtcgagctccaccaccgcggaaccggcaatgtcacggctggacgtgccgacctcgatggtgtattcgccgctctccacgtgccagtcattgaacctctcagaccagtaggcaaaggcgcgatcgtcgagctcgaaggagacttctgcggattcgccagccttgaggaataccttcttgaagcccttaagctcgtgtttcgggcgaactacgtcggccttgccaggagccacgtacacctgcacggtttcggcggcgtcaacgttcgaggtgttcttgaccactgcgctgacggatgcggtacaggcaccggtcttgacggccttcacgtcgctcacttcgaacgtggcgtagctcaggccgaatccgaacgggtagtcgacggccttgttgtaggtgtcgtaatagcggtagcccacgaacacgccttcgccgtagtcgacatgcccctcttcgcccggccagttgatggtgctcggatcgtcgttgatgtcgaacggaatggtctgcgcgagcttgccggacgggctcaccttgccgaacagcacgtcagcgagcgccggaccgccggactggccgagcagccaggattcgaggatgcccttggcgttcttggcccacggtgccacggtgacgacggagccgttggagagcacgaccacaacgttcttgttttcggctgcgacggcttcgagcagtgcgatctgcttggccggcatgtcgagggtctcacggtcgaagccttcggattcggctgcttcggggagccccaggaacatgagcaccacgtcggcgcccttggcagcgtcgacggcttcggcttcgagtgccggatcggccggttcgaggtcgagggtgaagcctggggcgaacttggcgtccacgccgcgttcggtgagggtgtcgaggaagctggtcatcttggttggggtgatgtgcgaggagccgccgccctggtagcgcggagtgcgtgcgaattcgccgatgaccgtgaccttggcatcgtttgcgaccggcaggatggcgtcgtcgttcttgagcagcaccatggattcgatggcggcccggtgggcgacttcgtcgtgggcttcgatgtcgaaacgatagccttcgatgctcatggctgcgcgcgtcttgttgaccaggtcgatcatgccttgtgccatgcggtcgagctgtgccggctggatgcgaccgtcgcgtgccgcatacacgatttggtcgtcggtgtagcttggcggcatttcgaggttgaggcccgcgttgagggatgcgacgcgatcatggtcggcgccccagtcgctcatgacgatgccttggaaaccccattcgtcgcgcagcacgtcggtgagcagccagtggtcctgggcggcatgcacgccgttgatgcagttgtatgcgcacatgatggtccacggctgagcttccttgacgatgtgctcgaatgccgggaagtagatttcgcgcagcgcacgctgggagatgttggcgctgatgcgcagacggtcggtttcctggttgttggcggcgaagtgcttgagcgaggtgcccacgcccttggactgcacgcctgcgacgatgccgactgcctcatggcccgccagatacgggtcttcggaccagtattcgaagcagcggccgccaagcgggttgcgcttgatgttcacgcccggaccgaggattacggcaaccttctcctgaatgcactcttcggccatggcttcgccgacccggtagatgagttccgggttccacgagctggacagaccagcggccggcggaaagcaggtggcaggcacgcagttgttcaaatcgacttcgccggtggtggccgagttggacttgcgcaggccgtgggggccatcggtgatcatatagccgggaatgcccttggcttcaacaccctgcagatgccaagcgtcgccgccggaagtcagggatgccttctcttcaagcgtcagatcattgatggaaggataggttttttcgctcatacgttcctctttcgcatcgttttcttgagttcgtatcggttaaccgatctgcatgagacctcaaccccgaaatctctactaaccggttggtaggtactttatcaaaaccaacaccgcaacacgccaatcttctttgaaaaatcaattaaccgaccgtaaagtaactgcagtatttacaacttgagagaaatgacgattcataagcattgcagcgcacatgaatcgccatcaatgaagggcaagagagggaatcatcatggccaacgaagaagtcgaccgaagggcggagattctcaacgcggccgtcgaactgtttgggacgctcggctattacggcacttccctgcagaaaatcgccgatcgcgtaagactcaccaaggctggcgtactgcattatgtcggcagtaaggaaggactgctcacagccgtgctggacgaagtctacgattccgaaacggaagacattcttaccgacatggtacgtgagccacgaccgttgatcgccgacatgtggcgcagaatcgtggcggtgaacgcacgcagaccgcttcaggtgcacatgttttccacgttgagtgccgaagcgatcgacccgaaccaccctgcacacgagtacttcgccaatcgtgagctgcataatgccgataccgcgctcaatatccgttggtgcacgcccgaaggcgttgatacgcgtcggctgcttaatgcgggattcgccatgatggatggcgtgcagctgcgttggctacgcacgcccggccaagatctgaacgccatgtgggcggaatgcgaagacaccctgttccccctgcccatgtgggagggctaccgctaagcctctgccccggcactgcattactgtatggatgcagacgtagaaggaggcatgtatgcggattttgctggcaccggactcgttcaaggaggccgcttcggctgaagcaatcgcacaggcgatggctcgcggcattaagcgtggcaatccgcaggcggaatgctggcttatgcctctttccgatggcggcgaaggattgacacaggccttggttcatgccaccgccggcacgttgcacagtgctgagacagttgacgcgatcggccgcccgattaccgctcagtttggctttcttggcaataatcatgcttcttgtattctccacaccgccgtggtcgagttggcttcggcaagcggacttgaacgggtctcccctgccgaccgcaatgcgttggttgcttccacgttcggtaccggcttactgattcgcgctgcgattgacgctggcgcggattgtattgtgcttggtttgggtggtagtgccactacggatggtggcacgggattggctcgcgcgcttggatttcattttcttgatacggcaggtcatgatattccgcttggtggcggttctcttgttgatttgtcgaggattgatgattcggaagttcccgattttgtaaaaaatgttccgattgttctcgcttgcgacgtcaccaatcctttgaccggcccggaaggtgccgcccatgtgttcgccccgcaaaaaggcgcgaccgcaacacaggtcgagcttctcgatcaggggcttgcgaatctcgcgcgcgcaatcatgcaatataacggccgcgatatcgagcacactccgggagcgggcgctgcgggaggtaccggaggtggcatgcttggcctgttcaacgcaacagtgaagccgggaatcgaactcgtgcttaatcttgcacatggccgtgaagcgtgcgcttgggctgacgtcgtcatcaccggagaaggttctatcgacagtcaaacgccatacggcaaagtgccaagcggcattgcaaaattggcgcaatcgcaaggaaaaccaaccattgccatcggcggaacggtaacccgtgacccacacaccgtcgaagcgctgaacaaagccggcattatcgcaacattcggcattgcgcccgggccagcagatcttacaacgttgatcgccaacacggaacgcaatgtcgaaatcacctgtgccgcaatcgccagcacattgcgcatcaccgcagctacttcaccctgcgaatcagcatgatgaacaccgcacccagcagcaccgcgaccacagcgatcgggaacagcgccgcataactgccagtggcaagcacaatcgcaccgacaaccacaggcgcaagcacctgaccaacggtgttggcaagattcagaatgcccagatccttaccagcttcttcctgacttggcaacacatcgacgttcaacgcctgatcgacggcaatgtaaatgccataaccagcaccgccgatgcctgcaaacagcatcatgcccaaagcattcggcatgaaacacggaatggccacaccaatcgcgataatcaccgaaccgatcgccacgatgaccttgcggcgctgcagacggtccgacagcggacccgacaccatggacgtgacgatcagcacaaccatggaaatcaccgacatggtggaaatcgtcgccgcggaatcctttacgctcaacccgcagtatttctgcagaatatacagctgatagccggaaatcatgttccaacccaagataagcagcaatctgcccatcaatgccaagtaaaaatctcggcaattcttggtaggaggaatgaacgaacgcagcaactgcttgacgtcgagctttgcggtggcatccgaagactcgacggaagccacagaagcagccgaggagcgttcgcgcggccagatcagcacggtcacgataccggtgactgcgaacagtgccgcaccgatcgcaaatccggtgcccatgttttcaatgaatttcgatccgaggaacgttccggcggatgatccgacgatctgcgcaccaccatagaatgcggagaacgtaccacgcacgttttccggaatgcggtcggacagcactgccacagccggagcgatcatcatgttgacgccgacctgcacaatgcaccatccggccacaatacccaccaactgcgcactggagaaggcgagcacatagccggctgccgtaatcagaccacctgccacaatccatggcgtgcgcttgccgaaacgcgagcgcgtgatgtcgcttaacgcaccaaaaatcacgttggagaacagtgcgaatacgcagcctacggaattcatggtgccgagaatcacttcgggcacgcctatgttcagttcggtgaatcgttgcggcagcagcacggccgatccggaagtgcctgcgaccatccaaatcagcgagaagagcacgaagccgacgccgaatcgccatttttcggtggatgtcagtttgcggccgctgtcaggtgcgatatcacccaatactgcggtgcttggctcgcgtgatgcgtttgctgtcatgattccccctttggaagcatgttcttttttgaaatattgcaatgatttgaaatatacgatgaagaaagcttttttcatttttggtatgattgcagtcctgccgacgccgacttttattcggcttcagcttcggcaggactttcgttcatacgatttcacacgattccgtacgattacagcgccatctgcagatgatgcgttcccgcaacaagatcgacgcgctcatggtcgacgatatccacgaatgccgtggttccggcaggtaccgcaaccgtcagatcaagcacattggcgttgacttcccattgcacttccgccttgccatatggggtgatgtgagaggtttcggcatgggtgagatctcccccgatcaccggagcgatacggaaccgcttccagccgggttcaacggcttcaaggccgccgatatgcgcatgcatccattccgccaccgatccgagcgcgtaatggttgaacgaggtcatgccgccggggttcagcgaaccatcggcccgcatggaatcccaacgttcccacgtggtggtggcccccataaccacttggtaaagccagcttgggcattcggtggaggtaagcagcgcgtaggcctcgtcgttatggccggtcatggtcaacgccggaagcacgaatggcgtgccggcgaatccggtgcttaccttgccgccggattcgcgcaccaggcaggcgagtcgattgccggccttcacgcggcgcaccggttcgccgtcaagcagtccgaaggcgatggcgagcgcgtaggcgcactgggtgtcggatgtcatggtgccgtcaaggttggtgaaacgctgcaggaatccatcaatcacacggtcacgcagggcggcgaatcgagtttcatcatcggttttgccgagaatatgcgcgatgtgcgtgccttgcatgcagctgcgtgcgtagaacgcggtggcgaccagttccttttcggtcatggcctgcgtaggatcttccggaggcgcggtcggatcaagccaatcgccaagctgcccgagcggatagtccggcttgcgatcccatacgccatcgggtgaaaggtaccctgccacttcatcgatccaatcacggatcagatcgtaggaatcggcgagcacctgcacgtccccgctttccatgtacagcgtccacggcacttccaccgccgaatcgccccacgtggagatggcttgtggatgcgcccatacgcccaacggcacgaacggcacgtagaacggcacagtgccccacttgacctggtcggcacgcacgtctttcagccagcttttcaggaacccgtatacgtcatacaaataagccgcggtaggcacgaacaggcagatgtctcccgtccaacccatgcgttcgtcgcgttgcgggcagtcggttggaatggacacgaagttggaacgcatcgaccatacggcgttctcgtgcaaacggttgagcagcggattcgatgtggtcagttcgccggtgcgttccatcacggaatggtagacgcggcaatccatgtcggctgcggtcagttctcctgcgaaaccttcgatctgtgcatagcggaagccgtgcatcgcgaatcgtggctcccaccaagcgtcggaaccgttggaagtgtacacatcgcactgctggcctctgcgcaaggttcgcgtggcgatggatccgtccggttccaacacttccacatgacgtaacgtcacgctttgttctgcttcaagatcgcgcatgtgcaggcggatgcgctgcgaacagttctgtccgaagtcaaccagccatatgccacgaccatcttccgtgttgccgatgcgttcgatgctgaccggctcatgcgattcatgcgcgcgcaccggcgatgtttcaggattttcaatacgtgccgggtcatacatgacttccgcgaccggctgccaggagctgtcgtcgaatcctggtttcgaccatcccggctgttccagtcgagcgtcatatcgttcgccttcgcacagatccgagcagacgatcggtccgagcgtcgccttccattggcggtcccatgcgttggaatatatgttctgcatactgccgtcggcatattcgacctcaagttgcgcgaatacggcaatacgatcgccatagaagttggagtaaccgccatcgaagccgaggcgtccgcggtaccatccgtcaccgagccagaatcccaatgcgttggcaccggactgcagttcgtcggtcacatcgtaggtgaagcattccacgcgctggttgtagttgctccagcctggtacgagcgcgtcattgccgactttgacgccgttgatttcggcttccacaagaccgagtgcgcttagatataggcgtgcgcgtttgggttgttccttcagttcgacttcggtgcgcactaatggcaggtgacgatggtcagtttcggattcgctccacgatggtccgacgaaatcggcgacatgctcatgttcttccaatagtccgacttcgaaatgcagggttgcgctcggtttgcccaatggctggtgacttgccgaaacggcctgcatggtggcgaacacttcttcgcgtgaggcgagcggcgcgaactgccatggaataagcactgaagtgtcagtgggcaggtaggtgcgttcttccacaggttgcccgccgggaacacgtcgtgtcactttgagcaggatctgcgcgtcgattggcagcatgccggagcacacccatgtcatgcgtggggctgcggtggcgatgccgagcgcatctcccgggtagtgttccacggtgaagctgatgatgtcaagatccgaagccagcgtactgggcacaatctgcggatcagtaatggccatgatgacccctttgtctacaaaaataatagatcacttgtttgtgatggtgggaagccaaagtccgagccatgccgcaaggagagagaaacgaacggcgacgatggctgggactttggctggcaatcgcaaggtattgcataactgacttgcgattggagatattgagttgttatgtgattgctgttgctaatcaggctgcgatcttgcgtgcctgacgttcttcgtcggtgccgtacttcttctgagcacggatcatgatggtaccggcgatgccttcgatgattacgatgccgaagaagcaccacatagtggtctgaatggtttcaggaagcaccagagccggggtgatgagcgcgaacaggccacagcacaggcgggagaagccgttgatgaagccctggatggaggcgcgaatctcgatcgggaaggattcctgggtccacaccttgtacagtgcttcgcctgccagcggggatccgaggttcatgaaggctgtcgcgccgacgatgacccataggttcgcaccgcccatggccatggcggccatggcgatcagcgagatcacgatgcctgcgaagaacgccttgttacgatatttgccgcctgcgatggacgcgaacacgatgttgagcacgagcgtcacgaagttgaggatgatgcccaagccggtggccagggactgggcggctccggccttggagaacatgtaggtctggaactggccccacgtgttggccagcaggttccagccgacgtagaagatcacgatggcaaggaagtaggtgagcagcaccttcttgtcggcgccgaacagcaccttggtcacggaaaccttgccgttgcctacaacagccggacgtgcggcgtcacgaacgtcggcagcttcatggaagcggcggaaggtcggagaaagcagtcgccacagccatgcgatcacagcgaatactgcgaggatggcgaacaccacacgaccaccggtggcaccctgcatggcggaaaccaggaacgcgcaaatgaaggagatgaacacacccacctgccagaacacctgggtggtggagacgagctgtgcggcggtggcctcgtctggagcatcatgggagacgatggtcatggaaaccggcagatccgcgccggaagccaaacctgcaatgatcaggccgatcagtagtacggtgaagttcggggcgaacacgcagatggcggcaccgatggcgtagaacaggttgatccagttgaaaaacagcacgcggccgatcttgtcggccaagcggcctccgaacagcgagccgaaggcgatggcgaaggtcagaataccggaaagcaggccgacctgcgtggtatcgagtccaaggccttcctgccagaccacaatggttgccgacagaccgacgatgatgccggatcccagcatcgatccgatgcctgcggcgaaggcgagcggcatgtattcgcccaatcctttgcccttcttggttgaagtattcattgctctttccttactttttcatacttgcatgcgttttttcacacaagtatgtccttcttttttcaaatggttttcactgcgttttcaaattgccgaggcatctcctttgatctgtccagcattcagaaaacactgcgattccattgttttatacaccagaacatcctgccgtcctcagcagcacctccagtgatgttgtagttgaaatactacattcgtttttgaaaatttcaaaatcgtcgcgcgtttttcaatatacaatttcaaaagagagcgcgtagactattgatacatcaaggaataaccggtttatgtacgaacaggagcaatctcatgccagcagcaaaacgtgtgggcgtttccgacatcgccaaacatgccggcgtctccatcggcaccgtatccaactatctcaactaccccgaacgcgtatcggacaccttaaaagagaaaatcggcgcaagcatcaaagaactgggctacaccccccgcagaaacacgcttcttccccagcgagagaacgccggaccgcgcctcatcggctatatcatgaccgatatcgaacattccctgttcaccttcatccatgaaggagcgcaggaggtctgcgaagaaaacgacctgcagcttatcgccttgaacgcatcatccgacgcgcaacggcaaaacgaactggtgaaaacactcatcgacatgaacgtggccggaattctgctcagcaccatatccgactcccccgaagacgtggccgcggcacaagcggccaacattcccatcatcctgctcgaccataccaatccccgtcacgccgatcaggtgtgctgcgtgcttgaaaacaatatggcggccgggcagatcgcagccgatgaactcattcgcatcggatgcagccgcatcgcgttcgccgcacactcattcgactatgaatccgtacaagatcggcagatgggcgtcgaaaaaaccattgcgcgcacgcatggaagcacgcaattggaactcatcaattccaaaggtctgatgtttgaagacggctaccagctcggcctggacatcatcgacacaatgaagcgtagcggcctggacgccattccagacggcatcatcaccgtctcggacgcgcttgccgccggcgtgctgtcggcattccatgaccataacggcccacgggttccagaagatgtttgcgtcatcggcatggagggggcacggttggagaccaaatgccccatgtcgctgaccgtagtgaacgcgcccgctatcgacatggggcgcaaggccatggcgcagatgctcgactacatcgacaatcccgccgcacacgtgcacagcaccacgcttatcgagccgactctaatccgacgcgaatccacacgcgcataatcgcatgcggaacactgttagcacagcccaactcgacgcaacacaacggcaaggtgggtttccttacctggcgaaacccacccttactactattctgcagcgtttgaaaatttcaaaccatcagactgcggcacgggacttgtcttgcaagtcaccgaataccggtgtggccgaaccaagccagtcgcgctgttcctcattgcccatggcattacctcctaccgccattcatcgtcgaagcggcatatcattcaggctccgcatcctcacggagcaacctcacggaatgatagactttgccccgagggcaaggtcaacacgaacagtgaagcccacgacaaggagacaatacgtggccggcgatgatgacgagctgctgacgattggcgaagtggccaaattggacggcatcaccgccaaggcgttgcgctattacgatgcgcataacatcttgaaaccagccgcggtagacccggctaccggctaccggctaccggctaccgatactacacccccgatcaaatgcttgacgtcgatgtgatgcgtatctgcatcgccgccggcgtgccattggattcgttggagaaattccgtttcgaagacggttcgcttgattggcgagcgttacttgccgcagcgcagtcgcaggtggatgagcgcattcagcaattacgacgattgcagacgtcaatcaccgattattccggggaattggtacgcaaggccttctcccccgaagatgggttggtgcgtgccgatttgctgccgacttggctggttgcacaaccttgcctctacggtaatgtttgcgatataaaacgatatttacgcataatgacgtcgttgcgtaccttgattcgcgatgcgcaggcaccgcatttgctgcgcagaggcatactgttggatttggtggaatgcaaggcgttcgcttttcaacagttcgcgccaacgcagcgcatgcttgatattttccattccggcgatcgttcgcaagtaacctacgattaccactttcccactggaaccgttgttatcaatcctcccggaggtcctgcggaaagtcgcgtaatcgagcgtgaatcgttggcgcaatgctttgaggatggcatggcgttggctgaatcgctcgacgctgaggattggccgcatgtcaccatgactgagatttggggcagtcatgccccaaatggttcggcttgcaggctactcctgagcacgcttcaccgagaagcggaacatgagcaacgccagaatctcaccgcatacggccatgccgaagaacacccacatgctggtggagaagccagccacataagcgtcagcctgctgcatgccggcattcacgttggcggccgagaattcggaaatcaacgtggatgccacagccgtgccgatggcgcctgcgagctgctgcatggtattcatcaccgcggaaccgtcggcgttcatggaagacggcaactggttcaacgcatgcgtctgatcgggcaccagcacgaatccggaagcggccatgaacagcgcgtatgccacggcaatggctccttcgtgcgagccgccaagcatcatcgccacatccatcaccgccacgccaacaaaaccgcaggcgatgaacttcggcgggaaatgctctttcaacgcgccgccgatcagtggagccgacaccgcgccaatcacagcgcccggcagcaaaatcaaagcggccgtcatcgacgtatgccccaatcctcgctgcagcagaatcggcagcaagaagttcacaccaagcacaccgccggaagacatgagcagaatcaccatgccgagcgtgaatcccgaatatgcaaacgtacgcacttccaccaacggatgagccatacgcaactgcaatacggcgaacaccgccaacaccacaatggcaccgataagcacactccagaatcgccaatcgccattccattgcgcgaagaaactggccgcaacaataatgccggccaagccaacagccaccaacagcagtgatggcaccgacagatagcccttctcaccgtgacggatgtcaggcacggtagccgcgccaagcacgaacgaaatcaccaggaacggaatcatggcatagaaaatccaatgccagttcaggaattccatcaccaatccgccgaacaccggcccgatggccggagccgcgcacgtcaccaaactcaccaacccaagcatcatgccgcgcttgtggaatggagccttgtcgagaatgatgttggtcagcagcggcagggaaacacccgtgccgagcgccatgatcagtcgtgcggcaagcagcatcggaaagttcaatgcgagcgcgccgacgagcgttcccacggaaaacagcgcgatggccataacaaacaacgctttggtcgggaatttgcgcaccatgaacggtgacgtcggaatggccacggaaagcaacagcagatacccggtggtcagccattgcaccacgtcggcggaaatcgcaaactcttccatcaacgccgaatatgcgatgttcagcgaagtttccgacagaatgccgaggaaggtgagaatggcgagcgtcaccaccacgatggtgagtttgccttcgctcatacacttgtcgttgattgcgccgctttgtacgccgttggtggcggaaaccgtgccgttttcggcatgttcgatgggtatgtctgatggtgcgttcctcttatccgtagacactctgctccttcgatagaaaggttgtgtaatagttcttgcttcgaaattgtcgacgatattcgcatgccggcgcggctacagtttgcgccggcacacaccacacattacgtaaggcagaacattatgtaaggcagaaatgttacgtgaaattgcatgagccgcctacgatcagcatttcgtaggcggctcatatcagtctggcgtgtcgattatcgagttctgcgacacggtttattttggttgcttatgcgacggtgaaggtggtgcgcttcaagtgttcgcgacggctggaatggccgataagcacttcgaattcgcccggttcgacgattcggttagcttccgaatcgacgatggtgcaatcggaaaccggaatgtcgaaggcaacggtcttgcttttgcctggttcgagttccacgcgctggaatgctttgagttcacgatcagtccagctgtaggaggtcacgatgtcgccgatgtagagctgcactacttccgtgcccttgcgatcgcccgtattggtgagggtgatttcggcatgcacggtgtcggtttcggtgaatatgccggattccggaacgttggtgatggtcggatctccgtattcgaacgtggtgtagctcagaccctcgccgaatgcgaatgccggattctgcgtgaggtcggcgtaacggttgccgtgctggcctcgaatctggttgtagtagaccggcagctgtcctgcgtgacgcgggaaggtgatcggcaggcgtccgctcggttcggtttcgccgagaatgatttcggcgatggcctggccgcccttcatgcccgggcttggagcccacagcagagccgaagtaccttcggctggagtttcgtcaacaatcacgccgttggtgccgatcacggatgccggcagcacttgcggcttggagctgacaagcaccaccacgaacggcttgccggtttcgcgagccacgttcgacagtgcatcgatcagtgcattctgtccgccgagcagttcaagcgtggcggtggagcagccttcgccaatggcctggatcacatcgcccaccacggccacgatcaggtcgcttttgcgtgcgttttccacggcttcgtcaagcagtgcgcgatcaatcttggcggaaacgccgatcttcgggcgaggctgtccatccgggtagaactcgccttccggatcgggcaccaaatccacgatgttggcaccgcgagagtacacgacctcgcaaccttccggagcgagctgcttgaaaccatcaagcacggtggtgatcatttcacgcgggtggccgtcaggcatccagttgatctggccggagctgcctgcccagtcgcccagctgggtctgggcgtcatcggcgagcgggccaacgaccgcgatacgcttcgcaccggccacgttgaacggcagtgaaccgtcgttcttcagcaatgccacggcttcgcgagccacttcaaggttgagctgctgatgctcttcggaaccgatcactgcatcgatacgcttctggtcgggcaagcgtggatcttcgaacagtccaagacggaacttcagtgcgagaatacgagccacggcggcatcgatcaacgattcgtcaagcagaccggtcttcacggcttcgatcgcaccctcgtagaactttggcgtggtcatcaccaagtcgttgccggacttgaccgcatcggcagcagcctgcacatagtcaggcttgaccttctgctcccacacggaacggccgacgttgtcccagtcggtgatgagcgtgccctgatagttccaagcgccacgcagtttgtcggaaagcagccacttgttgaaggtgaccggcacaccttcgatggattcgtagccgagcatgaaggtgccgcagccttccttggccacgcgttcaaacggcggcaggaaccaggattccagcttgcggtggctcaggtcggcttcggaagcgtcacgccctccctgtgtttcggaatagcctgcgaaatgcttggcgcatgcgaggatcgcgtctttggcgagcggctcgcccgccttagctccaccttgatagcccttgacaatggacgatgccatttcgccaatcaggtacggatcttcgccaaaggtttcgcccacgcggccccaacgggtgtctcgcgcgatgcacagcaccggggagaacgtccaatgcacgccggtggctgacacttcctcggcggtggcacggcccgcggcctgtaccttttcagaatcccacgtggttgccatgcctagctgttccgggaaaatggtggctcccggccagaaggaatagccgtgaatgcagtcgtcgccgatcaccagcggaatgccgagacgggttttggcgttcaccgtttccacggctttcggcagatcggaagacaccactttttcattgaccaccaacgcaggcatagacattacaccgtaggccataattttctccatatcagtgatatactccggttgaatagacaaccccatattgttcagtgctgcttttgtgttctccagcaaggcatggcaattcttacatccgctgcctaaaaccttaatacagcaaatactgttgcttgcctcatcgcagcagctaccgtttacagtctcggcctcatacgtttcacaagctccattgcaagcacaagcaacagtctttcctccttcctcttttcttttgccaaatccgaacagtcccataatagaatctcctttcaaattttgtatggttacaccttatccttgttaaatcaacagatgctgaaatacgttaaacagataacccacaatgacaattccaagcgtgcagattacgatgaacagtcctaacagttttgcttttaccgcttttttcagcataataatggacggcaggctaagcgtagtgacggccatcataaagctgaggattgtaccaagctgcgctccttttgcaagcagggcttccgcaacggaaatcgtgccgaaaatatccgcatacattggaacacccaccaacacggctaacacaacaccaaatggattgttgcttcccaataccgtctgaatccagctttccggaatccagttatgaatgattgcgccgataccaacgccaaccaaaatatacgggaacactttcttgaaagtctcaattacctgttcctttgcgaagatcagccgatccctcactgtcagtgcatctgattcaacatccacgctgtttgcattacggatgaaatcttccacgtagttctccatgtgcattttttcaatgactgtaccgccgattactgcaatcaccaagccaactaccacatagacgattgcaatctttgccccgaaaatgctcatcaacaataccaaacttcccagatcaaccatcggagatgaaatcaggaaagaaaaagttacgcctaaaggaagtccagcgctggtaaaaccaataaacagcggaatagaggagcaggaacagaacggcgttaccgttcccagcagagcagcgatgatatttgcccagataccatgaaaacgtcccagtatccgtttgctccgctcaggcgggaaatagctctgaatatatgagattacaaaaatcaagacacagagcagcacggtaattttaaccacatcgtaaagaaaaaactggatgctcccacccaagcgggatgttgtgtctaacccaaaaacggataaaccatttccaattaccgtgttcagccacttcattccaagcacctgatcttgaatgaaaagccacgttaatcgtaaaatctccataaggtatgtctcctttcaaattgataaattcaaaactatcgaaatgttgtccaaaagagaagccaccctttacagatggcttattttacctacagcaacttccgttttgctcatcatgaggaactaaagataattgttgctcaagcaattttttagcacgctctgcgccttcgggattgatggagtaatgaacccatttcccatctttacgcccttgtacgatgtcggcatcacacaatattttcatgtgatgggaaagtgttgattgtgtaatatgcaaatcatcaagcaatttgcaggcgcatttttcccctgtgcggagcaattctaaaatctgtaaacggttttcgtcacaaaatgctttgaacacctttatggtctctgtgtatgcagatgccacgaatctcacctcacattcgctgttttgaacttacatcctcattatattcataaattcaaaaatgtcaatatgaattttgcgaaaaacggaaagatgaacaagctgtttttcaagccagcgtattgacacacaaaaaataacccctccctgtcaagggaagggctatcacagtactttattctgttatttccgggatttccccgacaaagttgtaaacaatcttgacctcctgcgttttctgcccatccactttcctgacctctccgatcagaatcttactgataatccggtgcagcaccgtctcatccagctctgtgatggtggcatactggcgaatctccgagatgaacgtcctcacatcgctttcctgctcatcagagtggcgcatcatttcggccaagtcctgcaaacgccgccgattcgcttcctgctcctgctcaatggcggcggtcaacttcacaaatcgctgttcggacaggattccccttgccttgtcggtataaaggctcaggaacatatcgtctatctcctgattgcgggtctggagtcgttcaacttcccgttgcaactctgcggtgtccacttgataccggcgctccatctggctgctcaaccgtttgtagaagctgtccgcatccttcatggccaacgccgccagctcctgaatgtccttcagcacaaggttatacaaatctctggcctcgatcttgtgactggagcatactttgcagcccatccggttgtaggtctggcagatataatacgccttatcaatcggttcccgcatctcgccggtgaagcgattctttccggttcggcctaccttctcatagcgcacctgcatggacttgccgcaggtagcgcagtagatcagcccgtgaaagatgttataaaaggggcaggcgtttccctccataatggtgggtctgccgttaatcatttcctgcactcgctgccattcctccggtgtgacaatcgcctcatggcagccctcgatcacttcccattcgtcacgggggatgatatcagtaatgtcagtaatgaatatacgtcaactgcgaagcttcctgcgcagtgaacgtacgatcggaaatcacgccaagacccttggcattggattccgagatcttgatcgaaccgtcggcattcacttcttcgacaatcgcgacatgcccgtaatagctgtccgcattcagttggcctggagcgaataccacgatatcgccagtgtgacgtgccgtattatcaacccaatagccgagagcgcgcgcggaatcaccccaactacgcgcatctccaaaatggcttccgacaggcagaccaagctgtgtacgacgggtatacgcccaccatgtgcactgaccgtatggatagtcattgccggtatcaccggtgccgtggttcggattgaagcccgaaggaagaagaccggcgtcctgatccatgagaacggcgacattgggattgtcggcaatggactttgacagaagattcgtgtccatggaggaactggtttcgccaagctgccaatcaccgctattgctggtggaggccagagcgtctagatcgctacgggactcggaacgggatgccgcatcgtcggagacacgcttcatctgcgtggtagtggtggcattgtcggcaaaagtcatttcagacgcattctgctggccgaccgccatggcagtggccgcggtgccaaccaacgcagccagcgatgcggaagccatgaatgcggagcgacgaccggccgcacgagcggcttcacgcatggcgcggcggctcatcggagccacttcattcagcttttcggcaaccgcaggctcaagacctacaacggcacccccaccatttgccagctggaccatacgaacggccttggcggtgtgggaaccgcggctcgaggtgaacagcgccttggcaacgctgaaacgctcattcgaaaccttggcagctttatgcgccgcatgcctcatatatcaacactccttgcggattacttcaaccacagcaggcttatgaccgcgtggttacagaaccgtcacggaagctcaggctacaccgacaccgggatatcgcagtcatcatcgccacgtcatggttccgaaaagcggtcatcaccacgcacaatccgaccatctgactaccctaggttgtcatgacgaacactgtgaccattccttccaacgtgcttccggaagacggacgtttcggctcagggccgaccaaaatccgcccggagcaaatccaagcgctcgataagggagcccgtaatcttctgggaacctcccatcgacagacccccatcaagcaggtggtcggctcaatccgcgaaggactgtccgaattcttccagattcccgatggctacgaagtggtgctgggcaacggcggagccagcgcgttctgggatatcgcctgcgcctcgctgatcacccgcaaggccgcattcggcacgtacggctcattcagctcgaagttcgccaagtcagcgcaatccgcaccgttccttgaggagccggagattttcgcaggagagccgggaacatatcgcctgcctgagctcacggaatacgtggacacttattgctgggcccacaatgagacttccaccggcgttgccgcaccgatcaaacgcatcgcaggcaccaaggagcagggtgcgctcacgctgatcgacgccaccagtggcgccggcgcgctgccggtcgacatcagccagaccgacgcctactatttctcgccgcaaaaagctttcggatccgatggcggactatggattgccgtactctcccccgctgcaatcgaacgcgcctacggcatcgccaaaagcgtggatcttccgggcgcacgccgctggattcctccgttcctttccctgacttcggccatcgagaattcccgcaaggatcagacgctcaacacgccggcagtggcaacgctgatcatgctggaaaaccaggttcgttggctcaacgacaacggtgggctcgcctgggcttcggcccgctgcgcaaggtctgcgtccctgctgtaccagtgggcggagaagtccgattacgcctccccgttcgtaaacgacaggaacgcgcgctccaacgccgtggtcaccatcgatatcaacgatggcatcaatgcatcccaagtggtggcggcattgcgcgaaaacggcattgtggacaccaacggataccgtaagctcggccgaaaccagcttcgcatcggcgtgttcccgtccgtggaacccagcgatgtggatgcgctcacccgctgtatcgactacgtggtggaacatctctgatgcaaggtaaggtgtggcgatatgaagattgctccgattattgatcccagcgtgaggaaaccttcgccgaaaccggtgcgcgtcgacctacgcaaggtattcatgtttggcaccgcgctatgggccatcgctttggtggtctgcatcgtacttatcgcattcggcatcgacgcggaacgcgcgcaaaccgtctgcgaagcgggtacggtcatcggcgtgctcatgctggtttgggagcatttcgaccgttgggattatcgccgtcttggcgagtaatcggcaatatacccccgaaaaatcctcaaaaaaatatgatgcccgtcttgccttatcgaaagcgagacgggcatcgcattatctccatttgagatatttgcaacatctgccgaatgtcttacatcattccccgcccaacggcagcaccaaggcgaacgtgcttccctgccccgggctgctccacaccgacgcggaaccatggtgagtcaacgcaacatgcttgacaatcgcaagtcccaagccaatgccgtcaccggaatgctcattctgattgctgccgcgatagaaccgttcaaaaatacggttctgttcgccgatggcgatgcctttgcctcgatcgagaacactgattaccgcttccgtatgctcctcattggctttggcgacgacattcaccgtagaaccgtcttttgaatacgtaatcgcgttttcaatcaattttgcgagcgccgcctgaatctgatcggcttcgccattgatgcatagcgattcgtcaccgccggtctcgatggtgatgccgcgttgcgcagccatatcgagatgcgcctgcaccacggcttgtacctgttccatcacgttgatgcgattgtcggcggtcggcaggattggctcctgcgctttgatcagcagcagcagatcggaaatcatatgctcaagacgggaacaggattgacgcagctgcgtggcgttgcgttcgacgtcctgttggctggcaccgccccgttccacaatgtccgccagctgttccaatgattgcgtcggctcaagcaattgttcggaaacgttggtgatgaacgaatcgcgcacctgcgagaatcgtacgctttcgctcacatcgctgatgagcacaaccatgagattctcattgagtttgccgacgatgattttcagccagttgggtcgggaaacggttgcgccggaagtattggggtttgactgccctatcagtgcctggcgcgcgatttcacgtgtggttggtttgcctgccttcggcacttgctgggcgacatattgggtggtggtggtcaaatcaaattgtttgttgccgccacaggaacgcacctcatgcactgcgcgaagcacggtctcttccgcgatggcatcatcgcgcaccacgccaagcgcatacgccgacgggtgcgcgcgaatcacttcgtcatgctcgtcaactacgacggaagccaacggcagcatggaaagcaacgcgttggtggcatcatccaatgtgtcgtcatcggcatcatgctcatcatcgtcgttgcggtgcgtcagcgaacgccaccacgaacccaaagattcaaccatggtttcattgttgcacactcttgaggctccccaactcgcgacaccaccgctcgttcgtgaacacaaggtgaacgcgttggtgaactttgacggaacaacacgagcagtggttacgaatatggcgtttgtctaatagacttgtgagaggttatatcgaacccagatatatatgaagcattgaaaggcaagtcacatgcgcgttattttcaacgaggagctcaaggctgttgccgatgatctcgaccacatggtcaaaggcgtgcgcaaggcgatcaacggtgccggcgacgcgctgctgaaccagaatcttgaagccgcccaggccgttatcgacggcgacatcgaaatcgatgccctcgaagccagcgttgtcgaccagtgcgtgaagctgctggccaagcagaacccggttgccaccgatctgcgcgtggttgtttccaccatgcgtttggccaccaccttcgaacgtatgggcgatctggcccgtcacatcgccgaagccgcccgccgcacctacccggcttccccgctgccggccgaagcccaaccgctgttcgccgaaatgcaggcgttcctgaacgacgtcgccgaccagaccgtggccatgctgtctgaccgcgacaccaagaccgccgaacagatcatcatcaacgacgacaagctcgacgaactgcacaagaagacctttgaactggctcagtccgcggattggtccggcaccaaccagcagctcatcgacgtggtgctgatcggccgcttcatggagcgtcttggcgatcacgccgtgtccgcggctcgccgcgtggtgtacatcgtctccggtttcgacccgtccaaggagccgacccgcgacgaagacaccgacatcgcctgatttttttcttgcgatcttctttttcatcttctttttgagaaggcggcttccgttccccactgaagccgccttcttgttttgtttttgcaatctttcagcacgaatcgtcaagcactatctcccgcattatttcactttcgtcaagccgtaagaaaaattaaacaatctgtctattttttgcccatatacttttacgcaatgtcgcggcacaatatgtgcagtgacatccaaaggaggcagtcatgtattattccaacggcaattacgaagcattcgcccgaccgaagaaacccgaaggcatggacagcaagaacgcgtacatcatcggcaccggcttggccgcactcaccgcagcctgttacctggtgcgagatgcgcaactgccgggcagccacattcacgtattcgaaaaggacgcggttccgggaggcgcctgcgatggcgcaaatattcccggcgttggctatgtgatgcgcggcggccgtgaaatggacaaccatttcgaagtgatgtgggacatgttccgttccattccatccatcgaaacggaaggcgtttccgtacttgacgagtattactggctgaacaaggaagatcccaacttctcactctgccgctccacgaaagcgcgcggcgttgacgcaggcacgaacggcaaattcaatctgtcagacaaagcctcgatggagatcatgcaattgttcttcacgccgaatgaggaactgtacggcaagaaaatttctgattatttcgacgatgaggttttcaattcgaatttctggatgtactggcgcaccatgttcgctttcgaaaattggcatagtgcgttggaaatgaagctgtatatccgtcgatatattcatcatattggcggattgccggacttcagtgcgttgcgtttcacccgttacaaccagtatgagtcgatgattctgccgatgatcaagtatttggaaggattcggcgtgcagttccactacaacgcgaaagtggagaatgtcgatttcaagattggcggaggcatgggaccggtacgttcgcataccggcaccggtcaagacacgattttgaagaagcaggctgaatccggcgtgttcgtacgcaatccgtacagttcgccaaccaagaaaatggctacgcgcatcgacctgaccgaagcggatggcaccgcgcgaagcattgatttgggcgaaaacgacttggtgttcatcaccaatggtggctgcgtggaaaactcgaccatgggctcgcaaaccgaagcggccgcatgggctccggaaatcaagcccggcggcggctgggacatgtggcgtcgcattgccaagcaagacccgagtttcggtcacccggacgtgttctgcggcgatccggagcattcgaagtggatgagcgccaccgtgaccacgcttgacatggagattccgccgtatattcagaagatctgtaagcgtgacccgttcaccggccatgtggtgaccggcggcatcgtaaccgttgaggattccaactggctgatgagctggacgttgaaccgtcaacagcagttccgcgaccagtcgaaagaccagctgtgcgtgtgggtgtacggtctgttccccgacaagcccggcaactatgtgaagaagccgatgcaggaatgcactggcgaggaaatctgcgaggaatggctctaccatatgggcgtgccgaccgacaagatcaaggaactcgccacgaaccatgcgaacaccgttccggtgatgatgccatacatcgacgcgttcttcatgcctcgttccgccggcgaccgccctgatgtggtgcctgatggtgccgtgaatttcgcattcctcggccagttcgccgaaaccccgcgcgacacgatcttcaccaccgagtattcgatgcgcaccggcatggaagcggtgtacacgctgtgcgatgtggaccgtggcgtgccggaagtgtggggttcggtctacgacgtacgcaacctgctcaacgccacagtgatgctgcgtgacggcaagccgattaccgacatgaaactcaaccccattgaaaagaccgtgttgaagcagattctgaagaagctcgattccaccgatattccgatgttacttaaggaatacggcgtgatctgagccgattgcgattgacgtccgtctgccgcacatctcatgttccgtatttcatccggcagacggacgtaataacccaacaaagataccggacgcaaaaaggtggaaacccacatactgtggatttccaccttttcatatacgttccgtacgattgaacgcgattacctgcgtatcaatcgcaacaaactcacttctggccctgggcggcgacagcggcggcaccagcagcggcggcttccggatccagatactcgccacgcggcttgatcggcttgaagttctcgtccagctcgtacagcagcggcattgcggtcgggatgttgaccttggcgatctcctcttcggagaggttgtcgagcatcttcacgatggcgcgcagggagttgccgtgagcggcgatcagaacggtcttgccagccttcagctccggctcgatgtcggacttgaagtacggctcaacgcgcttgaccacgtcggccaggcattcggcttccggaaccggatcgccggtgtagcgcggatcattgttctgcgcgtactcgtcgttcggatcgatctccggcggcggagtggcgtaggaacggcgccacagcatgaacttctcgtcaccgtactcctgacggatctcggtcttgttcttgccctgcagagcgccgtagtgacgctcgttcagacgccagctgcgcttgaccggaatccacagacgatctgcctcatccagagccacgttggcggtgttgatggcacgacgcagcatcgaggtgaaaacgatatccggaaggacgttcttctccttgagcaggcggccgccgttcttggcttcctcgacaccctgctcggtcagcgggacgtcgacccagccggtgaactgattggttttattccatgcgctctgtccatgacggagcagtactagtttgtaagtcatacctgccagtctaccgcctagcacgcccaacacaaccgtcgatgacgattatttggttacgttcatgcaacaattttcattctgttgcatgccgtttgcatcatcaggcaatcgccggtgctcaatgacgaaatcgtaaatgcaggatgcagctacgccatgaaaccggcctgacaggcattgagcacgaacgcgccggctgcgaccaacgaggtcatcgagcacaatggcaacgcccgacgccactggtcatgccggacggccgcgacggcacgagtagcaatcgccacacaccctgcgatggatacgaacgccgcaaggctcatccaatcggcgtttccccacgaccagtcaccgcatatgccatattccgtgcatgaacggtcgcgatccacctccgcaggcagctttatgagcagatccagaagtttggcatacaccgataatggcatggcgaaaaccaccgtcagaccagcagcccatcccagcgcacgcatgcaccagcatttgcccttcccactgccgatgcgcaccatcagcgtgcgcttgccgtgcgcggcgtcatcttcgagatcgcgcaggttattcaccatcatgacgctgacggacagcaggccgcagatcaccgaaccggccacccccgtcacggtgatcgacccgcttagcgcatactgcgtgccgagggctggaaccaacccgaagaatacgaatgccgcaagttcgcccagaccccgatatccgtaaggatgccgaccgttggtatatccccaggccgccaccagacaggttgcgccaagcgctatcagccaccagcgaccagttatgacgacagcgaccagtccggcggcacaggcggctaaagcagcgaccgcggcagccagcaacacgtgactgggatccactccggaagcgaccaaccgccgaggtcccgcggcgtcactgcctcgtcgggcgtccgtgccgcgtacaccatcggcataatcgttgagataattcacagcaatctgcagaccgaccgccaccacggcgcacaacatcgcaacgaccgcaaaccacggccgagaaaacgcacaataccccagcacatcaccagcatcatgctcttccagcaatcttcccggaaaagctgggcacgaccgcaggccacccaaagcctcccaccgccaactggcggcaacgccgaccagaaccggggcaagacccagcggcagcgtttgagggcgagcgccacgaatccaaatcgtcattcccatgaacgccattctagaatcacactcacgattcgccttccaaccgcctacccgcattccagattcacaacctgaccatactcattgatatttcgtctgtttccagaaatcgacacaataccggagaatgccccagaacgtcactcatgcgaaatatcatgaaacccgtgggatttcttttttgaaaacatggagagcttcaatcgcaccctgcgattcagcatcctcacgcccatgtattctgcggtaggcaagctgggtggtacgaaagggatacgggaaaaagggcattcgcgaacgaatgccccaaatctgcgaccaggtcacaacactacaggtcgcagattattcttgccgtgcactgacaagaagtccgatacggcgcaaagccttccggccttacagacctgcctgctctgccacaaaatcaccgagagccggcataaccatttcgcgatgcttcacattgccgaaaccatggtcgccatcctcgatgaccttgagctgcatattttcgccatacacatcctcgtaccgacgaatatagtcaacaggaatgaaatccttggtgccatggatggcaagcaccttaccgcgatatccgcaagccatgccgtaaggatcggtacgacccgcatcctccaccatggccggtcccatggcaacacccataaagtcaagatagccttgctcttcgatggcagacagaggcttaccctgaatatgcccaccggcaatctcatcaacatacgaagtggccgtagaacacagagcgatcgacttgggctgcccaggcaccttcggtgccaacagcgtgcaaatcaccgcgccaaggctcagtccagcgaaatgcagattatccggatcgcagccgctcatatgacgagcctgctccactacctgcaaggcgtcttcgacatcgccactaacggtggtatcgaagaaagtaccatcactttcgccatgaccagcacgatcgtaagtaacgaccacgagaccacgagaagcaagttctcgcgccatttgcacgacaaatccggaaaagtcgatgcgattgcccccgaagccatgaaaaagcaccgccaccggcgaatgtccgtcttccgaaaaaccttccggcagataacgggtacctcgtaacgtcaaagaagtaccgtcggcacgttccactgtgaaaacagcaggttccataacactcatgatgatttccttattggtttgtaaaacgaatgttccgggcttcgaacggaaaagggaattgggatcaaaccgtttcgaagcccgaagcgcgatacgcagggtgcgtttactcagcaacgacctgattacggactgcgagttcctcacgaatagtgccgatctgatcatcgaccttgtacagcagcatcagcacagtgccgatagcgcagcaggcgatcggaatccacacgaagttgatgttgatggcgttcagagcttgcgccgtctgctcttgattaggcacaaaaccgttgatttccagcacaaaactggagagccagccggcgatgcccgcaccacaggtaacaccgatggccgcgcaggaagtaatcaagccctggctacgcacaccggtcttccattcgccatagtcaaccacatcggccaacatcacgaagcccatgctttgaccagtctggaacaatgccgaaaccgccatggatacgaagatcagcggaatggacatgatcttggcaccaacgtacagaccaagcagaccaataatgccgaatccgaagaacatgatggcgatattgcggttcttcatcttcttggcgaagaacggagcaagaatcataccggcaatcatgccagccgaattgatgccattagccaaagaggaaagagtttcgttgccgacgttgtacttgaagaagtacacgatggacgaggccttggttaccacaccaatgaacatgacaaggttgagggtgacaagaatccaccatggcccattgtgcagcatggccacgaaactcttgatgaacggcggctccttctccttaggggtaaacacacgttcacgcgtattggcaaaagtcagcagcaacagacccacgcagatcacgccatagatgatcatggtgacggtaaagcccaactgctgattgccaccaccgatcaggttgaccaacggcagagtaagcataccagaggcaatcacgccgatctgaccgccgacattacggaaagcatttgcattgacacgttcctgggcgttggtggtgaggttcggcagcagcgcggtgcacggcgtggtcaccgtgacggcgaggaaattcatcatgatgtacgttacgtacacataaatcatcttgattacgccgccgaagttcggcaccgaaaacgccatgacacctatgatggcaaatggcgcaccgaaccataggaaccatggacgcaccttgccccacttggtatgcgttttatcaataagcgcacccaccaccggacctgcaatcgcgtcaagcacacgcaccaccaggaacagcgtaccgacagacagcaggctaatgccggccacgtcggtgtaatagaacatcatgtacgtggtgaccacgttgaacaccagattgtacgcgcaatccgacgctccatagctgagcttctccttaagggagagcttaacgttcgcgttgtccacaacaactcctttgtcgagaatcccgaacagcccgtgcaatacgagccatcatgccattcgcagcaacgcgatgacaatgcttcttatccctgacggccgattcgcacctgcgctcattgcgtatattgcattttcgccgtctgatgtcagagtagagaaaatgaaatgcaaattcttgagatgataaggaaatttctttcttgcaaatgtcaatatacagcagataaacagcaattatcatgcactccaacacaatgattacactgcatagcaatcattagaagaaatttctctactatactgctatcatgacactgtcttcatcgcaaaccaatatgcgtaccgccagtcaacgaccgaagctgtcgcacatcgccaaacttgcgaacaccacgccatccaccgtctccaaagtcatcaatggacgttccggagtctccgacgaaacacggcaacgcattgaagcgctgctcaaagacatggaatacagcaaaccgccagtcaaacacgcgctgtccacaaccatcatgttggtgctcgaatccatggacaacccatgggtgctcgacatcatgcaaggagccaccgacaccgccgtcaaacgaagcatgaccgtgaccatctgcgcgaaaaacgcctccgatggcatcctcaacgacacctaccggcaagcaatccgccgagccagacccaaagcagtgattttcgacaacgcctacgtgccaatgcgagatcgaacgctttgccaagaacttggagctcgatatgcggtagtcgacccatccggaacaccatgcaaagattgtatggacgtgcgcatcgacaattggacaggcggattcgaaatcggcagccatcttattaacttaggacaccgccaattcgcggcaattaccggcccaatgtccaccacctgctaccccgccagattggctggatttcgtgcggcactagcacagcatgacatcgttctcaacgacactcaagtgcgagaaggcgactactggtcggaaaatgcacgcttgcacgcgcttgatctactgcaacaaaagaatcgtccaactgcagtatttgcctgtagcgatacgcaggcattcggcatatatgacgcggcacatcagttgggactgtcgattcccgaagatctgtccgtcaccggattcgacgacatcaacagcgcacggcatctcggaccgccattgaccaccatgcggcagccactggcggaaatgacccgagcaacacttgccacattactatccaaacatcagtccgaagacgcgcagcgcacgctattgtttccaccaacgcttgtcgtgcgcgaaagcacaggaccagcgccagaaattagggaataaaacagaattggggattaaaagacgcggggctgcctggttgtacccaagcagcctcaagtgaagccgatattgaattaaggctttgccttaattcagcggcaatttttataaggatggctccggcgggctgacggcccactgggccgtcagcttttccgcctcgcgtgaagccgatattgaattaaggctttgccttaattcagcggcttcactagcgggaaggtgatggtttcgcggatggtggcgccggtcagggcgatcagcagtcggtcgatacccatgcccatgccgcctgccggaggcatgcccacgccgagagcctcaaggaagtcctcatcaatatcgcaggcttcttcgtcgcccgcgagcgcatccttggcctgagccacgaaacgttcacgctgcacaaccggatcgttcaattcggagtagccggtggccagctcgaagccgcgcacatacagatcccacttctcgaccacaccgggcttggaacggtggcccttgaccagcggggaggtttcgaccgggaagtcacgcacgaaggtcggctcgaacagcttgtcttcgtagaagtgctcccacaggtgttcgacgagcttgccgtggttctccacatcgtcgcgttccacaccgagcttgtcggcaatggcaccgagatgttccacggaagtacccggattgtccgggccgccattcggcacgatttcctcgccgagcgcttcggaaagggaatcatacatgctgatggtcttccattcgccgccgaaatcgtattcggaaccgtccagcagggtcaccttgtgggtgccgaacacgtccatggcagtgtcttgcacgagctgcttgacgagcgcgccgatggtgtcgtagttgccgtaagcctgataggcctcaaccatggtaaattccggagcatgggtggcgtcaacgccttcgttacggaagtcacggttgatctcgaacacgcggtcgatgccgccgaccaggcaacgcttgaggaacagttccggcgcgatacgcagatacaggtcaaggtcgaacgcgttcatgtgcgtggtgaacggacgggccgcagcaccgccgtgcacggtctgcaacatcggagtctcgacctcgaggaagtcatgatcggcgaaggtcttgcgcagggaagcaacggccttggagcggttacgcaccatgttgcgcatcttctcgtcggcgatcatgccgatgtacggcttgcgggtgcgggtatcctcgttcaggtccttgtgcagggccggcagcggctgaagcgccttggctgcaatggcccattcggtggcgaacacggacagttcgccggtcttggaggcaatcacacgacccttgatgaacaggtgatcacccaagtcaaccagctgcttgaactgcttcaaggaatcggcgccaatctccttcttggaaatcatgccctggatcttggtgccgtcgccagcggaaagctgcacgaagcacaagccaccggcgttacgcaggaagagcacgcgaccggcgatgccgaccacgtcttcggtttcatctcctgcttcaagcttgccgtcatacttggcgcgaacctcttcaatggtggcggtgacgtccaaggtcaccgggtacggctgaatgccgtccttaagcatcatggcacgcttggccacacgcatctgcacctgttccggatgcgccagcgggccgaattccttattgcccggatcgacggcctcatccagggtggcgccgtcattgatcttggcgtagatagccgcatcctgctgcagcagcatttcggcgcgctccaccgtagtcatagcgggaacggcagcctcttcattctgattttcttgcgattcgatggtctcactcataagcccacagtgtaccgagaagccactacaccacacgcgacacgccgtatttgcattacctaagcaatcgtgtaatatttccaactgttgccaaacgggctgtagcgcagcttggtagcgcgcttcgttcgggacgaagaggccgcgggttcaaatcccgccagcccgacaactcaaggcggaacttcggttccgccttttttatttccagcgcatcagcggtgcaaaacagcatatgcgagacgcaaccacctgaaaaatcaaaaaacacgtaatacacaagcgcgtaaacaagcgcgcacaccaacacgcttcacattcatggaggagagactgtgaaaagaagcattctggctttggcttccggcgcctttattcttggtgccgccgaattcgtgatgatgggcattttgcctcagacagccgccgccatgcaggtcagcattcctgcggcaggccattatatttccgcatatgcgataggcgtgtgcgtgggcacgctgattctggtgttcggccgtaaggtaccgccgaagaatctcattattctgttcatgatcatcgcactggtcggcaacacgttgagcgcggtttcgttcaattcccccatgttgttggctgctcgtttcatctcgggcttgccgcatggcgcgtttttcggtacggccacgctgattgccaagacgttggccgataagggcaaggaagcgcagtccgtgtcaatgatggtgacgggtcagacggtggccaatatgttgggtgtgcctgcgggcacattgctttcggaaatgctgtcgtggcgtttggcgtttgcgattcttgccgcttgggcgttgatgacgatgatgttggtgattgcgtgggtgccgttcgtcgcgccgatcaaggacgctggcattaaggggcagttccgtttcctcactcacgccggtccgtggtttattctcatggcggtgttctgcggtaattccggtattttctgctggtggagctacgtttcgccgtggctgcagaaggtcggtggatgggattcttcgctggttcccctgttaatggtgcttgccggtttcggcatggtgatcggtggtattgcgggcggccgtttgactgatttgtggaagcctggtgccaccgccgggctttcgcaggccatcgccacggttggtttgctgttggtgttctttgttcctggcaatcatgtgaccaccgctctgctgacattcctgattggtttcgcactgttcttcaactcgtctccacagcagctgctgatggtgcaggccggtgagggcggcggcgagctgattgcgggcgcggccgtgcagatcgcgttcaattttggcaatgcggttggttcgatcgttggtggtgccgcattgacggcaaacaccatgaactaccattacaccggtttggccggtgctccgatcgctttgatcgcggtgattatgctggtcacctattcgcgtcgttacgaaacgcatacgggtgctacggagcgtatgcgcgaagtgcatgtctgacattcgacagtcagttatttcgattatttctgttatgtaacgggatatctcatcacaattattgtgatgagatatcccgttgttctttgtacgacgtatcgcatgttccccatctttcgttgtttcgccgtctgcgatgccgtctgcggttcgggagatgatggaagtcaccgatgaagggattgcgatggcagacagtgatgtcaatctgaatatgaataattgcgatgacggatgcgcaacgtttgatgtacagcgatttttgcgtggtcttgatgcgattttcgatgcgcataaggctcctgaacaggctgaaccgtatctgcagaaggcgcggaccgaagccgaacacagtcataatgacgccggtttgctgacggtgttgaacgaaacgatggggttttaccgttcgcaaggtcgccataccgacaatctgccgattatccgcgaatcgttaagcattgcggatcatttgcatcttcaggaaatcgacccgcaggcgtgggctacgacgctgatcaacgcggccacgggcatgcgagccgcaggccagtacgaggaggccgaacagctgtaccgtcaggcgcttgacgcggccacgtccgccttctcccccaccgaccgacgcctggccgcgctgcataacaatatgtccatgttgtacagcgaaaccggtcgtctcaatcaggcgaagcgcgagctggaacaggcgctggacctgttggagcaatcttcccccgatgcgagcgctgacatcgacgttgcctccacgcacaccaatcttgcattgctgctcctgcagatggaccggtattgggcgagcgatgccatacagcatgcccagaaagcgttgacaatctaccgtaccgggcatttggaacatagtgcgcattatgcttcggcgctggccggctatgcgcaggcctgctatatggccggctgcctgcaggatgcggtttccggctatgagcatgcgttgagcgtgattgaggaatgctacggacgcaacaccgactactatcacacgactgcagtcaatcttgaagtggcaaaacaggcgttgcataagcacatgccatcatctcataaaacgcgggaatcgcaagaatatcaagaatcgcaagaatccttggaatctcagcatgcaccgaaatcaatcgaatctcagcaatcaagtgaaccgcactatatgacggaatccggcgcatcttcgattcctgcgatttctcaccatatttcgggacttgctttgtctcgcgcattctggaatgatctcggcaaaccgttgcttgccggcgcatattcggcatatcaggggcggattgccgcaggtttggtcggttatggttcggaatgtttcggtttcgacgatgagctgtcgcgcgatcatgatttcgcgccgcgtttctgcctgtggcttactgatgaggattatgatgcgattggcgagcaattgcaggctgattacgatgcgttgagtcgcgatttcactgttgccgagcagggcaagccgcattttgcagggcatggttcggctaattccgacgctcttgccgcatctcaatcgccacttacgccgcgtgcgcaaggcgagttccgccgtgatggcgtgtttcgtatcggcgattttttcgagcggatcacgctgtttcgtgaggctccggcgcagaacgactatgcgtcttggctgagtttggacgaagccacacttgccactgccacaaacggtcaggtgttcgctgatccgttaggagtgttttccaagactcggcaggggttcaagttcatgccggaagatgttcgactttccttgatttctcgccgtttgggcatgatggctcaggcggggcaatataatctgccgcgcatgctgcaacgtggcgatggtgctgctgcgatgttgagcattcatgagttcgtgaacgccacggcttcgttgatgtttctgatcaatgagccggtgagcgttgggtatctgccgtattacaaatggcagtttgctgccatgcgcaagctgagccgccgtatggcaacaaggcttgccggcgtgtgcgaacagttggaagacatattgcgattgagttccgccgcatgtttcggtggtgtcggtttcggtgagggcggcaagggtgcgaagcctgcggcggagcgcattatcgccactgttgagcgcatctgcagtgatgttgtggatgaattgctgcgggagggattgaccgaatcccacgaaacgtttgtggaatggcagcggccgtatgttgagaaccatatcaagtccgacgcgagttgtctgcacagcctgtgacgtgcctacaatcaaaaaatccatcgcaagcattgcaaatcagagcaataatcagacgaaatcaagaatcgaaatcatatgaatagcagcgtaatttcagatgtaatagacggtcacgatacagcaaatcttgttgaatccattatcaaactggagtggaatcagtttcagcaaaccaataatgagggcggccgcgcgtcctgccaaggcaattggccgatgtttcatcagatgcgtgccagtcagttcatgacgtggccggaggaattgctgcgcagttaccggtcggacttgcaggaagccgaccgtgttggacgtaatttggtgacggaaaagtatggtcgcatgatgcaatccacatatccacaggagtattgtgcaaacattgcgccgtatattccccggatttccgcgaatcgcaacgtcttgcaggaaggcatcataacagttcaggtgtcgtgggcgcgtgattttcgtgagcgttttcctcatctcggcgaggcgatgcgtgtgctgaccactgtcgaagatacgccagagaccacgtcgttcgaaacgtatctgcgcggcgaattgggcacctattccgaccgtaccgtggcgttgtaccacgattttgtggagcgtttgcggcatgagcggcgcaatctcaccgaagagacgattcgcaatacggttcgtttggctggatttgaggatttggcacaggctgaggccgcacagtaaacacagtgaaaacacaccgtgacaattactgaaaactgcagtaagccccgtacatcaccataaaaaatgaccaccatggtacgaccaaaatccaacgtcaagatggaaagcaagtgttggatttggtcatgccatggtggtcacgtatttgtttgcgatgtcagcctcgatttcgttggtgcggctgatatcaggggctattcagctgattctcacgatcgttccgaaatcggtgacttatccgaatcagtcgaaaaggccgtggcatccgagctatggggagcgtcgaatggatcgtcgctgtccgcatcgcctccattcttggatcggtttgaacgcaccgcgctgactatcgcccagatcacggcgacggcgataagcagcacgccgatgcctccgagcaggaatacgaagaactgtttcggatcgctggcccaccaccagagattcattggcacatgcatgccgcaaagcagcgtcaccacccccatgaagcacgtgaacacgccgagcgcgatggtcgaaccgcttcttccggaaggtctgatgatgtcgtctccagtctgccgattcttgcgcccatcattcgcaccggctaccgaagcggtataggtcggaacgccttgcgctggagcggattccacgcgcggcttatcatcctgcgttgcacgcccactgcgctgcgactggtcatacgtggactgcgcatccacggtatgcaacgtttcggtaggcatatctccggcatcagccatgaccggcatttcctgggtcttgtcgtcgctcatggtcactcctttcccgctttgcccaatgtgttgtcggacgcatactgcaccgcgacgctgccgccgaccgttgccatagtattgatccgcagtccggttggcatgaccggagccttgccatcatcggtgaagcacggccaatattgatgattgtcgtagatttcgcggtaggccttatctacattcccgtctttgaagggggaatcggtcctagtggaatcggcgccggtatccatgccatcttccgtatcggtctcatcatcgaaatcctcgatgccggattcgtctccgtacgagccgcaactccgatcgtaagttcccagcgcacgctttttcactaccgatttcgtggaatcgttgcccataagcgagacatagatattgccggaatccaacgtgagcccgtccgaactgccgacgaaatcggtgatgttgtagaaattaccgtcagacccgaacgcccaccagcagccgttcggcaaggtcaccacgacctgtgcgcttgaggccaccacattcaacgttcctgtagggcaggaagtcgtgccctgtgtgccatcctgaagatccactttgtgcggaccgttgtttttcgcgtaatcgcttaagtcgatatgcagcacgtcggtggcgtaatcatcgccttgcgcgacgatgccctgctcgtattcgctcatttcactggcggtggagcccatggtggtcattcccgacacattgacccttttgtaggatgagggaatgctcgtgtcaatccgatagctgaacagcgaataacccgccaaagccatcaccatgaccaacgacatgaatacggatatccatgtcagaggatgcaatcctcccgttcttctgcccgcgaatccgagcgcgacaataacgattcccgtcaccagacagatgccaccgacgaatgccgcgcatgcctgcaacgtgtattcggtgccccgctgcccgccttgaacgccgtacgtcataatgcaccatacgcatagtgcgcatgcgatcatcgtgagaccgaacatcatcaataccagcagtggaccagccggcttacggcgcccccttcttggctgcgtaggcgcctgcgccaccggggctaccggagcggtgaatgttggtggaacattggccgtggcaaaagcggccggaccattggcctgctgttggtaggcatgatactgaggctgttgaggctgagggcgctgaggctgaggcgattgcgattccggtgacgaagccgtgttggccaccccgttatatgcgccgctcgcctgcatcggctgagtataaggattcgattgcgctggagacggcgatgcaggaggcaccggctgtccgtacgaaggacttccatattgaggctgaccatattgcggttgaccgtacggagcctgaccatacgggggctgctgccactgatttggaggaacattcggcgcataaatctgcctattgagcagaagccacagcaccaacgcggccaacgcgaaagcaaaccatcctgcccccggcaaacagatggcaacaaggcagcacaacagcgcgccaatgcaattccaatcccacttgccgttaatcaaatcctcagcaagaatctgattgtcgcgctcatccggcagcacaaaccacgccaggccatagaacgcggcacccgcgccgaaaaacagtgtggcaaccatcataagcgcacgaaccaacgtggtattccaaccaagacgacgtgctatgccatcgcacacgccgccaatccaacggtcatgtccacgcttgacctggctggaacgaatccacgcgaagaaacggccgccgcgggaaggttgcggcgaaccgtacgcaggctgccgatgatacggctgtccagcagaaggctgcggccctgcgttgccgcgatcgcccagcggaccattgtttgcattgctcatggttccattacagcaactcgcgcatgccacatgtatcggggaacaccctgaatctgccctgaacactatatgaatgccctgaaacggcgtcccttacaaggcacaatagaagtatgaaatccttaggaaaaccgtggtatacgcaaagccaatacgaccaggcaagcgccgtatatatgcgctactgctgcgaccaggccctgcatgagggacgtccgctgccgacgcagccggccaaactgccgttgatgcgtcctccatacggacgcatgggagccggcgtatgcaaggcgatcagcatgcatttgggcattgccgtgctatgggtgcgcctgtttttcctcgccaccacatgtctgttcggtgcgggactgatcgcctatattttcctgtggatggcgctgcccgtgggtgatccagtccagcaggcgtacattatcgcaggcaagcgttcgccatggcaggcaccgctttccagaggcaacatgccgtacggaacatatcctgtttccctggaatatcaatcttttacagctccgcaagatggtcagcacacgcaaccaccatcttttgaagatacgactgcatgcaacgacggaacgcatggcgatacgcaatcttccagcgaaagtcttgagcagacactgaagaaagcaccaaaacccgctttgcttgcattagctggtctgatgctgctttccatctgtttcgtcatgttcgcaggcggtgttgaacgcactctgattgtgcccctgctgcttggtctggtcggcatcggcgtctcctggttgcgtttcaatgccgaagaaggtcagttatggacgatgcttggcggcattgcgattattttcgccgcatacgctttgtacgtcagttcctgcatgcattttgacgcgttttccatgattcgcatactgtgcgccggtttggcactgctgattggcgtattgcttgcgattgtgccatggatcatggcgctgattcgcgatttgggtacggaacgcgcatcgaaggaacgcgaagaggaacgtgccgacatgaccgcgcatctgcatgatggcgtactgcaaacgttggcgctgattcagttgcatgccgacgatcagcagacggtgttttcgctggcacgttcgcaggaacgcgaactgcgcgaatggctgtatcaggaacgcaccacgtctgaccgttccgtgaacgccggcttgaaagaaatcgccgcacatgtggaagacacgcatggcaagccgatcgaagtggtgacggtgggcgacgcacgtccaagcgcgcaaaccgatgcgctgcttgacgccacgcaacaggcgcttatcaatgcggtagcacatggaggagagccgatttccgtctactgcgaggcaagcagcaaactggtggaagtattcgtgcgcgaccatggcaacggatttgacgtgaatgtcatccccgcgaatcgccttggcattcgtgaatcgattatcggacgaatcaagcgtcgcggcggtacagtggagatagtatcaagaccgcaatggggcacggaggtacgcatgcatatgccaatcgcagacatgcccgcaaccgcggccgccgacacgaatgcgcagcaatcacacgaatcgcaaagcaactcacaacaaaccgattttcccaatcaccataaccgtcaatccaacaatcaacgtaccaatcaattcagcaatcaacctaccaaccattttgaggagcagcaatgaacgagcaggaacagcagatccgcatcgccatcgttgatgatcatgaaatgttccgtgcgggcgttatcgcaacgctgcagccgcatttcgacatcgtcggacaagcggccgatgtcgagggatcggtggcgatgatcgcgcagacgaagccggatgtggtgctgcttgatgtgcatgtccccggcggtgagggcggcggcggagccgaaattctcgtgaaatcgcgcgcatactcccctaataccgtgtttctggcactgtcggtgtctgattcgccgcaggatgtcggttcggtgattcgtgccggagcgcaaggctatgtgacaaagacgatttccggcgatgatttgatttcttccatcaagcaagtacatgagggttatgccgtgttttcgccgaaattggcgggattcgtgctttccgctttccaaaatggctcaccggctggcatgggcggccctgcaagcggaccgatccacgatgacgagctggaccgcttgtcgaaccgtgagcaggaagtcatgcgcctgatcgcacgcggctacacgtacaaggaagtggctgcggaactgtttatttccatcaaaaccgtggaaacgcacgtcagctccgtactacgcaaactgcagctgtcaaaccgcaccgaactcacccgctgggccgccgaccgccgcatcgtataaccgaagaatcttccggcttatttcgtcatattctgcgtagacgttgcggacaggcgtacatagccggaatgatgcatggtgaatcgcatgcgatcagcgatatacacgtcagtggcacgctcgaacgggcatccattcgacgcataggcgatccggtgaatgcgcatcagcggagttcccgcctcgatctgcagcagctcgttctcctgctcgtcgccgaccaccgattccaatgtttcgtcgacattgcacggatacacgccataatcacgttcgaacatggtgtagaacggggtcgtcaaatcgcgtgtaaggaacagaggaaacagatatgccggcaaatgcgaccgttccaacgaaagcggccgattttcgatataccgcaatcgcgtaatgtcgtagatcatcggatgctcgcccggtaatcgcagcaaacgcacgtcggaaacggaagccggggcaatcaccgcctgcaatactttcgacgaaacgcgcatgccttgtcttcgcgcgatcgtcggcaatgattccaccgtgttgatattgcgttccaaacgtccgtccgatatgacgatgcccccggcacgaccgattttgcggatgatttcatgatcggattccaacacggtcaacgcattgcgcaaatcggaacggctgacgccaagactgtcggcgagcgcccgttccgatccgagtttctctccgggaagaagctcctgttcacgaatgcgagcgcggatacggtagaccagttcgctcgtagcgcttcgcgtgcgcctgatgccggtatgatcttccatatccgcgccctttctttatggttatctgtcgttttacagcttcaatgtttccagagtcttcatgaatccatccatgaaccaatccacatcggattcgctgaacaccagcggcgggcgcagcttgaggatattgccgtaacggccgcatacggaggtgaggatgtggttgtcacgcagggtttcgaggatatcgagcgctgcctgctggtcgggatccttggtgcccggcttgacgatttcgcagccgatgtacaggcccgcgccacgcacgtcgccgatgcaggggtgtgccggcataagcgacgcgacggcatccttgaatattgcgccgaccttcttggcgttgctcatggtgtcttcgtcacgcatcacgtcaagcaccgcctgggccgcggccatgcataccgggttgccgccgaaagtgttgaagtaaggaatggagcctgcgaacggttcaagtacttcgtggcgggcggccatcatcgacgtgggcagaccgttggccatgggcttgccggatgtgaccagatcgggaacaatgccttggcgtccgaatccccagaatgcgtcgccggtgcgagtgaagcccggctgcacttcgtcggcgatccatacgccacccagttcatgaacggtgtcgatcaccggcttcagatagccgaccggatcggggtacacgccgtcggaggagaagatggagtcggcaagcaatgccgcaaacttgatgccatgacgttccatatcggcaacggccttgcgcacttcgccagccatccagttgccgaattcctcggcggcgcattccgcggcaggcttgccgtcaatgaccaagcggtaagtgtccggcgtgggaatcatgcgcatggtcaagccaagcgtttgcgcggtgccgagcgctggggaaagcttggaggtgagtgccgaattgccatggtaggcctcgctggtcacgatcacgccttcgccgccagtgtaggtctgtgctacgcgaatggccagatcgttggcttcggaaccagtgcactggaacatgatgcggtcaagttcgtcaggcatggtggagaggatatcttccgcataatgcaggatgttctcatgcaggtagcgcgtgtgggtgttgagcatcgaagcctgctgggtaagtgcatccaccacgcgcgggtgacagtggccgacggatgcgacattgttgtacacgtccaagtattcctcgccgtcggcatcccaaagatgcgagccacggcccttcaccagatgcactggattgcggtagaacaaacggtaggccggaccaagcacgtcacgctcttcggttagtttgcgtgtttctgggtcgagcgcggccgccatttccggacggaagctattggtgtccatgatggttgatcgagttgccatgattccttctttcgttggcttcctgtggcgttacccacacggtaacgcagtaatgttgagtggctgatacagcgcagaaacaaaccatttccgctgttttccacctatttggttgacctttttacatatttccgataattgaaaaaggccgcatcccagatgaacacggccttggcaatatcgttttatttcaagaaaacgaaacgataatcgcagaaaatcagtcagtcttcagtcttatatgcgacctttccgccggaagcggcgaactcttcttccggagaaagcaccaggtgcttacgtccgtaaaccgcgaagaagatggtcgcgagaacgtagatgaccaccatggcgtagacggccagtcgataatccgggttcagcagcacggcaacgaaaatgcagaatgcaagcaaacctgcgattaccgcgcccggcacgccgaacgggctggtgaacggacgcttgatatcaggcatcttcttcctgaggatcacataggaaaccatctgcagcagatatgccagcaccgcaccccacacagcgatgttcaacaccaccgaaccggcgccatcaccgccgtacgcgatgatgaacagggctgcgaaaccgatgatcgcgccgacgaccagaccccagtacggcgtcttcttcttaccggtcagcgacaggaacgccggataatagcctgcacgggacagtgaatacaggttgcggccatacgcgaacataatgccttggatggaagcgagcagaccgatcaacgcgaatgcggacagcaccgcggcgagattgcccggcagaatcgcacgatagccatccagcaacggctcatcggaaccagcgagcgcttcggaaccgaccacagccgggttcaggaacacgatgatcagcgcggacaatcccagcgtgaaaatgcacaggcgggacgacttcggaatgttcttttccggctcacgcacttcctctgcagccagaggcagctgctcaataccaaggaacaaccacatggcgaacggcatggcgtagaagatggcacctgggccgaacggcaggaacgcggagttgccttcggtaggcgtgatattgagcagcgtggagaaatcggccttaccagtggcgaaagcgccgataccgaacagtgcgacgatggcgagcgcggcgatcgacacgacttcggcgaaacggaacgacgtttcggcgcccagccaattgaccactacgaaaatcgcatacaaggcaagccaccaaacccaagccaagccatgatcgtcaagcgaatatccggtcaggttcgacaggatcgcatcagcgtatgccgacgagaagtagacgatggtggctgcggtcatcacatactcgatggtttccgcaaggccggtgaagaagccgccccacggacccatggcggcacgcgcgaaggaatacgcgccacccgtgtgcggcatggccgacgccatttcgctgatggagttgagcataagcacgtacatgaggtacaccacgatggcggccaccagcatgccaccccatccggcttgggcgatgcctccgttccagccggagaagtcgccggagatcaccgcggaaatgccgatggcccatagaccgaacgctcccgcggttcgcttaagctgtcgttttgcgaaatagtccttgtcggtttcaacgtaggtcacgccgcctatcgatcgtcccgaaacagttgacgcagtcattgtaatcgccttcctctcttattgttcggcgagttatgccattgattcctcgtttggttggttgcggtcagatgttgttaagttataaaaattgagattttcgtaattgcgtatttttacgtgcttacgattggatttcttggattgtctggtttctgcgtaattacgcttgtttcatgcaacttgcctaatgcagcagccagagcggatcctcaagatagttttttgcgcacatcacgctgccgggagcctgctgtgcagcgagaccgtcgggcagggcatcctcacggtggctggtggtccagccgagcatctgcatgcgtcggatcatggaaagcgcggacatgatacgcagttcctcatccgtgaacgaacctgcgacgcgctggtatcccttgacccacgccttggcaagatcgggagcatacggttcatgttcgatgaaactcagcgatgaagcgtaatcgtagagataccagctgtatccggcatcgtcgaaatcgatgacggtcagtctcccgtcattgccgcgaatcacgttcgacgggcgcaagtcggcatggataagcccccaagtttcgttggttctcggcactttcatcaccacgtccatggccttccacagcgcggtgtcgcacagctgcttctcttcgtcggtgagattggcgttttcccaacgtccccaacgcggtgccggaccaaccatgttcgaaagatcccaattgaagcgggtgaaaccgtacggtttgctccacgtgcgcgactgctcatggaatttcgcagcccattcaccgatcgtctcgtaatacggtgcaggattctcaagatcttccagcacggttccttccacatatttcgtggagatcaccgtccagccgacaccgttcagatcagtgattttcgttacgaacgtgccacggatggtgggaaccggattgatcaggctgataccttcgatatcatgcaacgcattcaaccagctgatttccgacgccaccgcctcgggacctcccacatagcccggctgcgagacacgtaccacgccttggggctcgccgtccagcaacagcaggaacgtcgcgttctcggatacggtgatgaggttgagttgcgcccgctggtggtcgatgccccaagccgcgcaaacgccttggaaaagccagaatggtgcggggcatcctttggtgagcccactgaaagtgtctagactgaccgcttgcgtaggatcgtcaagcaagctagtgatctgctgtgccatggtggcctcgattcatacatgggatttttcctgtgagagacatgtccgtcagtaaaacctcttcacgaaactgtcgatacccacgattgtgccggaatcgtccgttacaatcaccaccgcactgttacgccgcagttacaaaagcgcatcacaagattaatggctcattaccgatgccagccgagcatcatccaagttttggcgcaatatgcacgacatacaaaaaaacggggtttgctgagcagaactcaacaaaccccgcagaatcaaagtccttacctatcctacgatggaatcagtatcagtgacggtaaccagtggcgtgaacaacgccatggtgttcaatgccatctgatggttttccggagaactgccggcgcaggcgtctgccgcgacgcgcacggccacgccactgtcggcggcggcgagcacggtggtgagcacgcagcaatcggtggcaacaccacatacggtaatcttcttggcgcccttgatggcttcgctcaactcacttccccacttgccgaaagtgtcgcggctgaccactgcatggccctttgccaattccgcggtatccgcggtgagatcgtacatcggatcatcgggggctaccaaaaactgcggccaatccttgaaataatcgacccaagcgttttgcggcggctcaggcgcaacatatcgcgtgtagaccacacgatcgccgaacgccttagccaatcgtgcgaacgcttcatcagtagtgtgataggagccgtccgggcaagcccatgcggaccattcactttccgcaaaaacacgctgcctgtcgataactaccagccattcatcttccgcaatcatgacttttcctttccttgtattatcgcaacaagcaactcatgcttccgaaaccggcagatcagcttcctgcttggcaatatctccgcgctggaacatcaacgatcccgcaagaccaatactcagcgcaacaatcacaccaagattggcggcagcccaactaccttctttacccccgataaggaacagcagatacccctgccagttcagccagctggcggcagtgttgaccaccaatccccaaccaagcacggtaccgacgacgagaatggcgaaagacttaccgttccatgcaccgtaacgacccttcggatcatacaaatcagcagtgctgtaatccttcttgcgaatgatcacgtcagccacgaacatgccggcccatacggccatcggcacaccaagcgtggtcagaaaaccttggaacgggccaatgaacgtgtcggagaagaaagtcacgtagaccacgccaagcacagtcaaagcggcggtgagcgcggcagccacagtgcgcggcaacttcacaccgaacgacagcagcgcaagcccgttggaataattgtccataatggagccggacatcaaaccgagcacggccacaatggtgtacggaatcaagtaccaggtcggcagaatggaagccatggctccaatcggatcatttccaacgttttccgccatgtcggcattggaaaccgcgagcagcagaccgtagaaaatcaggaacacattggcaatggacgcaccgaatgtggtccagaacacaatgccgccattggaggagttgcgcggcagatagcgcgagtaatcggcagcgatattcacccagcccaagccaaagccggtcatcacgaagaagcagcagccgagcatggccggcaatgatcccgccggaaccgagtcaatggcggaaaagtcaatatgtccccagccgaggataaagaaaccgacggtgatcacaccggtcacgatggtgatgacctgctgacaacgcataatcaggtcgtatccgaaaatacctgcgaccaccacaaggccgaccaccacaatggtggagatgatcttgggcgcgacaccagagccccaaccgagtttttcgatggtgcttgataatgccaacacagcggtggtggtcagtgaaatctcccagcctaatgtggcgatccagctcagagccgctggcactttggcaccttccacgccgaacgtggcgcgggtgagcaccatggtgggcgcgttgccgcgtttgcccgcgatggaaatgatgccgaccagcaggaacgagatgaccacgccaataatggtcatggcggtggcctgccagaacgaaatgccgaaaccgagcgcccacgcgccgtacgacatggcgaacatggaaacattggcagcgaaccagggccaaaacagactggccggcgtgcccttacgctcctcttcggatatggtgtcgataccctgctcctcgatggagagggtccctttctcattgctcatgtgaaactaatctccttgaatctgccgagcaacgccgcgggcaagcgacatgcacgccgcgtcagcgcaatcgtgcacatgatataaccacttatagtcatttgtaccataagtcttagaacgcccttcctaggagccgctcaacctcctttcgatcagggcaggtagccggccctgatcgcgttacagacaacgccgaagcagcattggcgcaacgtacagcctcctccaacggcacgccttcgcacagcagggcgcacaacacacccgcgtgacaatcaccagcgccattggtatccaccgctttcattggaaaacctggaattcgcagcacttcgtcaccgggaatcgccgaccacgcaccatccgcgcccacgcgaacgattacaggagattgcaatcgatcgcacagccacgcaaccgtctcctcattgacattcgcactctcaatctcttgcagcatatcccgcgaaaccttgcaatcgcaagaatcgccactatcgagcgccgccaaacgttgcgcaatcaacgttgcctcgcgttcattgcacgaccatatcggacgatatgcgagcatcacacggaaaacgtcatcatcaactgccgagatcatcggagaaggatcgaataccgcagtgaactcacgatgttcagtcgttcttttcacaaaagcaagcagcgcgtccgcagtgtgatgcaccaacgtgtatccgctcacatgcacgacatcccgcttttctggattcacagaatcgaacgcatcggcactgccgtacgcttctgcgcccctcgtcgaaatgaacgtccgttcagcattcgcgtcggtcaacgccacgcaaaatcccgaatcgtgcacggcatcccgcttgccgatatgctgaatttcctgattttccaacgtttgcagaatctgcgaagcccacggccccgtaccaatcacaccagcatgagacgccttaacgcccatgcggcgcacggcatacagcgtgttgaagctggcaccaacctgcgtttgcacattgccggcgaacacatcttcacccgcacgcggcaccgcgtccacattcatggtcagatcgacaataacctgcccaagagaaataacttttccagtcattgcgatgcctttcgcacttccgtcatagtttcgctaactacggttcctgcagatcaaacgatatttacatcattaagcgcactatcatcgcgtaacgcgcgtagcgacgtaacagtgccgaccaaatcaaggtgattatcttcagcaagttgtgaaagcacctgatcaagcatggttttgtcgaaaccttgcataccatgccacgcccccagcatcgcgcccgcaatagccgcaatggtgtcagtgtcgccaccgatagaagccgcgaaacacaaagcatgcgtgggatcgtcaaaaaagcgcgccgcaatggcgaaagcggcggccacggactcgttcgattccacgctggtaccgcaattccgttgcagcacagcagcgaattcgttgtcattgagcctgcatccatcagtttcggcccaattcatgaaatattgcacacgcgcaagcaccgaagcctttgccgaccaattgccacgctgtggcagcttccgtacgaattccaccgcgaggtgcaaaaagtcacgttctccttcaatggcaaagctcaccgctgcagccaccaaagtggtcgcttcaatgccctgcaccgtgttatgcgtcaccacacaggatcgccaggcggcgtcggcgagcgcttggcctggacggaatgcgatgcccaccggcgtggcacgcattgcaccgccgttggtggtgccgaatcggccggtctcttccagacttacgccttcggtaagtttttgcagcgctgctttggtggaaggtcccagcaggtcaagcgatcccttggccttcatcgcagcttcccattgcagcagatcgtgggcgtatcgggtgttatcaatgcagccgttatcgtcgataagtcgccgtgcgagtacgaaagcctgttctgtatcgtcggtgacggcaccagctttcatattcggtgcgatcggctgctgcggcacggcattcataagtttcgtaatcggaccgtcgtaatactggcgaatctgctcggccgacatgctttgcgtaggcattcccaacgcatcgcccaacgcaagcccagccatagctcccatcgcccggtccttcatttgcatcccattcttacgcatagtcgcagcagcctttctcatagctcagcctgatcgtacaccgaacaacatcacaatccctccccaatccttccagtcactggaagaaagtggacgtatatcggctccccagcgggaaaaacctccagcaactggaagaattgagacttggacggtgctgagccgaacttgggcggagtttgtccggattgcagcaataaaaaaggcttactgggagcttaggacgctctcagtaagccttgtaggcgggtaaggcgagattcgaactcgcggaggcttgcacctcaacggttttcaagaccgtctctttagaccgctcagacacctaccctttgtgtgtcaacatcactgccaacacacaagatgtcaatatatcacagcgtaaggaagttgtggaatcaggcttcccacttggtcggctcaatgacttccttgccacccatgtaggcacgcatggcctgcgggatgacgatggagccgtccttctgctgatggttctcaagaatggcaaccagccaacgggtggtggccagcgtaccgttcagcgtggaaacggcgcgggtgccaccatcttccatacgttcgcgaatgttcagacggcgagcctgatattcggtgcagttggaagtggaggtcagctcacggtagcgaccctgggtcggcacccaagcctcgcagtcgaacttgcgggctgcggaagagcccagatcgccggcagcggtatcgatgatgcggtacggcacctcgactttgccgagcatttcctgctccatggccagcaggtgctcatgctccttgtaggagtcctcctgcttggtgtaaacgaacatttccaccttgtcgaactggtgcacgcggatgatgccggaagtatccttgccagctgcgccagcctcacggcggtagcaggagctccaaccgcagtaacgcagcggaccgtcagacaggtcgagaatctcgttctcgtgcataccggcgagcgccacttcggaagtaccgaccaagtactgctcgtcaggttcgcgcagacggtagatttcgtcggcgtgggagttgaggaagccagtgccgcgcatcacttccggacgcaccagcgtcggggtgatggccagcgtgaagccgtgctcttcggcctggtccacagccatggtgagcatggcgatctgcatacgtgccacctggccgcgcaggaagtagaagcgggaaccgccgaccttcacgccacgttccatatcgatgccggcaacgccacgaccgagggtcaggtgatccttcggctcgaaaccttcggctgcgaaatcgcggatctgtccaaccttcttgaccaccacgtaatcgtcttcgccaccttccggagcttccggctcaaccacgttggagagcttccacatggcggtggtgtattcttcggctgcggcgtccgctgcggccttgtattcggaaaccttctgggagagttccttggtttcggcaatcagcttggccttttcgtcggccggagccgcggcgaccttcttgccgatttccttctgctgcgcacgggcagcctcgaattccttcagagaggaacgacgaacctcgtcggagcgcagcacctcgtcgaccagttcgaccgattcgccacgcttgcgctgggattccttaacaacgtcagcatgttcacgaatgaattggatatcaagcatgcctcctagcctagtgctgaaagccgacacccgccgcagtcctctcatttttgtatacaacgtgcaggaatcgtcgaataaatcagtcttgattcgcttttttcgcatcttccgtgaacaatagatgacatgcctatgcctgttatcattctgattgtcgttcttgcggtcgcagcggtgtgcgcggccgcctttttcgcagtacgcgcgtataagcatcgcaaacttgcggaacagctcgacaagcgcgacgatgatcaggtgcattacgcgtttgtgatcaatccttcgaaaccacaggcggaacaacgcaagcagcatattcaggagttctgtgaggcgaagcatctcacgcaggttgaatatatcggaacgcagcttgataaggatggtcgcgcctgcgcgctggaagccttggagcatggcgccgacgtggtggtcgcggtcggcggcgacggcacggtgcgcacggtggcgagcgcactttcgggaaccggccacgcgctgggcatcatccctattggcaccggcaatctgtttgcccgcaatatgggcattcctgtggatgatatcgatgcggcgctgaccgtcgccacatctcatggttcgcgtttggtggatgtcggccgactgacgctgctcgatgatgaagccgccgatcacggccatgcgttccttattatcgcgggcatcggctttgatgcggtgatgatcgacgacaccgatcctgagttgaagaagaacatcagctggctcgcctatttcgtgtcgggcgtgaagaacctgttcgccccgaagtacaagggtgatgtgaccattaccagcgccgacggcagcacgcacaccacgcacggattgaccttccgcacgttcatggccggcaattgcggccagattccggtattttcgctcatgcccgacgccgtgtacgatgacggcattctcgattacgagatcattgacacatccggcggtttgatcggttgggcgaatctgttcggcgatgtgctgcatcagacgatcaccggcaaggcccagcagagtccgctgtccacgaattccacggttgaccagattcagggcgtcagcgcggaaatcaagttggagaaacccgttttggcgcaggttgacggcgatatgcttcccgaaacgcagcatattcgtttcagtgtggagcgtaagtcgttgtgcgtgcgtgtgccggaagcgcccgaagccaatacttccaatgtaaatcagtaactattatcgtaattattaaattatttattacgatgattatgtattttatgcaaattatgcattggtatcgtcattctcatgcgattccgtcgcatgagaagtcactcgtgcgacatgcaaggtgagataggcgatttccgcttccgaaagactcacgttcaatcgcattttgacgatgatcgcaagtttgttcgcacaatccgatgctttcggatatgaggttttgatggattccacgattggctcaggctcgtcatcaagctgttcatgttggtggatgcgcacgaaaagatagcgcagatgcgtgatgaaacgcgccacattgacgctgttctggtcgagagtgatgccgtaatagccttcgatgaccgtcagcatttgctggatgacgccggtcatggtgtatgtggcggaaagatcgccggtagagaagcccgcattgaccaagtgcagggccaaagccacggcttcgcaatccggcagcgcaccgcccagatacgtgttcatggcatcgaccagagctttgcctttggcatattcgctcgcgtagagcgaacgcacttcggcttccagcggatattcgatggtctgcttgttttgcgatcggcggatcgcaccgcaaatatggtcggataatgccagcaccaatgcaggctgtctgtcggcctgttccttcagaccggtgcggttcatggcgtccgtaacgagacgaatgatttcgggcggaatcccggccacctgttgggccatatggtcgggatccttgccatctgcgggaacgaaccgacggacgatcttcgcgtcgtcaacatgctggccgggcttggcttggaaacctatacctcgaccggtgagaatcacctcactgttgccgtcttttgccagtacgacattattgttgaatacgcgaagaacgtccacgtcggccccttccgactatgcgattggtcagcgctgaatgtcgatcaccgactcaccggccttgacgtcgacgccggtctttggcgtgacggacgcgaaggccactgtgttcagcaccgtcatcaatgtggtggtgctgtatccagcttccttaaccttatcaaagtcgacgacaacgaggttgtcccccgcgttcacgtgttcgttggccttgaccttcacatcgaagccttcgccgttcatcttcaccgtgtcgatgccgacgtgcacgagcacttccacgccatcatcggttttgatgccgaatgcgtgaccggtttcggcgacggtctgcagcacgccggataccggcgcgacgacggtgctgtctgccggctggatgccgacgccttcgcctagtgcgcgggatgcgaacaccggatcgccggtttcatccagggaaatcacatggcctgcgactggagcgttcaccacggtggtggcgacagcagcagccggggcttcagtcttggtggcggcaacagtggcagtcgcggtggcagcagccggagcgactcccttggcttcgaccgacgagacagcggtcttctgattggcagccgcgcgggccagcacttcggccttctgttccggagtgcggtagtcgaaggtgatgatcagaaggaaggaggtgaggaaggacacggcgatggacactgcatacacccacatctgattgaagaccggaatggtcagcaacgaggtgaatgcgaaagcggtggtggtcacgccatgcacggtctggccggcggcggtgacggacgggaagagccaaccgaggatggcgatgacgacgccaccgagaccgcagcccaccagcatgcgcttgtagatgagcttgtaacgcaggtgaatgccgtacagagacggttcggaaacgccaccgagcaggccggccgcaagtgcgcccaaagcggtctggcgcatgtccttatccttgtcacgcacagcaaggaagagcacgccagcggtagcgccgaagcaggcgaagttccacacgcccatcgggccttggatgaagtcgtagccgagagtctggatgttcatgagcatcagggcgttgagcggccagtgcaaaccgagcggcacgaggaacgggtacagcatcggaatgatgatggcgaagatgaacggggcatgggtgttcatccaggccaagccgacgccgaggccgttgccgacccacacgccgatcgggccgatgatgaaggcggtcagcgcgccaacgatgatcatgcagaagaacggcacgaagaccagctggacgctttccgggatgatcctcttcaatccgtggtagacgagagcaagcacggcggccatgagcagcggcacgaacacgttgccggaatagtcgctcaatgccatcggcagaccgaatatgttggccatgcaagacttggtgcccagagcggcgttctccacgcacgtggtggtcttggcgtccatcaagccggtgaactgcggggtcatgagcatggccatgatggcaccacccagccatgggtcgactttgagcttcttggacgcgttgtaggcgaccatgatcggcaggaagtagaatacgcccttccagatggctttcacgaatacccagcctgcggaaacctcgtcattcggaatgacgttcagcgaaataagcaggttgaccagcgcgatgatgatggaagcgccgagcagcacgcccagaatcgggcggaaggaatcggagagatactcgaagaaggagtccagccaagccaccttgccgcgggccttggaacgggcttcggccttgacgtcggcattgctcttctgaccatcgtcggatgcggaggcaccgccgacaccggccatttcgggcagatgcatgatgttttcgtacacggtggcaacgccaccgccgatgaccacctggaagcggtcgccgctctgcggcaccgcgccgagcacgccctgcatgtgctcgagactattctgatcgaccttggatgcgtcaaccagttcaaagcgcagtcgagtggcgcaatgcgtcagactgcgaacgttttcaggaccaccgattgcagtgatgatctgcgatgcgagtgagtcagccatcctgatttcctttctttcccttacaaccgattcgatccgagcaacaccgcttcgggcaacaaaaaaagacctgagatatggctatagttcagccacatctcaggtcttgcgtctttatgttgactagcaaccctgcatcagtcgaatagcatagaactatacaccatcgtttgacattgcgcaactcggctaagcgcagaatccgccattttcgaaaattcatgtacacacatccgaacatgcactaaacagacaacgtattcatcgcgcataatgggacaattacgcacatctgacgcaaaagcgtggcagaatagtgaccatggttgcaaacaatgcgggaatgcccgctaccccagcagatctgatcaatgtcgacgaggtcatcggcaagtactatgacgtcgtccccgaccccaacgttccggaacagcgtgtctccttcggcacctccggccaccgcggatcgtctctgaagacctcgttcaacgaggcccatatcgtcgccatcacccaggccatcgccgaataccgcaagaaggccggcgtgaccggcccgctgtacatcggccgcgacactcatgctctgtccgagccggcttggaagaccgccatcgaagtgctcgtcgccaacggcgtgaccgtgcgcatcgattcccgcgacgacttcaccccgaccccggttgtgtcccaggccatcctgacccacaaccgcgcagcggatggcacccagcgcttcaccggcgaaggcctggccgacggcatcgtggtgaccccgtcgcacaacccgccgaccgatggcggcttcaagtatgacccggtcaccggcggcccggctccgtccgacgtcaccaacgccatcgcggatcgtgccaacgagctgctcggcgatttcaagaacatcaagcgcgttccgttcgagcaggccgtcaagtccgacctggtcgagcgcttcgacttccgcgagcactatgtcgccgatctggagaacgtcatcgacttcgatgtgatccgttcctccggcgtgcgcctgggcatcgacccgctcggcggcgcttccgtcaactactggccgctgatgaacgagaagttcaacctgaccatcgacgtggtgcgcccgcaggtcgatccgacctggagcttcatgaccatcgaccatgatggcaagatccgcatggatccgagctccccgtacgccatgaagggtcttgtggactccctcaacaacggcgcttgggacaagtacgacctggtcggcggcaccgatccggacgccgaccgtcacggcatcgtatgcccgaactggggcgtgatgaacccgaaccactacatcgccgtgtgcgtagagtacctgttcggcggcaaccgcccgggctggccggaaggcgccggcatcggcaagacgctggtgtcctcctccctgatcgaccgcgtggccgcttccatcgacgccaagctcgttgaggttccggtcggcttcaagtggttcgttgacccgctgttcaagggcgaagtcgccttcggcggcgaagagagctccggcatgagcttcctgcgcaaggacggccgtgtgtggaccaccgataaggatggtctgatccctgacctgctggctgcggaaatcaccgccaagaccggcaagaacccggcccagctgcatcaggagcaggtcgatcgctttggcgaaagctggtacaagcgagtcgacacgccgaccaccttggagcagaagcagaagttcgccaagctttccggcgacgacgtcgcggccacccagctggccggcgaggacatcaccgccaagctcaccgaagccccgggcaaccacgccaagatcggcggcctgaaggtcaccaccgagaacaactggttcgcggcccgtccttccggcaccgagaacatctacaaggtgtacgccgagtccttcgaatcccccgaagccctcgacaaggtgctcgccgaagccaccgaagtcgtggacaaggccttggccgagtgatcattgacgaatcggcgtaatccagccattcgccaatcattcgcaaactcactgagaagcccgctttcctgaaaaaggcgggcttctcgcatatccgcccgaatacgaatcgcaacgaacacgaatcgtgcgatatggcacgaaacgccgaattctggcatgacacgcacgctatcaccccctgccggccccgcttcgcattacgcttgaatgatagcgacacaacactcagtccagcggtccccgccaatcttcatgggaggtgaacgatgcgcatcgccatcgtcgaagaccacgccgccgaacgccaactgatggccgtcatgtgcgcggaatatttcaaacgcacccgcgatatcggcgtggaatgcgtgaccttcgccgatgcggaatccttcatcgaaagctggaaagacgcccgatacgacctgctgctgctcgactgctatctgtcggacgacgaaaccgccacgcatgcggcgaccggacttgatatcgcacggacgctgcgcagacaaaacgacgattgcccgatcgtgttcatcacgtcaagcactgatttcgccgtgctcggctacgaggtgcaggcaagcggatatctgttgaagcccctgaatcacgacgcgttccatgcgaccatggaccgcgtcgcagcgcagctcgacacgaaaacaccggtcactcatctgaaaaaacatcaatcgacgggcaatgcacaaagcagcacggacgccgcatggcaggtggctttcggcaatcccgccatcaccatggaccgtcgccttatcgcctacgcgctttccagcgcgcattatgtggaattcaccttcgccgacagcacctgcgcgaaaatccgcaccaacttctccgatgtggaacatcgtctcaccgtattcagcaacttctaccgcaccgcgcgaggagtgctcgtcaacttcgactacgtgtcaggcatcagcaacaatgaattcgtgatgaaaggcggcaagcacattcccatcacgaaaaccgcggtgaccaccacctgcagaaaatacgcggaatacacgttcacccgcatgagaatggaggactagccatgcttgacgcactcgcatcgatcgcgccatcatgcatgttcttcgccatcggcgagcagctaaacgcgctaacgggcctgcttctctgcctgtacatgacctggcatcatatggagaatcccaagcgcgacggccttattctcatgatttccggcgtgattgtcttcttcctgtgcggcatcgcatgttgcctcgcccacgtcccctcgctctggtccgtgattccttcggctccggttgtggtattggctttacgtaagatgacgaatcttccttgggggcagcttcttttcgtcgtttcaacagccgcatatatcgtcgcgatcgtttattacctgtctttggccgtggatttagctgttctgaatgagcagtccatgaatttacgtgtcggatggccgggaatgatcagtctgctgatttttgatttgattgcggcgactacacttttccatccgttccatcattcattttccgcaacattcgattcaccttccatcagcaggaatttttggagggtcatctggcttttcccgttcatttccacagcaattgtggtgtggtgcatgcccgccgacaacgcatcgctgctcgacacccgcgtgcttagcatcgccttcaccgtatccatcgcatattccggtttcatgaccatggcctacttcctcatctggtatatggtccagcaggcggaccgactgcgcgaagccagcaaacgcgaacattacgaagccatgcagaccttgcagctgcagcatatgaacgaacgcatcaacgaagcgaggcagatcaagcacaatatccggcatcatattcagacgttgcaggctctcgccgcggccgacgatatgcccggcatcacctcgtatttggaggagatggccaatcataggctgttgcagcccatccccatgcagtattgcgaacatgcttcgttgaacgcggtgctggtctactactgtgactggatccgccatataggggctgaagtcgacgtcaaagcgtcggtgccgcaatatctcaacatcaataatgccgaattatgttccatggtcggcaatctactggaaaatgcgtctgaggccattatgaaacaacaggatggggagaaaaaactcagggtgcgcatcaaatatcgcactgggccgcccgcatcactgttcattgtggtcgacaacacgcacgattcctccattatgcaggttggcgacgctttcgcctcaaccaagcatgggggtgaaggtttgggcaccgccaccgtgcgcgaaaccgcggaacggcatcatggcgcgacctcgttcgattatgacggcacgctgttccgcgcttccgtcatgctgtgtttggatgattgagattcccgttcgacgtcgcccgatcacagttcgcagttcaccacgtatggcagcgtctcacggctttcgtagggtagagatatgacgattacggtttctacagacggttccgctttaggcaatccgaatggtccgatgggttggggttgggccgatcatgagcttgccacaggcggcaagccggggcatcaccatgacagcgactgcgatgccggcggagctacgaacggcaccaatcagattggcgagctgtgcgcagtgctggaggcgttgcgcgcgcaccccggctccgaaccgttggtgatcgaaaccgattcgcagtatgcgatcaactgttccaccacgtgggttcacggctggaagaagaacggctggaagaactcgcagaagaagccggtaaagaacgcggatctgattcgcgcgatcgatgccgaaatctccaagcgccccggaccggtgaaattcgtatgggtcaagggtcatgccggcaatgccggcaatgagaaggtggacgagctggcgcgcacctatgcgggcgattgccgttcgaagatccgtgaaggatatcttcctttggagggttggcagtcgctgctggcttccgaatattcgcaaggtaccgatgttcccgatgatgcccaaatgctgcttgacggcaaaatcactacggacgaataccatatggggcgcgggcaaggcaagtccgctcaaggatcggccgatgatctgatgggcgcggccgatccggagccgcgtccacgttccatcgccgatatgctggtggagccggaaggctatccagcgcccgacgaggcgacattgccgttgacgtccaacgaaatgtcggtggaatccgacgacatgccggaaccgaccaccgcgcttgatacgaccatgcctgatggcacgacgcctgacgccgaggcaccgcgcaaatcgtatgccgaaatgctgctcaagccggactgttttccccacgagcatgacgagcggcagccagccgacgatgcacagaacgaacaatccgcgaattcctcggaaaacacgccggcgccaacgagcgaatcagccgaatccgcaaacgcgtcggcgccaacgaacgccgtcgccgacttgccgaaactgccgcatcgcgccagtccttcgggattggcggtgtcgggcgccattcgcttcactcccccgccaaattccagtccgacgttcgacggcaagccacgcctgatccgcggttacatcgcggtggaaggctacgtgcaaggcgacggcacgctcgtcctcgacgaagcgccatttgcagtcaagcacaactaacgagccagcactttcgaccttaacgcctcgaaagtgcgtgaaacatcctgtgaaaacatttgctgaccaccaatggcacaccttcgttcatgacatgtccgcaaacgcacaaaaatcaacacatccgataatatggagacggtcttaaccccatatcgaaggaggatcatggacaaggcacagcaggacgcattgaagaaggcagccggcatcgaagctgccaagctgattcagaacggcatgatcgcaggtctgggcaccggctcgaccgtgcgcttcctggtcgacgagctcggccgccgcgtgcaggaggaaggcttggagttcaccggcgtgaccacctcccgccgcactcaggagcaggcagaaggctacggcatcaagatcgtcgacatcgatgacgttgatcacatcgacgtgaccatcgacggcgccgacgaggtcgacaagaacttcaacggcatcaagggcggcggcgccgctctgctgtgggagaagatcgtggccaccaactccaacaagatcgtgtggatcgtggacgagtccaaggttgtggacaccatcggcaagttcccgctgccggttgaggtgattccgttcggcgcaggccaggtcgtcaagaagttcgaatcccgcggctacaagccggtgcttcgcctcgacgccgaaggccagccggtgcgcaccgacgagaacaactacgtggtcgatctgcacctcgaatgcatcgaacacccggaggctctggccgacgatctcatcaacaccgttggcgtggtggagcatggcctgttcctgcacatggtggaccaggtcatcgtgggcgatcccaacggtccgcgcgtgctcaccaactccaacaagtgagtttgaagtagcgtaagttccgcattttccgcggattttcgcgaacctacacgaaaccatatgaggctgtgcgttcaacttcgagcgcacagccttctttttgcatctattgatttccgattctcgtacttttcgtttatttctttgcaatatgcaaaaatcccgcatacctcaagaagacatacgggattttgtttaagcgacgcttcaaccgcgcctgaagactacttgcgctggtggcgagtcttacgaagcagtttgcggtgcttcttcttgctcatgcgcttgcggcgcttcttgatgaccgagcccatctcagcctccgttcttaaactcaaagggtaaaagtttgcaacttgcccaatactacactgcttcggggactaacgcacacaaccgcattcatatggtggaagcacgcacctttttatcggaagatcaggcaaacgcagtccgcatggtccacggctgaatcttacgtgaatcatgcatgaatcataggatcgcacaaccagccgtaggcagtatcacagcgggaactgctggtagaagcgctgcaccgaatccttggctcccgtggcttggaacaccacggtatcgttgcgccagaccgcgatggccttggtttcgtcgtccggatcggttttggcgctataggcgccggtcgcttcaccggaaaccttcacattgccgccgcccagctccttgccggtcatggcaccggtcagattgtcatactgactttgcgcatcatcagactgagaccattgcgccactttcaaggtgatatcctgaccgtccttgcccgtggaatacgtcaacgtgtactcctcgaccggggaagcgccgctccacgaagtgctggcatcggccttggtgcgcgcgaaattcaacacggaatcaggcatggccttcaacagttcgctggcgtcatccggcaacgccacagcgtcaatggacggcgtggtcggctcagaggcatcctgcgacgcgccctgcgaggtggtggtgccctgagtggacgcttcatcgcccttgttcagagcccagccgggccagatgaaagcggacaccaaggcgagcacgaccaccaaagcggcggcaatgacagccacgatcagtttgccatgagaagaggaagtttgcgtagtagacatggctgttattctttcatatccgtgagacgctcgaatccagaaaccgtgatctcgccatcatcccgcaccagcacccccttaatatctccgaaaacgattgtcctaaaatatccgtattgtcggcgatatggcaaagacgtcctcgcaatttgtatgttccgaatgcggctggagcgggccgaaatggctgggccgctgccctgaatgcggccagtggggcaccatcgaggaattccatgaagcgcgcccctccgcatcgtcacgcaccgccgctcccggacgcacatcgcgcacgctatcgcatgcagtgcccgattccgcggcgaaaccgatcacggaaatcagtacggaaaacatttccagaatcgacactgggttcacggaattcaaccgcgtacttggcggcggcatcgttcccggttccgtcacgcttatcgcgggcgaaccgggtatcggcaaatcaacgctgctgctggagaccgcaggcaatgttgcccgtctttccgcagcacagcccgaacgcaacacggtgctctatatttccggtgaggaatcgcaggcgcaggtgcgcatgagggcctcgcgcatcggcgcggtcgaaccgaatctgcttctggccgccaccaccgacctgtcgaccgcgctggggcttatcgaacaatgcaagcctgcgctggccatcgtcgattccgcgcaaaccatcgtctcgcaggaagtcgatggcatctccggaggctcgactcaggtgcgcgaagtggcgagcgcgctgatcgacaccgccaaaacgcttgatattccggtattgttggtcggtcatgtcaccaaagacgggtcgattgccggcccgcgcacgttggaacatttggttgatgtggtctgccagttcgaaggcgacaccgaaaccgcattgcgtatgctgcgcgcggtgaaaaaccgtttcggccctactgatgaggtcggctgtttcgatatgagcggcgaaggcatcgaagaggtgacggacccgtccggactgtttctttcctcgtccaattccgcagatccctctccggtggagggcacgtgcgtgaccttcacgttggacggtcatcgcagtcttcccatcgaagtgcagtcgctggtcaccaaatccgtactgccaacgccacgacgtgccgcgaacggcgtcgacgccaaccgcatcgccatgctggtggcagtgctatacaggcatggcaacgtcaatcttttggcgaacgatctgtatatttccaccatcgccggaggccaggcgcgcgagcccggatgcgatctggcgatcgtcggcgcattggcgagcgcctcgaaatcgaaggcgatcagccgcaccacatgtgcgattggcgaaatttcgttgaccgggcaggtgcgtccggtgccgcgattggaataccggttgcgcgaagccgcccgtcttggtttcaccaccgctgtagtgccgacattacgtagagaaatcgcaattcccggattgtcgatcgttcaggtcgacacattgcaggatgcgcttggcgccatgttgcgataatacacaccctacataccgtttttgcatgtatgcacgcgaagcatatacattatgttatttttttaacctatacaagtggggctcttacgtaaatgcttacgtaagagccccactatttttgaatactgatacgtttttactggaaatatcagcattcattaatcactgtcattatcgtgattatcattgcgatcatcgttgtgattagcatcaggcagtaattcgcttggtttcctcgacattgcgcttcagctcatcgatcaaatcctgtgcggaatcgaatttgatttgaggacgcaggaatcctacgaattccacacgtacctggtgatcgtataaatcaagccaatcgtcggtgacggcataggcttcgaccacgcgatcgttcattccggtcacctcgttgaaggtcggcttggtgccgatggaaatcgcagcaggccaacgatacggcgaatgatcggcaagtcgcgcgtccacggaagaggaatcgaactgctgcgaaacaccttcggaagcgccctgcgcatcatcgtccgccgtcttcgcgcccaagtccacaagccaaccggcgtatacgccgtcgaccggcagatagcctgccacattctcgctcagattcgccgtggggaagccgatggtgcgtccacgttcctcgccatgcaccacggcgccttccacggcatgcggatgtcccagaatcgcgtcggcgtctttgatgcgcccctggcccagcaggtagcgcacattcgtggagctccacacgcgcacggccttcgcctggtttttcttgctccatgcgcgacgttccgccttggacgcgtcttccagcggatcggccggctcaccatggtcggtgggcataaccggcttcgcattggctggcacgcgggtttcgcccggtccacgatcgtcgaccacgtcaagctggaacacgccggtggcgagcgccagattctcgatggccttcacatcgccggcacggttcgcacccatggccgcatcggatccgagcactagcgcgcgcatgcccagcttgcccaccatttgtccgaggaagaatcggtacgatttcgccgcgaacgccagcgtgtaacgcacgatgagcgtgtaatccacgcccatcttgttgatggcgcgcagacgctcctgcatgctggtgagcgcctgcgcgtcgatcatgcccgccggcggctcctggccaccgttttgcgccgcgtagccgtgcacgagcgctgggcgtggatcgaacagcaccaccacggagaaggactgttccttcttggcgagttccaccacgcggcgaatcaccgcctgatggccctgatgcatgccatcgaacgaaccgatggtcaccacggatttcttatcgttgctcagcgtaggccaatccaccatgccgctggcatcaggcgtgagcgtgattgtcttcatcatgtccttcttgtgtatgaattcgtatctgtagtctgattggatggttcagttgaataccgcgaccggtttagcctcaccgcgtttcgcacgttcgaggatggcgaccaaatcgttggtttcctcaacgtacgccgccgtggtcgtacgtatgtcatgcgcgattctgcgtccgaaacgcaagtcggccgcttcctgatcgctcacggccagcatattcatggaagccgcagcgctggccacgggatcgagcgcatgatcgagcgcatgatctgcatcgtcaagcactgcacgattgcgcgtcacttccatgccttcacgattggtgaatgttttggattcagcgtgggcgctcatgacgttgggcatattcactgagaatctgccgacacgtgtgcgtcgcagcatcgtcagatggcctcccaacccgagttcctcacccagatcgcgtgcgagcgcgcgaatgtaggtacctgcggaacaggtcacggtcacgtcgagttccataacgggctgcatatcttcatacggtgcagtgtcggcaatccatccatctcctgccctctcggccacgactgcgccagcaagttccgtgccggcacgatcgctatgcgtgtagccgtaacgcgcctgccgcacgttgaactcttcgatggtcacaggacgtgccttaagctccacatccttgccttcgcgcgccagatcataggcacgctggccattgaccttaatggcggagtagacgttcggtacctgttcgatgcgcccggtgaaccgttctgtgatcagctgttccacggcttgacgcgaaggaaagttcactgcccgctcccccgccggcaacagctcgccttcggcatcgtccgtagtggtgcgctgtccaaggcgaatggtggcctcgtacgttttgttatggtcgacaatgtagttgagcagtcgcgtggcattgccgaaacccaccaccagcacgccggtggccatcgggtcgagcgtgccagcatggccgacacgcttcatatgcagggcgccgcgcacggccgcgaccacgtcatggctggtgaccccctgcggcttgtcgatgaccagcaggccggaatgttcaggcttcttcgtcatcatcccaatcttcgacttcgacgtcatcatcgtcgaaatcatcgtcgtcatcctcttccggatgcttgtacggatcggcttcgcccgcatactgggcggtttcacgagccttggcgagttcttcatcacgcttgcgcgcgatggcgagaatgtcttcgatctcatgcgcctcgcccggcacctcgtcgaatacgaattcgagctgcggggtcaaacgcagaccggccttggttcccacgagggaacgcagacgacccttggcttggttcagtgcctgctgtgcacggcggcgttcgccctgctcatggccttcacggccaagctgggtccaatagactttggcgatctgcagatcgttggtcacacgcacttcggtgatggtcacgtttgtgagacgcttatcgtgcaattgcgcctccatggaggatgcgatcacacgttggatcaacgccgcgatgcgtgcggcgcgaggattggttcctgccattgttgtcctttaatcaggtaagttctgttgtattacggaacgcccgcagccgtatgtcagctgtgggcgttcctttcttgttatcgattgctggttcgaatcaatcgactacttgcgttcgatttcctgcatttcgaaggtctcgatgatatcgccaagctcgatgtcgttgaacgaaccgaggttgatacccgcttcgtagccttccttgacggagttgacatcgtccttgaagcgacgcagcgaggagatttcgagatcattgacggtggcgatgccgttgcgcagaatacggcacttcgtaccgcgcttgacttcgccgtcctgcaccataacacctgcgatattgccgaacttggaagaacggaagatctcacggatctcggagtgggacgtgacgacctcttcgaattccggcttgagcatgcccttgagggatgcttcgatgtcttcgatggccttgtagatgatcgagtagtacttgatttccacgccttcgcgttcggccatatccgccacctgacggttcggacgaacgttgaagccgatgatgacggccttgtcgacggtagccaagttgacatcgttctgggtgatggcaccgacaccgcggtggatcacctggatgccgacctcgtcagacacctcgatcttcatcaaggaatcttccagcgcctcgacggaaccggaggaatcgcccttgatgacgatgttgagcatgtcgacctcagccttggcgaactgctccttgaggctttcgagcgacacgaccttacgacgcttggccagctgggccgcacgctcggtggcctgacgcttttcggcgatctggcgtgcggtacggtcatcggaggccaccaggaacagatcgcctgctgtcggcacggaggtcaaaccaagcacctgcaccggagtggacggcgtggcttccttcatatgggtgccgttttcgtcgagcatggcgcggacacggccatacgacgttcccgcgacgatggaatcgccgatgtgcagagtaccggactgaacgagcacggttgccacggcaccgcgacccttgtcgagtcgggcttccacggtggcaccgcgagcgtccatatccgggttggcacgcagatcaagttcggcgtccgcggtcagcagcacggcttccagcagcttgtcgacattggtgccctgcttggcggaaatgtcgacgaacatggtgttgccaccgtactcttccggaacgaggccgtactcggtgagctggccacggaccttgtctgggttcgcgcccggcttatcaatcttgttgacggccaccacgatcggcacgttggccgcctgagcgtggttgatggcttccacggtctgcggcatcacgccgtcatcggccgcgaccacaaggatcgcaacgtcggtgagttcggcgccacgggcacgcatggcggtgaaggcttcgtggcccggggtatcgaggaacgtgatcttacgcggttcgccttcgagatcgacggtcacctggtatgcaccgatacgctgggtaatgccgccggcctcacgtgcgatgacgttggtacgacggatggtgtcaagcagtcgggtcttaccatgatcgacatggcccatcacggtgacgaccggcggacgcggcttcagatcttcatcttcctgaagttcttcttcgtccagatcgatgtcgaactgctgcagcagttccttgtcttcctcttcggcggacacgatcttgatgtcccagccgatttcctcaccgaggatctggaaggtggattcgtccaaggactgggttgccgtggccatctcaccaaggtggaacagtacggtgaccagtgccgccggattgacgttgatcttctcggccagatcggcaagggatgcgccctgacgcagacgaacggtctgaccgttgccggtaggaatacgcacgccgccgatgaccggggccttcatctcctggaattcctgacgctttgccagacggttcttacgagccttcgaggacttgccgccctgacgaccgaacgcgcctgcggcaccgccacgaccgcgaccgccgccgcgtgccggaccgttgctcggagcgctgttgccgccttggaagccgccaccattggtattggcgccgccaccgaaacggttgccaccacctgccggacgctgaccgccgccctgacccggacgatgctggccccactgacccggcttcgcaccggtgccttggcccggacgaccacggaaacctccacgctggccgccgccctgacccgggcgtccgccgcgacgaccttcgccgttgttattgttgttggcgttcggacggttcatcggatgcggacgcggaatgtcacccggagtcggggtatgcatgccctgcttgcggctgaacggattgttacccggacgtgggcccggagtgtgcggcttcgcaccattggcggcattgttgccattgccgccctgcggagcattggtattgttattgttgcgctgtgcgcgaggtcccggaaccggagccggcttgccgccctgacggcgttcgccctgcggacgcggagcgttgccgttggcacgattgccatgctggcgggaatcacccggacgaggcatgcgctggccgggcttcggggcttcggacttggacgctgcaggacgtgccggctttggagcggcaggctttgccgcggatgccgcgggagcagccggagtggcacgaggcgcaggagtaggcgaagctgccggggcagccggcttcttggccgggaccgcaggcttcttggattcggatgcgttgccctgcgcgttggaagcgaaagcattcctcagcttacgggcaaccggaggttcaacggtagacgatgcggacttcacaaattcgcccatcgcctcaagtttgttcaaaacagtcttgctgtcaacgccaaattccttggcaagttcatatacgcgtgctttcggcactcaatttctcctatcttgggccgcgcgcatacgagcgcgaccgctactgattcacggcgagcttgttccttctcatcgtgcaaccatgttcgtgatacctcgtcttttccctgggcatgacggcacgtacccccacgctttggattatcgagtccagcatactcaagcccgtggattgaacgcccacgggcttaccgctgctgaaagtgttggttattcggcggtttccccgctggtcgaagcctgcgcttcggccatcttcttggcgtgtgcctcggcggattcgatgccgatcttccatccggtcagcttggcggccaaacgtgcgttctggccttccttgccgatggccagcgacagctgatcatcatgaatgaaggcgattgcggtctggttcttctcgctgattacctgcacaccagtggcgaccgccggagacagtgccgccgcgacgaacttcgccggatcggcagaccagtcgacgatatcgatcttctccggcccaaggttctccatcaccgcacgcacgcgagcaccgccggggccgatcagagcgcccttcggattgacgccctcggtgttggcgcgcaccgcgatcttggtacgggcaccggcctcacgcgcgatggccatgatcgagacggcaccggaaaccagttccggaacctcacgttcgaacagacggcgaaccagctcgggatgggagcgggacaccacgatttccgggcctttgaggccacgtgcgacattcaccacatacacgcggatgcgctcaccatggcggtaacgctctcccggcacctgttcacgacgcggcagcaacgcttcgacgtcgccaacggccacgtgcacattggaggtgtccttcacatcctgctgcacaatgccggtgatcagcttgcccttctgcccggagaacgcgccgaacaccttgtcgtcctcggccttgcggaacagctggctgatgacctgacgcgcggtggcggcggccagacggccgaagtcgcgcggggtgtcatcatattcctcgcccagagtcggcgcagggtgcggattatcctcggtcggctcgacggggatctcatcctgagcccaaacggtaaagcttccggcacgcggatcaagctccacacgagcatgcttcgccgcgtgcggcgttttcagatatgccagtcgcaatgcttccgagagtgcggcatccagcgtctcgggatcgattccctgcccagctgcgagctggtgcattcctgccaggtccagttccatacttccaagacctcctatatgaagttattccgagcgctcggcccaatggtcacagtcgactattagtctaatgtttcatgcagacacgctccccgtttttccccttggccttgtcgactgtcagacgcgcctgcgtcttggtgtgcgcgagcgcccttgtggcatcactggccgcgtgttccgctcctcgaatcgcaggtcgcgccgaagccgaacagcagccaagtccttgcgaaagggcgtatgcagacgcgactgccaacgccgacatcatggcagacaggtcacgccatatcgtcatgcgctatcttgccgcgcaggaggcggtttcagattgggccaacaccgcggcatattgcccggcgcgattcgccgatggcacgttgcgcagcgcgcaggcccgtcacgccgtcagattgatggcctcacggcttgcgattgacatcgcacagcccacgctgtcacgatgcgatggcattgactcgcttgatgtcgatacggattcgcttgcagccatggctgctgcggaagatcaggtggggttcgcgatggaggtgttcgccgcgcgttccttcggtcatgcgacgcttggcatcagcgatcgtcataaaaccacttcgcaacgcctgatttctctttccggagccgaagacaatcgtgcgaaaacctatgatgtcacgcagctgctcgccaatcctaataccatcgtggattccgcaacgggcttgtacgcgccaaccgatgccgtcctggaaatgaattgcgcgcgcagcgaaatcgcagccgttgcggcaagctcgacttcgtcgaacgcctcgacgaagtcccaaacaacctcggacgaccattcggatgactcccgggaacagtcactgggcatgatcgccagcatgatcgccgaccgcgtggatctggcactcgactggggttatccggcattcgacgaagcgctattcgcatagcgcagacttgcgtacgctgtccgcgcaaccgtcttcacacaatgcgacgcagtgttcccgcgaataagacacgccgagcaatcgcagacatcgcaaaaatccctcaatcggatttgacaatcgccaaagctgtggcaaaatgatgaagttgcttgttttcaagtagcacaatggataagtgtccgagcggtctaaggagcacgcctcgaaagcgtgtgagggcgaacccctccgcgagttcgaatctcgccttatccgcaagtagaaaaaccggggcaacggcgcttcggtttttttattgcttacagccctgtggcacgtaggagcacataggagccaaggttattgctttagacgatctgcaacttttatgccttcattcatcgtcgcacacttcttctacccctgaaaatgcatgcctgtcttaaggccgctcaatcctcgatagaagacgtactggcgttcgattaccctaaaatgcaacgaattattacaattgcgtctcgatcacggactcgtgagaacgacgtaacgtcgtcatggcatttcgcatgattcgcgtgttcttttcgaactatatctcgttttccgtttttcttgcgattgcgtgatgtggttttgtgatgcgatatttggtgcgattgtatagcgcaatcttctgtgtatccgtacagtatgtgctcttacaaagtacgtttcgcacgaatcgcttcggcacgaatcgccaactggtcgtcttccggatattcgatatgttccagcgtcaatccttgcggagcgatcggaccggtgctgccttcacgcaacggcgtcgtcattttttcggcgaaccaatccacggaacgtttgccgatgcctacctgcacacaaccattaaccagcgatcgcaccatattgcgtgcgaaagcgtccgcaacgatggtgaagcagagcagtccggattcgaccgcaggcgtgcgatatcgctcccccatcgtatttccgtcgtcgatcagcggatgctgcggtatacgacgccaatacgcggttttcacctcgcgtatggtggtgcctccaggattcggggttgcgaacgagccgaaatcatgcaggccgatagtcatttcagctgccttgttcatagcttcgatgttgagatcatcgtcgatatgcagcacgcaattgcggatacgtggatcaatttcgcttgatcggtcggcaatgcgatatacgtaagtgcgttccagtgcggagaaacgtgcgtcgaatccttcgggagcttcctcgatggaacgaatggcgatatcgttcggcagcatgcgttgcagccgtcgcttcaacgccatcaccggttcgacctgcatatgcccgacgcaacgtgcaagcgtctcctcattgatgtcgagatggcaaacttggtgcgacgcatgcacgccggtatcggtacgacccgcgacggtcaggcgcagcggctcgtcatcatcgccttccggtacacgaagaacggtatgcagcactcgttcgatttctccctgcacggtacgcatgtcaggctgtttcgcccatccgtagaaatcggtgccgtcatatgccaagtcgatacgtaatctcacggcaatgagcataacaaaagacgcataacaacatatgacaacgcataacaaaaaggctgggaacctttcgattcccagccttttcatcagctagtcaagcctgcttgatgccaatcactcggcgttctctgcggtggcttcctgagcctcaaccggtgcctcttcgacaaccggagcttcttcagcggcaaccttggttgcggcttcggcttccttgaccacggcctgcttcgggctcaccggctcggtgacgagctcgatgatggctgccggagcggcatcgccacgacgcggagcaatcttgacgatgcgggtgtagccaccctcacgctgctccatctgctcggcaatctcggtgaacagcttgtgcacgacggacttgttgcggatgacacgcatcacgcgacgacggctgtgcagatcaccacgcttggcgagcgtgatcagacgctcagccagcggacgaaggcgcttggccttcggcagggtggtggtgatgcggccacgctggaacaggctggtagccatgttcgcgagcataagacgctcatgagccgggctggaggccagacgcggacccttctttggtgtaggcattgtttctccttgaaagccccgtcggactcaggtgggcagttgcccgaacatccgaatccgacgaagcggttaggtcaaaagcggcgaatcactcgtcttccggcgagaagaaagtgccgccttcgaggttgttggtatcgaagttgcccagcggggaagccttgagggccagacccaaggactggagcttttccttgacttcgtcaatggacttcataccgaaattgcggatgtcgagcagatcctgctcggtgtgggcgaccagctcgccgatcgtgtggatgccctcgcgcttcaggcagttgtagctgcgctgggtgaggttgagatcctcgatcggaacggccatctccgggttggtttcctctgccaccggggcaggtccaacctcgacgccctcagcctgggtgttgagctcgcggcacaggccgaagagttccaccaaggtggagcctgcggatgcgacagcatcacgcggggagattgccggcttggtctccacgtccaggatgagcttgtcgaagtcagtgcgctgttcaacgcgagtggcttccacgcgatagctcaccttgagcaccggggagtaaatcgagtcgaccgggatacggccgatctcggcgttatcctgcttgttcatctgggctggcacataaccgcggccacgctcgacggtgaattcgatctcgagttcgccatcttcagcgagagttgcgatatgcatatccgggttggcgatagtgacgccggccggcggagtgatatcacccgcggtggcctcgcccttgccgctcttgcgcagatacatgacaaccggctcatcgtattcgctggtgagcacgatgcccttgatgttcaacaggatctcagtaacgtcctcttcaacacccggcagagtggtgaactcatgcgggacgccggagatacgcaccgaagtcacagccgctccagggatggagctcaggagggtacggcgcagcgagttgccaagcgtgtagccgaaaccaggctcgagaggctcgatggtgaagcgggaacgctgagggttgagagattcctcggtaagtgtcggacgctgtgcgataagcactgtggttatcctttcagcttcaggccggtggtgcactcaccggccataagcggcgttggattgatgatttcttctagtgctcagacgcgacggcgcttcggaggacgaacgccgttgtgtgcctgcggggtgacgtcggtgatggaaccgacttcgagtccggcggactgcaaggaacggatagcggtttcacgaccggaacccgggcccttcacgaacacgtcgaccttcttcagaccgtgctccatagccttgcgggctgcggattcagcggccataccagcggcgtacggcgtggacttacgggagcccttgaaaccgacatcgccaccggacgcccaggacacaactgcgccggacgggtcggtgatcgaaataatagtgttgttgaaagtggacttgatgtgcgcctgcccaaccgggaccgacttgcggtcgcggcgacgcggcttgcgcgcggcttgcttttgagctgccattgaccctcgtttcctaataacgaatttgctttgttgttcaggcgatgaaacttacgtctcgtggtctgaactgacagccacctattacttggtggccttcttctttccggcgaccgtgcgcttcgggcccttgcgggtacgagcattggtcttggtgcgctgaccgcgcacaggaagtcccttacggtgacgctggccttggtagcagttgatctgaatcttacgacggatatccgcatcgatttcacgacgcagatcgccctcgatcttgtagttaccctcgaggtagtcacgcagcgtgatcagctgctcatccgtcagatccttgacgcgaatgtccgggttgataccggtcgcggcaagcgtttccttggcacgagtgcgacccacaccaaagatgtaggtgagggcgatctcgatgcgcttctcattggggatgtcgactccggcaagacgtgccattgcgattccttctgttttccgcaggtcttgcaccgagtcgtccggtttcccggcccgggcctgcgtacccggggttcataccgcttgcgcgatctgtgactcagcgcctgtacttattatgccgctggatctgctctcagccctgacgctgcttgtggcgcgggttgacgcagatcaccatgacgcggccgtgacgacggatcacgcggcagttctcgcagatcctcttcacactagggctgaccttcatggttttcctttgcttgtgtaccttacttgtaacggtacgtaatacggccgcggttcagatcataaggactcatttccagcacaacacgatcctgcggcagaatgcgaatatagttcttcctcatcttgcccgagatggttgcgagcacgatatgcttgttctcgagttcaacgcggaacatcgcgttcggcagtgcttccactacctgtccttcgacttcaatcacaccgtctttagccatgagcctcgttccgttctttggcgattactatgcgtgcccgaagacacaccaacttgcaagaatacacgaaaacgggaactacggcacgttcggcgtgtcgcaattcccgttttcgattgatttgtggtattttattgggctttcttatctatacatatgcctcaaggcagcccaatcttcagctatttcagccgagttcagccacgatggtggattggatctcttcaacggaaccgacgccgttgaaggtcttcagcagcccgcgctcttcataggtggccagcaacggagcggtttccttggcatacacatcaagacgcttggcgatggcttccggagtgtcgtcggaacgtccttcgatctcggcacgcttcttcatgcgctccataagcacgtcatggtcagcgtcgagagccaccacagcgtccagaggagtgttcagatcggcgaggatggcgtccagtgcctcaacctgggatgcgttgcgcggatagccgtcgaggatccaaccgttcttggcatcatccatggccagacgatccttgacgatcttgttggtcagctcgtccggaaccagttcgcccttgtcgatgtacttcagtgcctcaacaccgagctcggtcttgttcttgatgttgtagcggaagatatcgccggtggagattgccggaataccgtagtgctcgctcagcagcgcagcctgggtgcccttgccgacgccctgcggtcccataatcagcagtcgcatgttattctccgtttcattgagcctcttgcgaggctttctgattctcgattggttacatgaaaatcgtgataccgcttcacgtcgaaacggtatcacgattttgaggttttacttgccttccttgtggtcagtgccctcgaacaggaatccagcgtactggaactgttcggtctgggccttggcctggcgcagggtgtcaaggccgacgcctgcgatgatcaggatggtggtgccgccgaacggcaacttggtgttgaggtcgagcgccatgatgagcacggtcggaataagcgccacgaatagtaggtacacggcaccgacggtgttgagcctgttcatcacgtagctcagataacggctggtggcgctgcctgcgcggattccaggaatgaagccgccgtactgcttcatgttgtccgcggtttcgtccgggttgaaggtgatttccgtgtagaagaagcagaagaacacgatcatcaacgcgtacagtgcgatgtaccacacggaagtggtgttggccaagttggagttgatccacttgacccaggactggtcggatttgccgaactgtgcgatcagggtcgggatggccagaatggaggacgcgaagatcggtggaataacgccgctcatattgatcttcagcggcaggtaggtggaggatccgccgtacatcttacggccaatcatacgacgggtgtactgcaccggaatacgacgctgggaaagctcgacgtagatgacgaggatcatgatgaccagcagcacaccgacgaccgcggcaaacttcgcccaattgccatcggtgcctttggtgccccaaccgatctcccaaagctgcggcaggaagccggagcagatggacatgaagataaggatggacataccctgaccaagacccttatcggtgatcaattcggccatccacatgatgaggccggtgccgccagtcatgatgagcaccatgaccacgaggttccagacggaaccgtcaggcacaacctgggagcaccggtagttgaacagggcgccggagcgggcggtcaccagaatggtggtggactgcagcacagcgaggccgatggtcaggtaacgggtgtactgggtcagtttggcttcgccggactggccttccttgtgcagcgcctcaaagcggggaatcaccacgcgcagcagctggatgacgatggatgccgtgatgtacggcataacgcccagtgcgaagatcgatagctgcaacatagcgccgccggagaagaggttcaccagaccaatgaagttttcggaggtgctgttcatcgaaccgaggcactgctgaacgaccttatagtcgacgcctggggtcggaatgaacgaaccaatacgataaatgatgatgataccaagagtgaagaggatcttgttcctcaactccttggttttcaaggcctggattaacgtcctcacctgggattccttccatcgacgtgcgcgcctgcgcacccatgcaaaacagactctaccgatcgagtctagcgtacggcgtctacctacacgtggagtgttccatcctttgtcggttttttacaagatttcgaggcattgttttcgttttgttccccgtactggaccaaaacgaagtgaggcctcccccgtctaagcgggagaagcctcacttgcaagcttcagtcagctctacattccttggaatcagtcctcggagatggagccgccggcagcctcgatcttggacttggcggaagcggaagccttaacacccttgatggtgtaggctgccgaaacctcgccgtcgcccaggaccttgaccgggtagccgttacgcacggcacccttggcgaccagatcggcaacggtgatttcgccaccctgcgggaacagttccgcgagagcagcaacgttgacgacctgatattccttcttgaacgggctcttgaagccacgcagcttcggaaggcgcatgtacagcggcagctggccaccttcgaagcccggacgaacctggtaacgcttcttggtgcccttgtcgccacggcccgaggtcttacccttggagccttcaccacggccgacgcgagtgcgatccttcttggcgcccggagccggcttcaggtcatgcatctgcagaatatctgccataatcagtcagcctcctcaacggtgaccaggtgacggaggaccagcagctggccacggagggccggcgtgtcttcacgggtcacggtcttgccaatcttgttcaggcccagagtctgagccgcagcacgctgcttcggagtggagttcaccagaccgtggtgcagcttgatgttcaggttagtcatcactcaccgtccttctgagcggccttggcctgtgcttcttcacgggccttacgagcctcggcgatgccttcggcgcgagcacgcagcagggagtcaggagccacctcttcgagggacatgccacgacgggctgcgatctcttccggctcttcgagcttcttgagagcgtcgacggttgcgcgcaccacgttaacggcggtggcggagcccatcgacttggtcaggacgtcggtgatgccagcgcattccatgacggcgcggaccgcaccgccggcgataacgccggtacccggagcagccggacgcaggagcacggtgccagcagcatcatggccgatcaccgggtgagtgacggtgcccttgatgcgcggaacggtgaacatgtgcttcttagcatccagctggcccttagcgattgcagccgggacctcacgggacttgccgtagccgacacccacggtgccgttgccgtcgccaaccaccacgagggcagcgaagctgaacgtacgaccacccttgtgggtcttggacacacggttgatggtcaccacgcgatcgagcatctcgttctcgtgagattcctcacgacggttgcgacgctcgccacgacgaccctcaccacgctggccacgacgggacttgcgatcctcgttggtagcttcagcagcagcctgagtgttctgagtttcttcagccacttgggtttccttttcgttgtcgctcacagtgccagacctccctcgcgggcgccttcagcgacagctgcgacgcggccatgatacttgttgccgccacgatcgaacacaaccgcggtgatgcctgcgtcctgagccttcttggcaatcagttcgccgaccttcttggcagcttcggtcttggtgccttcgaaacctgcgaaatcgctcatcagagtggattcgctcaccaaggtaatgcccttggtgtcatcgatgatctgggcaaccatgtgacggttggaacgggtaaccaccagacgcgggagctccggggtaccgctgatgcgcttgcgcagacgagcgtgacggcgctgaagcgcgaccttcttgcccttaccgaaaatctggacgctcattacttaccagcctttccagccttgcgcaggatgcgttcatccgagtacttgatgcccttgcccttgtagggttccggagcgcgaagcttgcggatgttagcggcgcactggccgacagcctgcttgtcgatacccttgacgatcacctggttcggattcggcagttcgaactcgataccttccggcggctcaacggtaatggtgtgggagtaaccgagggagaactcgatacccttgcccttcgcctgagcacggtaaccggtgccgatgatgtccagagtcttggcgtaaccctcgtgcacgcccttgaccatgctcgccacgatggaacgagccaggccgtgctttgcacgggtcggacgcagatcgtcagccggaacgaggatgatctcgttgccttcgacctgagcggtgatgccttccggaatctcgtaggagtcagtgcccttggcgcccttggcggtgaaggactgaccgtcgatcttgacttccacgccagcaggaatggtgacggggagcttaccaatatgcgatgccatgtttcagctctcctttctcaccaaacgaaagcgacgatttcgccgccgatgcctcgatcgaggcattccttctgggtcagcagtcccgagctagtcgagatgattgcgatgccaaggccaccgagcggcatcggcagagcatcggactttgcgtagcgacgcaggcccggcttggagatgcgcttgatgccctggatggaacgctcgccgttcggaccgtacttgagggtgacctcgagagtctggccgaccttggcttccttggcggtgaagtccttgatgtagccttcacgcttcaggatctcggcgatgttcgccttgaacttggagtacggcatatccacggtctcgtgctttgccgcgctcgcattacgcagacgcgtaagcatgtctgcgatcggatctgtcattgtcatttgggcttattgccctttctcgccgtggtttccgccgcccgcacgctccattgagcgattgggccgcggaccttcagcgtcgttatttaccaactggacttcgtaacgccgggcagctcgccgcggtgggccttctcacgaaggcagatgcggcaaaggccgaacttgcggtagacggagtgaggacgaccgcagacctggcaacgcgtataagcgcgcaccttgaacttcggcttagcggccgccttgttcttaagagcggtttttgccatatcagttctccttgaaggggaagccgaggtgcttcaggagcacgcgagcttccttgtcgtccttggtgctggtcaccacggtgatgtccataccgcgctggtgatcgatcgaatccggatcgatctcgtggaacatggactgctcagtgaggccaaagttgtagttgccctgaccgtcgaactggttgccgttgatgccacggaaatcgcggatacgcggcagagccatggtcagaaggcgatccaggaactcccacatacgctcgccacgcagggtgacgtaagcgccgatggcctgtccttcgcgcaggtggaactgtgcgacggacttcttagccttggtgatcttcggcttctggccggtgatcagggtgaggtccttgactgcgccttcgataagcttggagtcgcgagcagcggcgccaacgcccatggagacgacgaccttctggacgcgagcgacctgcatcgggttggagtagtggaattccttctccagctccggcacgatctgctcgttgtacttctgcttcaagcgcggagttgccggcgcttcgacagtggtatcggtcatgccagctcctttccggacttcttggcaacacgcacacgcacggtcttcaccttgccgtcgcgagcctcttccttttcgacgatgcgcacgcgggtcggctgcttggtctccggatcgatgaccatcacgttggagcgatggatcggagcctcgacagccacgatgccggcctgctggccctgctgcgtagcgcgaacgtgcttcttgacgatctgcacgccttcaacgatcagacgatcgtccttgagcacctgcttgacggtgccctccttgccgcgatccttgccgcgaatgaccttgaccaggtcgccgctcttaatcttggctgccatgtcagatcacctccggggcgagggacacgatcttcatgaagcgcttgtcgcgcagttcacgaccgaccggtccgaagatacgagtgcccttcggttcacggccagagccgagaatgacggcggcgttctcgtcgaacttgatgtaggagccgtccacacgacggtgctccttgacagtgcggacgacgacagccttgacgacgtcgcccttcttgaccgacccgccagggatggcgtccttgacggaggcgacgatcacgtcgccgatgccggcatagcgtcgcttcgatccgccgagcactcggatggcgaggagttccttcgcacccgtgttgtcggcgacatgaagccgcgtttcctgctgaatcattgattctccttagccgagctggttctccccaagcaccccgcctgcctgcttgaagcaggcggggtgactcacggagccttgccgaacttatttacttagcgcgctcgatgatggtatcgagacgccaacgcttggtcttgctcaggggccgagtctccataatactcacgaggtcgccaatgtgagcctcgttgtgttcatcatggaccttgaccgtacgagtggaacgcacgaccttgccgtacagcgggtgggtcgaacgctgctcgagctcgacggaaatcgtcttgtccatcttatcggacacgacgtaaccgcgacgaaccttgcggaagttacgctcttcagccattacttctcctcagctttcgtttcggtcgcctcgggggcctggctgatgccgagctcacgctcgcgcaggacggtgtacatcctggcgatgtcgtgcttgaccgccttgaggcgggcggtattttcgagctgaccggtcgcggactggaagcgcaggttgaacagctcttccttggacttcttgaggaagccctcgatctcctcgttggtcttctcgttcagattcttcatggtgtagtctgcagttccgactgccatcagatgtcaccgccttcacgagcaataacacggcacttcatagggagcttgtcgattgcgcggcgcagagcctcgcgagcgacatcctcggacacgccaccgatctcgaacatgacgcgacccgggtggacgttagcgatccagaattccggagtacccttaccggaacccattcgggtgccgagcggcttcttggtcagcggacgatccgggaagatcgtgatccacacgcggccaccacgcttgatgtagcgggtcatggcgatacgagcggcctcgatctgacggttggtcacataagctggagcaagagcctgaataccgaaatcgccgaatgcgatctcgttgccgcccttggacataccacggcggaccggacggtgctgcttacgatacttggttctctttgggataagcatttctcagctcactccttcgtttccgttgcggcaggtgcctcagctgcggccggagcctctgctgctgcgttctgctgctgggcagcgttacgctgaccacggcgcggacggcgatcgccgcgacgtccctggcggttgttgccctgctgtgcctgctgctcttcgaactcacgctcggtcatatcgcccttgtagatccagaccttcacgccgatgcggccgtaagtggtcttggcctcgaagaagccgtaatcgatgagggcacgcagggtctgcagcggaacgcgaccctcgcgatagaactcggaacggctcatttcggcgccaccaaggcggccggagagcttgatacggatacccttggcgcctgcacgcatggcatcctgctgggccttacgcatcgcgcgacggaaggtcacgcggttggtcagctgctcagcgatgccctgtgcgacgagctgggcgtccagtgctgcgttcttcacttcgaagatgttgagctggacctgcttgccggtgagcttctcgagcttggcgcgaacgcgctcagcttcggcgccacggcggccgatgacgatacccggacgagcggtgtggatatccacacgcacgcggtcgcgggtacgctcgatgacgatacgggacacgcccgcacgctcaagatccttgctcatggccttgcggatggcgtcatcttcgagaacgaagtcgcggtagcgttcgccaaccttgttggaatcggagaaccacttggaacgatggttctcagtgattcccaggcggtagccaaacggattgatcttctgacccatctttagcggtttccttccttgttagcgacgacgaccgtgatgtggctggtgcgcttgttgatacgagcggcacggccctgtgcacgagcgcggaaacgcttgagcgtcacgccttcgtccacataggtctccttcacgaccaggtcgttctcacggaacggctcgccggccttgtcggccttcacgcgagcgttcgcgatggcgctctccaggaccttacgcaccggaagggatgcgtcctgcggagcgaacttcagaatggtgatggcttcggtcgccttcttgcctcggatgaggtcgaccatacggcgagccttgcgcggcgtcacgcggacgtgacgagcgattgctttagcttccatgtgtccttactctcctttagcggcgtgccttcttgtcgtccttcacatgacccttgaaggtcttggtcggggcgaactcaccgagcttgtggccaaccatggattcggtgacgaacaccggaacatgcttgcgaccatcgtgaacggcgaaggtgtgtccgatgaaatcaggggtgatcatcgaacgacgggaccacgtcttgatgacgttgtgcgtacccttctcgttctgctcgtcgactttcttctgcaggtgggcgtcgacgaaggggcccttcttgatgctacgagtcatctactcgacactcccttacttacggttcttaccattcgggcgacgacgaacaatcatcttgttcgaagccttcttcggacggcgggtacgaacctcgcccttgccccacggagaaaccggcggcttgccaccgcgggtacgaccgccgtgcgggtgatcgacagggttcatggattcaccacgggtgatcgggcgcttgcccatccaacgtgcacgacctgccttaccgagctggatgttggcgtgatcggagttgccgacctcaccgacggttgcgcggcagcgagcatccacgttgcggatttctccggacggcatacgcagctgggcgtaagcgccatccttagcgacgagctgcacggctgcaccagcggagcgggcgatcttggcgccacccagcgggcggagctcgattgcgtgcaccacggtaccagtcgggatgttgcgcagcggcaggttgttgcccggcttgatatcagcctgggcgccggtctcgatgacgtcaccctgcttgataccttccggagcgatgatgtagcgcttctcaccgtctgcgtagtgcagcagtgcgatgcgggcggaacggttcgggtcgtactcgatgtgagcgaccgttgccggcacgccgtccttgtcccaacgcttgaagtcgatgagacggtactggcgcttgtgaccgccgccacgatgacgggaggtcatacggccgtaagagttacgaccgccagtcttgctgagtttgcgaaccagcgacttctcaggcgtagaacgcgtaagctcggagaagtccgagacggacgcgttacggcggcctgcagtcgtcggcttataaacgcggatagccataatctagttcttcctttaacttttctcggctagccttcagttaccgaagatgtcgatcgactgcccctcggcgacggtcacgatagcgcgcttctgattgacgcgctggccgaaaccgttgcgggtgcgctgacgcttgccggcgcggttgagggtgttgacgttcgtcaccttgacattgaagatctcttcgattgcctgcttgatctggaccttgttcgcgttcggggccaccacgaaggtgtactgaccgcgatcggacagagcgtagctcttctcagaaacgacaggcttgaggatgatgtcgtgtgcgggcttgtgaatagcgaccatgaaaatcaggcctcctttgcagccggctcagccttcgcagcaaggaaagcgtcgaagccttccttggagaagaccacgtactgagcggtgaccacatcgtacgtgttgagctgatcggcgaagatcgggtgaacggtcgggatgttacgaacggaaagccattcgttcacattctcgcgagagagcaccacggtggtgaacttgttctcggtcaccggggtaagagcggcaacagcggccttggtggacggggcttcggaaacgccgaagtccacgactgccacgcgacctgcgttggcgcgatcggaaagcacgtacttgagagcagcggccttcatcttcttcggggtgcgctgggagtagtcacgcggctgcggaccgaacacggtgccaccgtggtaccactgcggtgcacgaatggagccctgacgagcacgaccggtgcccttctgcttccacggcttgcggccaccgccggaaaccatgccgcgagtcttggtggcgtgggtgccctgacgagcagcggcgcgctgggccaccacaacctggtggatcagcgggatacgggactggacttcttcggcggagaagccgaagatctcagccggagcctcaacggttccggttgcattgccctggttatcggtaacgttcagagtaacgtttgccatgatttatcaggctcccttcactgccgaacggacgagaacgatgctgcccttcgggcccgggatggcgcccttgatggcgagcacgccgttctcaacatccgacgaaacgatggtgaggttcagcgtggtgttggttacatgacccatgcggccagccatacgcttgcccttgaggatacggctcggggtagcgcatgcgccaacagagccaggacgacgctcgttcttgtgagagccgtgggtacgacgataggacttgaagccccagcgcttgatggtgcctgcgaagcccttgcccttggtggtaccggtcacatcgaccagggtgccctccgggaacagctcagcggtcagctcctgacccggctcgaactcttcggcgttatcggtgcggacctcagcgaggtgacgacgcggggtgacgccagccttggcgaagtggccggcaagcggcttagtcaccttggtcgggtcaacctggccgtagccaagctgaacagccttgtagccgtcggactcttcggacttgacagcagtcaccacgttggtggagacgtcaacgagggtcacaggaacgaagaaaccgttctcgtcccagacctgagacatgccgagcttcttgcccagcagtgcggtgcgattagacataatggttccctcctcccttacagcttgatctcgatgttcacatctgcgggcagatcaatatgcataagggaatccacggccttcggggtcgggtccacaatgtcgatgagacgcttatgagtacgcatctcgaaatgctcgcgagaatccttgtacttgtgaggagaacggataacgacgaacacgttcttctcggtcgggagcggaaccgggccaaccacagttgcgcccgcgttcgtcaccgtttcgacgatcttcttcgccgattggtcgatgacctcatggtcataggacttaagcctgatgcggattttctgtcccgccattgccttccgccctttctagcgattcgttagttactgtttaccagcctgcttctcaaagggcaccggcgcagaagacccccgaaaccgtggaagttccgtggtcataccacatcagtgcgcagccatgcagttttcactctcgtgatcactgtgccacgctcgcttttttaattccaatttgcgagccctaaaatcaggcaacttctttatttaagcatcaggggtagtcttaagaaatcctcgcgtgtcgcggtctcaagtcctgttttcaagtccctgaaaacgaatgagatgcacattgccgatcgtctgttgcgatcataatgcagcatcatccgaaaatgcttttccacatataaaaaacgaggaatccggttgaacgaatccaaccaaattcctcgttatctatgatgcttgccgatataacgcaagcaccttatatataggtcactgctgatggcctatacatgaagcgactcatgcacgctcggaagcttcttccgtggcggcctcgccctgacgctggacgcgcagcttgtgtccttcggcctggctgacgccgtagtatgcggcgatggcgatgtccttcatatcctcgatctgcgggatacgcggatttgccggagcgcactgatcctcataggcacgcatgccgatctgatcgaggatggaccagaagtagtcctcgtccacaccgcactcctggaagctcttgttcatgccgagcttgttgtcacggtagtcctcgacggccttggccaggttctcaacgccctcttccggagtcttgcccgggttcacgccaaggttcttggcgatctcctggtaacgttccggagcgatgtacttgttgtacttcggccagctggtcggttcctccggaatggagccgttgtagcggatgacgtacggcagcaggatggagttggtacgaccatgggcaacgtggcacagagcaccgatggtgtgggccatgccgtggcacatgccgaggaatgcggagccgaatgccatgccggccatggtggcggcgttgtgcatcttctcctgggccttgatcttgtcttcacccggctcgccgttgacggactcggcgaggttgtcccaaatcaacttggccgcgtgcaacgccatgccatcggtgaaatcgttggcatagacggagacgtaagcctcgaaggagtgggtcagggcgtcgaagccagcatcggatgcgagcttgcgcggctgggtacgcgccagcaccggatcgacgatggcgacggacggggtcagcgcgtaatcggtgatcgggtacttgtagccggtcttgtgatcggtgatcacagcgaacggcgtgacttcggaaccggtgccggaagaggtcgggatgcacacgagcttggccttcttgcccagcggcgggatcttgaaggcgcgcttacggatatcgaagaacttctcacgcacgtcggagaaggagatttccgggtgctcgtacagcagccacatgatcttggaggcgtccatcggggaaccaccgccgacggcgatgatggtgtccggctcgaactcctcacgcatcatggtggcaccgcgctcgacggtttcgacgctcggctccggctcgacgtagtcgatgatgcggaaggtcacacggttggaacgtgcgcggagctggtcgatgatcttgtcgaccacaccgagctgctccatgaccttatcgcacacgatgacggccttctcgatgccgtacatgtcgcgcaggtacttgatggcgttcggctcgaagtaagtcttggccggaatcttgaaccactgcatgttgttgttcctccgagcgatgcgcttgatgttgagaaggttaactgcctgaacgttgccagacacggagttgccgccgtaggagccgcagccgagggtcagcgacggtgcgatggcgttgtagatgtcgcccacgccgccgagggagctcggagagttccagatgatgcggcatgcgtgcatgcgctggccgtattcgcggaccagagcctgatcgttggtgtggatggctgcagtgtggcctgcaccatgcttgagcatggcttcgcacatttcgaaggcctgttccttgttgtcggacttcagtacggcctggaccggagcgagcttctccatggtcaacggctcgttctcgccgacttccttgcactcggcggcaagaatggtgacgtcttccggaatctcaaaacctgcggccttggcgatgtactgcggggacttgcccggcaccacagagttgagcttcggggtctggccggaatatgcggtgcagccgaacatgtactgctcgagcttggccttctcttcgtcgttcacgaagtaggccttgcggcgcttgagttccttgatcagcggagcgtagacttccttgtcggcgatgatggcctgctcggtggcgcagatcatgccgtaatcgaagtgcttggagagcaccagatcgttggcggcgcgcacgatgtcgacgttcttgtcgacatatgccggagcgttgccagcgccgacgccgagggccggcttgccggaggaatatgccgccttgaccatgcccgggccaccggtggcgaggatggtggcgataccatcatgcttcatcagggcgccggtggcttcgatggacgggtgctcgatccactggatacagttctcaggagcgcctgccgcgatggctgcgtcgcgcacgatcttggcggcttcgacggagcacttctgtgcgcccgggtggaagccgaagatgatcgggcagcgggtcttcagcgcgatcagcgacttgaagatggcggtggaggttgggttggtgaccggggtcacgccggcgacgacaccgaccggttcggcgatctcgtcgatgcccatgacatcgtcttcacgaatgatgccgacggtcttctgaccggccagatagttggtgacgtgctcgcaggcgaagatgttcttggtggccttgtcttccaccaaaccacggccggtttcctcaacggccatcttggcgagcaccagatgcttgttcagtgctgcgacggaagccttggcgacgatacggtcaacctgcttctgatcgagcttttcgaaatcgtcaagagccttcaggcccttcttgaccagagcatcgacctcagcctcagctgcggcgagcttctcttccggagtcggcttggtcggctcttccttctttgcgtctgccacttgaagtcctcctcgattctttgggggtttgcaaagtagtttcccgttattccatccgcctcgaagcggatggacgcgttgctggtcttttgtgacctaggacacactttagtgagtatgcaatatgatgttccactgtgtcgtgtcgcaagagaaatgttatcttctgttcatttaatgtttagattgcgttcttttatggaatcaaaaagcctcaaaaacatcattttgagcgtttttgttgctttttatcataaatcacacacactttctcaagtctcacctccatatcttttataaaagtattttctatatgatatcaatcatatcgagcttttacaaagtcgatttatttatcttgttcgtccaatgtattttttccgccagccagtaggagtttcgcctgtttcttcaaagaagcgacgattgaaattcgaagcgttaccatatccgcaagcgcgacggatcgaagcgacgctttgattcgtggtcgtcagcaatctgcatgcatgcccgatacgcaatcgtcgaacaaaatccgaaaaccctattcctgcagcccttttgaacagacgagagaaagccgaaacgctcattccggcctggcgggcggccaaatccatgctaatttcaccgctcagatgcgatgaaatgtactcgatggcatcattgaccacacgttccgcaccactgcatacagccggatcgtatccggacgcaaccaccgtataggattcatctgcgggggcatgcgcgaacacatccaacacacgaatcagatcactaacacggcaagcaagactatgttcctccatgttttccagaatcgaaccggcctgacgagcggattcaccgctcagcaccaatgcctgccccgcacgtttcaacaccattgcaaaaccagacgtttccggaaatccagacatcagcagacgcatggtttccggacgcacatggcacaccacatcacgctgacgaagccgctcccccggagcgatgtcggacacccaattatgcggaagatttgaaccaatcagcgcaacctgcccggcctcatacggaacaacggcattgcccgccatcatcaatccggtaccttcccgaatcagatgaatttcaatatgaggatgatgatgccatttcgccaacgagcttgggtagccatgcttcgcccaacgcaccgaagcctgcgcgtccggcacaatgatctccaatacgccggaatcgttcgaacttccacctttcggcacgaatccaccaaaagaggtctgagccaaagccgccttcccatgccgattatcgttgacttgtgcaacagcgcccatggcatagacccctttcgtcgttccgtaacgtgcgtaacgtcagtcgtttttcacggtaatctgcagcttaatgtctccaggacgcccctcggccatgcgatcgaacgccgcctgggcatcctccatcgcataggtgtcggtgatgaatggcttcagattcagtttaccgttagccacgaggtcaatggccttctgatacacattggcataacggaagatattttcgatgcgcacctcggtagcctgcagttccgtaatgtcgatggccaccggattgaccggaatgccaacgataacggcagcgccaccgggagcaatcagcttccagaatgtctcgtatgacttcggcgagcccgagcactcgaaagccacatcagcaccccagccccccgtttcctcgcggacgcgctccaccagatcctccttggtgagatccaccggaataatacctggaatctgagccgcaatcgccagtttgattgccgacacatcagagatcagcaccttggaagcgccacccgccaacgcgcacgacgcggtcagcatgccgaccgtgcctgatccggtgaccacgcagacatcgcccggcttgatacgagccttggtggcggaccacatgcccacagccaacggttcaagcagcgcaccctcaccgaagctcacattgtcgggcagcttgtaggtgaacgccgcaggatggttcaccgtttcgcacaggcagccatcaatcggcggagtggcaaagaaacgcaccgcaggatcgacgttatacatgcccagtttgctggcacgcgaactcatatccggaatgccgggctccatggccacacgatcgcccaccttgaagccttcgacgccaggaccgacctcaatcaccgtgccggaagcctcatgaccgagaatcatcggctgctccaccacatatttacccacgcgaccatgcgtgtaataatgcaggtcggaaccgcacacaccaacggtatgtggcgcgatcttcagctcgcctagaccaggtgcggggacgtcaggcacctcacgcacattgatgacgccctgctcttcgagaacgactgccttcatgattattctcctttgtggataatgatgtttttttgagaaaaatgatgattgagcaattgatattcaattgcgattagttacgttcgaccgcggtaatgcgatggccacgatcgtcaaatccgggttgatgaggatgaatgccgagcgtgaccaacgatccgatcgcatagcagatcgcatacgtccagcacacgccgccgaatccgatagtggaaatcagcaccgtcgcaatcagcggaccgaaaaacgtagtcaggccggaagcgagattatgcgcggaaatcgcagcacccttatgttccgacgccaacgcgggaaacacggctcccataggaacgaaagcggaaattcccaatccaagaacaaccgcatcagcacacataagcaccatattcgccccgaaaaactgcggaatgtaatacatgcccagcgtgccgatcacacagaaccagcagccaaaccagcgcatttgccgcatccaaccatgcgaatcgcccatacgaccccagaacacattgccgaaaatggtgaccacaaactggaatccccaaatctgactccattgcgaaaccttaaaccaagcgccgcctccattgttggtagtggccaagtagagtggcatgatgacgggaaagccgtacaacgtcagattgcagatcacacgcaccaccgcagccaaagcgatttggcgattatgcaccagaatggtgactcctcgactaagctcgcgcagcttgtctgcattgctcatggaagaggtgtcagcacccttgcttttcggcaccagcagcaggcaaatcagcagtccagctatagaaaaaggcaacgaaagccacagcgagtagtactcgcccaccagcggaatggtgaaactcggcaaatatgcgccgaacacgccaatgccgaacgagtaggcggcccaaaaccaccccatggccgacgcgagcttggcagtatcgatggtttgcgccatcaacaccacgaacgagtagatgaacagcgggtagccaacaccccgcaacgcatacacgcctaacatcagcggatagacgccgctcggcagcgccacaccaacgaacagcaggtgcaaaacgacccaggcgctcgcgccgatcagcatgatgcgtttggcaccgaacatttcagctagcacaccggacgcccagccagcaagcgcagccatcagcccgtacatggtgaacatcagcgacgattgtgaagaactgaatccctggtccacgatgtatttggacaaaaaagtcaattcaaagccatcgccagtcatgaacaccgctatggcgaccaagccggccaatagcgtgcgcggcagacctatcttcataacatgtctcttttcttggtagaacgtcgttgtcaccgtctcaacttttttgttgataaacatattttcgacgcagaaaagtggcagaaaatcctttatgcacagctatttttgatacttttttgcaatacctgatatctcagaccaacacgagacataaggaaaggacttttatgaagtagtcttggaaaagaagttgcgcaggaaggatcaaccagtgaaagcccaatccgccctatcagtcaaagaagccaatctcaaggccatgaccgcgttcatctatacccaaggttcagccaccaagcagatgttcgaacacgaattagggctcagcctgccaaccatcacgcagaatctgcgcgccatggaggccgacgggctcatcgtcaaaggcgagatgcagcaatccaccggtggacgcaaagcgcaaatctacgaattcgcggcacactccagcgtggcgatcggcgtgcgcatccaaaccacacaaatcacggccatcgccattgatctgaacggcaaatccgtagccaccagacagcgcacactcccctatcgcaacaacgacgcctactaccagcgcatgaatggcatcatcaacgatttcgcgcaagaactggcgaaacaaggcagcacggtactcggcgtggccttctgcatgcaaggcatcgtgtcggcggacggccagtcgatcactttcggcaaaatcatgggcaacaccggcctgaaactcagcgaactcagccatggtctcaaccatccgtcgctgatgattcacgattccgacgcttctgccatggcggaactctggttcgaccacaatctgaaggatgccgtctgcatctacctcgaacgacgcccaggaggcgcggtcatcgtggacggatcgctctaccaagggccaaaccaatgcaatggctcaatcgaacatatgacgctgattccaggcggaaacccttgctattgcgggcaattaggctgcatggacacgtattgctcgccggaaacgctgatggaggacggcgaaagcctgcccggcttcttctcggtattggaacaaggcgagcaggagcatcgcaaacgattctcgcaatggctggattatgtggcgctggcggtaacgaacattcgctcggtgctggccggtgacgtgatcatcagcggtgaggcagcacaatatctcgatgatgacgatatggccggactacgcgaacgcgtggtggaacatacgccattcggcaccacggatttcaccctgcgcaagggaatggcgctcgaccatcaagacattatcggcgcggccctgcgttttgtggaaccgtacgtacgcgaactatgcgatatgtgaccgcttttacacatatattaatcgcatcgcttgcataacaaaagaagcgtgttgccgaacccgtatataaggttcaacgcacgcttctttgttcgcttccgtctgcttcacttgttgtattttttcagcgattatttgacggtaatcatctaatgatagttatttgacaatctggcagaattcgatggtttcgccgttcggtccgtatacattgaagtagcgaatgccgtgctcccagaagctgtcgatatgctgaatttcagtgtctttgaaattcagtccgagttccttcgcgttttcgaacgcggcttcaatgtcgggagtatcgaacgcccagtggttgatggcaccggtggtcagcggcgctgggtcgccttcccaggtttcgatggtcagatggccgtaacgcaggaatgcgcaacggttttcaccgttatggaacagtcccgccagctcgaaaccgagtttcttggtatagaattcgatggtttcgtccagatctttcgccggcatgccggaatgctgcagatcggtggtgaattcagacattggtttggtcataataccctccttgtgatggttggtacgatacgtttttcccttttgtgattaggatatgcgctatgcggcgatgtcagcggcgcatttgccgtcatatcgtgacacttttttgctaattccaggctgttcaggacgaataaacagcgtcagcaccgattttgacgacagccttggaagcggcggcgattttgccgtcgaggaagtcctgcacctgctcgagttcaagctcacggccggatcagaccggcacgagcgtcgacagcctcgacatagtaagtcaacagataatttcaaagtgtttagaatgaggttatgaagaacccgtctttgcaccgttatgcaactcgtccaggtctctacttcaccgatgatggtggggcggatgccatcgtccgctcggaaacagcggaccaagtgtggttttgcgtacttgagccgctcgaccaacccagtgccttctatgccgacgcagtacgattgttcaacgagccggggctgaccttcatcgatcaggcgatgaaacagcgcatctgcactcggcgaatcccctcgctcaatcttcgcgaaacactattccgcatggacgggcccaattacggactgtggtacgtgcacgtgccgcaagcatgggacggcatgcaatacggataccgcgtcaacggcccatgggaccccgaccacggcgtgagcttcaacccgtacaaactgttgctcgacccctatgccaaaggcatcgaaggatcaatggagcttgatcccggagcgttctcctatgaatgcgagatcgtgaacggcaaagtcaaaggttcgccattcggcccgatgagcaccatcgactccgtggggcatgttcccgtttccgtggcgatagacgatcgtgccaccaacaagcatgacggtgagccatcacacccgcatgtggcatggagcaaaaccgtgatctacgagctgcatgtcaaaggcttcacagccaacgcgccttggcttcccaaagagcttcgcggcacctatgcaggtttggcacatccggcgacgctctcctacctgcaggatttgggcgtcacttccattgagctgctgccgattcaagccaagcaatccgaactgtttctgcaggaacgcggacgcgtcaactattggggatattcgacgctcggctatttcgcgccggaagcctcatacgccaccaagcgctcccaggaggccggtgcggccgcagtacgccaggaagtcatcgacatggtacgagccttgcatgaggccggattcgaagtgattatggacgtggtctacaaccacacctgcgaatccggtccggaaggaccgaccgtatgctggcgcggactcgacaatctggcatattatcgacgcaccaaagataagatcagccgcctgtacgacaccaccggctgcggcaacacgcttgatttcaccaacacgcacgtcaccacattcgccgtggattcgttgcgctattgggccaaacgcattggcatcgacggattccgattcgatctcgcggcgacgctggcacgtctcgacggtgaattcacccgctaccatccgttcctgtatgcattgcgttccgacatgctgctcggcaatctcaaaatgatcatggaaccttgggattgcggtccaaatggctggcgcaccggcgaattcggcatccccttcgccgaatggaacgacaggttccgcgattgcacacgcaaattctggctgaccgacgtggatcgcatgcgcggtggagaatacggcgaaatgaccatgcaggagatggccacacgtttgtgcggatcatccgacctgttcgccaccgatccaggccgcggttcgaccgcgtccgtgaattacgtggcatgccatgacggcttcaccacagccgatctgaccatgtacaaaaccaagcataacgagaccaacggcgaaaacaaccgcgacggaacaaacgacaatcattccgtcaacttcggtcacgagggccccagcggcgatcaaatcatcgtgcagcaacggcaacgcgccaccatgaacctgctgggtacgctgctgctttcgctaggcacgccaatgctgcttgccggcgacgaattcggcaattcgcagaacggcaacaacaacgcctacacgcaggataacgacaccacctggcttgattgggattggctgtacagtaccgaacaaacgccggaattgaagcagttcaatctcacttcccgtttaatcacattgcgtaaatcccgcgatttgtacaatcatgaggatttcttcactcgcctgagcgaaatcggtttgctgaagaaatccgatcgcgtgcattggtatttgccgaatggacagatgccaaatgatgcggattggacgaatccttccgtccgttcgttcgccatgcagctgctatcccccgacgagccaagtctgctgattctgatcaacggttccgatgaggtcacgcgttttcatctgccgaaagacatcgaatgggagatggtctggtcctcatcggagattgtcggcgaatatccgggattgggaacgtccatcgaacgggtgtcggaattcgacgaagaatcggaaagcaagcccgcgggcaggctccgcaaccatctgcaccgcatcaacatgatgtactggcaaatgaaagacgatgcggacaatctgcaatccgccgatgatgggctgtcggaagatgatccgacattgtggacgcttccggcattgagcatcagcgcgatgaagcagatgccaaccatctaaacgccagtcaaaataccgtctggaataccaagaaacccctcggaagtcgaatttccgaggggtttcgtataagccgtaaagctttagcgcttcgagaactgcggagcgcgacgagccttgtgcagaccggccttcttgcgttccacgacgcgagcgtcgcgggtcaggaagccagccttcttcagggctgcgcggttcgcatcacgatcgatagcgttcagagcgcgggcaacgcccaggcggattgcgccagcctggccggtggtgccgccaccgtcaacgaggacgatagcgtcgaacttgccttcgagcttgagaagcacgatcggggagttgacctcacgctgcagcagcttggccgggaagtactcttccagggtgcgaccattgatggtccacttgccggtgcccggaaccaggcggacacgagcgacggcttccttacgacgaccggtgccatagcccggagcgatagcggaagtaccggtgccagcgccagcgttggtctcggtggtgtacgaggtgagctcctcttcggtctcgagaaccgcggagttgttggtgttttcagccatgtttcttatctcccttcggttcacttagcctgctgcgagacctgagcgatctcgaaaacctgcggcttctggccagcgtacggatgctcggtgccacagatgatgtggaggcgatccagctggaccttggccagacgattcttcggcagcatgcccttgatagcggacttgatgatgcgctcagggttggtcttgagcagcttgccgtagctatcgcgacgcaggccacccggacgaccggagtgcatgtacagttccttgcccaacttattgccggtcagagcgatcttatcggcgttgagaatgatcacgtggttgccggaatcggcgtgcggagcgtaggtcggcttgttcttgccacgcagcaggatggctgcctgggaagcgagacggccgagcaccacgtcggtggcgtcgatgacgtaccagtcgtgagtcagatcagctggcttcggagtgaaagttttcacgatgtaccttttctatatattgtgttccggaccttccatcaacatctctgcgttggttaggcgcggaatgatgcctttttcaggtctcattatccgtgggctccctgaaagtcctcgatggcgagtgggaaaagcgctttgaaggaccccgtagggaaacacaacaatctactagtatatcgccagccttgacattcgcgacacatcaacccctagtacttgcgaatacggaaacacagcaatcgacacgcaaaagccggcgacgcttggcaggtctccctaccttgcatcgccggccttccgccaatcgaaatcagctgcaatcagcctcaatccgctgcaagctcagccgcgcataatcgctgcgatctcctgcagtcgagtattgtcgaacaactgctccagcggcacgacattgccatcgccgtcagccagcggaatacgccagttcggatattcgttgctggtgcccggctggttctgcgtgcgcttttcgccgaccgcgtcgacgatggacgccgccatgagcttgcatggcgatcccttcaaaccgcggtacagcgcgtcgatgatctcgttttcgttggcaagctcgtcttccagcgcggaagcgtcgagatagccttcgtcgacaagcatgctcagcatggcgttatgttcggcttccgcggacttctggaattcttcgaccggaccggacagcagtccaagctgttcacgcaatttgacatgcccgtactccaagtagccggctaccggaggcaaatcgtgcgtgttgacggatgccaacgcatacggacgccaatccttcggcgcacggaattcgccgtcgaactgctcgaaccattccacggcgcaaccgagaatgccgtgctcggacagcgacttggacacgtatgccggaaccacgccgagatcctcgcccacgaccacaccaccggcgcgggatgcttccaatgcgagaatgccgagcatgatgtcagaatcgtaatgcacgtaggtgccgtccatggctttcttgccttccggaatccaccacaagcggaacaagccgagaatatggtcaatacgtaccgcgcccgcattggagaacatgccgtgcaccatatctcggtacaccttgtagccggtctgttcgagagcgattggattcagcggcggctgactccaatcctgaccctgctggttgaacatgtccggcggagcgccgaccgtggcgcccttggcaaaacgctccgggttccaccacacgtcggaaccggccggatgcacgcccacagccatgtcggcgacgatgccgatcttcatgccggcctcgcgcgccgcctgctgggccgcatgcagctgctcggtggcgacccattcgagccaacgatagaattcaagcgtgtccgggtactgtgcgcgaagctgcgcgacttcctcggaatcacgattgtacttgcgcacccaatcgtcgtcgctgccattcgaggcgccccacttgtcgtagcacaggcaccatgtggcataggattcgatctcatcgcccacttcggcgagatactggtcgaactcggcttgacgctgtgcggaaaggccggacttgtagatgatccacaacgcctgcatcttggtacgccacatggtttcgcgatccaagatccgcgcattgccgttgagcggcttgacctgctcatgcagttcatccactttcgccttgtcttccggcgaaagcacggcatattccggcatggattccggtcgaatatagctgaaattaatgaaacggcgcgaaatcggcagatacggcgatggctcgatcggcggcaccggttcggcggcatgcagcggattgatcagcatgaagtcggcgccggtcttcttcttggactcgacgagcagggtcttcagatcctcatagtcgccgataccccaggaaccgctggaacgaatggagtagagctggctcatccagccccacagggagccttccttcatgtcgtcaagcagctcgatcttttccggagcgctgataacggttgcaatctccgtcttgccaccaacggtgacttcaagggtgtgatacccctcgggaagatctgccggaagcaccagatatgaggtgcacacgaagccgccgtcgacctcgaccacggtatcgctgccaccctcgagctcgattttgccggcatacgccccaccgtcttccagcatgatggaagcttcaggaacgtcaagcgctccgccgtgaacctcaaccttgctttccttgccgacaacgtgcagcacggtcggaggaacgatacgtgtgtcgcgttcgcgctgaatggtggtgatggactgctcgatcgccccatcgttggaagcgtcgattccgagcgccttgagcaccgccacgagaacatcgtcttcgatttcgtggtagtcgcggctcatgccgacgtaactggtggcgatacccaccaactttgccaggcgaatgatcggacgggctagacgcgttgcattttcggtctgttctgtcataaacaacagtctatgccccaatcacatgcaccacgcgcaaaaatctcataaaaatgacaacgtatgcaattatttttccgaaagatgccgttcagcggcccttttcacctctcctgacgcatcctgcgcaagtttttccaacatctgatcagacgtgttcgggttcaaagcaacggccctacgtaccatggaagcaagcacggcaggagcattcggctcgacgtcgacccccaaagatcccagaaaatcaagggccgtggaatccatacccggatcctgcgcgccttcgagccgcatcttccaagacgtctgcttgttgcgcaacgcgacatcgcgcacttcgagggactcatccttggtgagacgccccaccagccaattcttatcattggcattgcccgcaacagctttgcgcacctcaacggattcgtcggtggacagtttgacgagaatattcggaaacggcatggtttccgcaagaaaaacgcgatcttccaacggtgtatgcgcattgccggcgacggcttccagcaatgccgtggcacgcgagaaagcggcctgttcggaacggtcaggcagcggacggcgcgcgaattcgctcaattcggcggcatccgtggagtgacgcaaccgctcgtaggttgcggtcaaaggctcgaaatccgaaggaacctcttggtttgatgcttgttcgtcggcgttccccacaacggtttcgacggtattttcggcggtttccacggcagtagtgtcttgcgagctcatatcttcggtcatgcgttccaccttacgttatgttctgctcaatattccattcgtcatcgttggatttcagtatcgcaccgggcgattggacgtgcccgtttgccgcggcgtgacggtcgcattgaacgtttcgataattcgtgatttgaatttctgcgattgttcctgcggaacgataattgacagcacgatgcgatcggtatattgcgcatccgcctgctcgccgtccactgacgcaagcagattctgaaagcttcccaattgcggatagtcaagcgtcacctgatattcgcaacatggcacgatcttcgctttgtttgccgctttgaccgcaatggacgcacccgtggaatatgcgcggatcaggcctccggaacccagcagaatacctccgaaatatcgggtgacggcaaccacgcaatccgtcatctcgttggcacgcaacacgtcaagaatcggtttgcccgccgtgcccgatggctcgccgtcatcgctcatgcgttcggccaaacgaccgtcggaaccgccgcacaccgcagcataggcgacatgacgcgctttcggatgctggtcgcgaatcgtctgcacaaacgcgagcgcctcatccaaggagtcgatatgacaggcgtcgccgatgaattccgattttttctcgacgaacgcatcatgcgcgggctgatcggcggaatcgagtatggtctgcatgtctttcaacctacccaatcacgccgaccgtccacatgttttgcccataccggttttgcggttattcacacgacgacgttgaaatcctcgcccttgcagaatgccgcaacggattggaccacctgtctggtgatgcccacataggcgccatcggtgcgccacgcggtgtgcggggtgaggatgatgcctggaatcgaacagagcggatcgtcggcagtgagcggctcgtgttcgaacacatcgagcgccgcaggaatgtcgcctcgctggagtctggcgagcaatgcgcccggttcgatgatttccgcacgggccgtgttgatgaacatggttcccggtttcagagcttcgaggttttccgcagtgacgatgccttttgtggagtccagcagcggcatatggatggataccacgtcggaaccggcaatcagctcgttcatatcgttgactggagtgatattcagatcggcgaacacctgctccggcacatgggagttccatgcggacacgttcatgcccaaagctccggcgatgcgtgccacggtctgaccgatgccgccaaggccgatgatgccaagcttcttgccgtacagctcgtagccgtcggcaccgtcccaatcgcctgttttgacttgcctgtcgagtttgccgacctgtctggcgagttccataagcagtgcgatggtgtgttcggccacggcatggtcgccatagtgcaccacattgcatacgcggattccacgttccttggctttgtcgagatcgatgtaactggccacgccggtgccgccgaatgcatagcatttggcgttcaaccgatcgaggatggaatcggcgcagtggaatccgatcaccatgatggcgtcagcttcggcgcaacgttcgacgatggtgtcttcgtcaagcgtgaaatccttgtacatgcgcacgcgggcaatgtctttgagtagttcgaagttcttttcgaacggttcgatcatcgattcgatgatgacgggcatgaccaccagtggcagatcggtgcgttccggttgggtttcgtagatttccatgttttcacctcacattgtatgttcgagagttcttacgcatatgcgactcacggcatgaggcatattgtgccacggaaaactactggccagatgaactcgtttgctccgcggtaatattccattccttgaccacgttctgatcggcgcccatggaatagagcacgtcccagatgcgttggcgcacattggcgtcttgcgtttcgtcccagcaggtgccgtcaggatgatcgcttgcaagggaacaccattggtatttgccttgggtttcgttggcactgggcacccagtcaatgcggttgacacgccacgaaccggccacgcctttcttgcccgcgaattgaatacgcgcggtaatgccttgattgttcaccaacgtgtccgcagtattggccgattcggtcacggcattgcccaaaccgtagatgatccaagtgccgttgtaattctcgaccggctgcgcgcaatggcatccagcgccataaatcacgtcgaacgcaccggtatcggccagttcatgagcctcactttgctgccaggaatcagcgtaatccaaatactcctgcacggaatgcatggctatggccaccacatcggcaccctgctcgcgagcggccttcgctttggctaccgccttgtcgatatcggcttggtggttcgggtctccggattcacgcagacgatccacacgccagtcgtagtcaggcgtctgcgcgttcaacgacacggttcccgcaatcagaccaagcttaccgccaccggtaggcgaatcgatgaccaacggcttatacgaatcctcttcggttttataggagccggtctgggcgatgccatcctgatcaagtgtgtcccacaagcgcgcgatgccgtcagcaccttggtcccaggaatgattcgacgcatgcgtgcaggcgcgataccccacgtttttcgcggcgtcggccacttctgccggaatattgaataccggatagcccgtatatggaccgcctcgctgcgcgataggtgtttcgaattcgcatacggcaatgtcggatgcatcaatgtatttgcgcatcggctcgaacaagccggtaaagtcgaatgccgtgccatccgtggccgcggtgttggtgctggcgtactggttccaaagcccctcgtggaacagcagatcaccgttgacaagcatggcgatgcagtcggtgtcggggcaatccggagaattgccatgatgctccgcaggctcagtcgcctgcttcttttcaaccgttttcggctggcttaccgccatctccggcttcacggcagcatcgttctgcttcggttgaagactatgcaccaacagccaagttcccgccacaagcacgacggcaagcaccgccaatgccgcaaacacaagtttgcgacggccggccgcaagcacttccggattggtcgcgtgcaccgcctctttcctgtatttcatggcacccctgccttcctctggaccttctcaactcatcacttcaagaataacggatatgcccttgcttctacaccccgaagctggcgatattgttaccgtattttcgacgcaccgcatcaagcgccgcctccgcgccacgcaaacgcgccgaatgcgtctgcgactgggcgctgccgccggagatttcagcacgctgttcgacttcgttttcttcgagcagatcatccagcgaaggctgaatcacagcttcttcggcaagtacaagcccactggcgctcattcccgccaaacgcacggggcgtgtaagggaaatggcatgcgcagactccggagccatgcccatcatggagagcagcagattggcacattgcgggtagagcacgctcgccgcatccgtaggacagcccagtgtgtgcccttttgttgcgtagctcaaatccggaaaccgaagtttgaccatgactttacgagcgaggaaacccctcctgcgcaaagacgtggccacgtcatcgcaacaccagcggagcatggagcacacctgccgcatgtcttgcgtatccgcatcgaaggtgcgttccgcgccaatcgatttttcctgcgtatatggcacgacgggtctaccatccagtcctcgggccgcctgatacagcccacgcgcggaaatagccgatccagtagcctgttccaacgattcaagactcatacgcgcaagatcggcaacggagttgacgccccacgcattcagtcgtttctccagagaaggtccgatgccgggaatgccacgcaatggcatcatctgcacgaattgcgcatgccgcgccacgggaatcatcaacatgccgttgggcttggcattggtggatgccattttggcgaccagcttgtttgccgcgatgcctacggaacaggtgacgttgtaacgcgaaaccacctgttcgcgaatccacgccccaatggcgcgaggactcccccaccgcaacagcgccccggaaacgtccatatagcattcatcgaccgatacctgttcgatacgatcggtgatccgactgaacacttcctcgaaaatgcgatgcgacatcgcgcgatagtagcgcatgtcgaccggaaggaaaatgccgttcgggcagaacttttgcgccctggaactcgccatggccgaattaacgccgtattggcgagcctcgtagctggctgcggacaccaccgaacggttgcccacgccgatgatcaccggcttgccgcgatattccggatgcctcgccacctccaaagatgcgtagaaggcgtccatgtcgatgtgcagcaccgtgcagccagcctcgtcgtgaccccagtcacgtttggctgctgcgattctcggtgcggtgctcatggttccatgataaccgtttttcgcaagatattgaaacaaatgttcgaatatagtgccgcaccttaacgcaacggcgtgtcggcaaacccgaaaccagcatggcagcacaatcccacaacacgtattttcgttgaaatttcaacgttttctcatcttttttgcgagatatggtgttttgcccgcaaatggatggtatagttgcatgctgttgcgccgtgaaaacggtaaaacagtggagtcatgcctgagtggccgataggggcaccctgctaaggtgttagtcgtttttagcggctcgagggttcgaatccctctgactccgccttgagggttttcggagaaatccggaagcccttttttcatgccaaaacggcggaataccaacgatttcaagacatacggcacaaacagagaatgtacggaaatgtacgccaatgtcaacatttccggtacccagcaaggtacccgagttgagtacccaacaagacatgctgacgactgcactgcaaatacgccatagtgtccgcgctagtcatgagcgggggagttcagtcttcctcataatcacccccgttcacgctcaccgccacgtccaacgattgagacgccacatccgacggaatccacgcagaaacgcccctatacggcgaaatatccggcctaggacacttcaaacaactcctagcctcacaataagccgcacgacgccgaacagggtctttgatgctctgagcctccgcgagacgccaccgacgaaccagcctacggaaacggtgaaaagtcggataatcagtctcgaaatcctcctgcacgcgcaacggcaaaccattatgcggcagggacgatccacaaagaccgtccctgtttacatatcagtatttatacatcaacggcatgccgtcacaggccgaatgcttttcgatccatttcggtaagccaatccgtccgcatgcccggttcttggcataaatgcatggcggggcattcctcaccgatgcaaggatcccatacaggaagcggcgttccgtcacggtccgttccgttgggatcgccattggcggcgaaattggtccagtacagccccattcgccttgccagatcgtaatgccatccaacgaacggacgccagcatttcgcaaggcttccgaaggagaaccacagatcggacgagtggaaggctccggcatcatcccccggcatagcgacatcgaaatgatagtagtatggcgcggtcccaccgcttgcggtccatttgcggatcagcgtgagattgccgagctggccgacatgcacaggcttcccatcttcagtcgaaacgatgaactcattggtcgtgttgccgaccagcatgtcgacgttgttggccttgcagccctcgacgatacgctcctcctgatcgggaaggaacaggccgtccacgcatggcacccaattgacgatcatcgaccagtcatcttcacgtccgctgtccggtggaacaggcagggactcggcggcttccaataccgttcgggccgggattgcacgggcctgctccagcgtggagacacccaatgcttcgaacagacggattccgttggcctgcgcatgctccagcgtgtcctgccgcgcattgaaatgccctaggcctgcgccggattgcatgatggctttctgaaacaggccatgattcatcggcgagcagatctgggccaagacgctggcggcaccggccgattggccgaaaaccgtgatgttttccggatctccgccgaacttcgcgatgttttccttcacccattggattccggcacgctgatccaggaatccgaaattcgcatatggttcgccgccgccgcgttctacggcctcctcatgcagcaaagggtgcgtcataaacccaaatgcattcagacgataggccacgctaaccacaacgacgccgttcgctgcgagacgtgtgccgtcgaattccttttcacatgtgccgccgcattgataggctccgccgtagatccagaccatgaccggcagcttttcggaggctaccatgctatccgcaccatatccgcgtaatgccggagtccaaatattcaggtagaggcaatcctcgctcatcggcacggccggatcggtgccccattcacgatcatagaaatcatcggaggcgcccggcgtaggctgcatcgcggtaggcccgaaatcgaaggcttgcagcacaccatcccatggcagggccggctgcggcgcacgccagcgcagaccgccgacgggaggctgggcgaacggaacccctcggaacacggtgatgccctgatcttcagccgccaagccttcgacagttccttgcgccactatgacctgtcgcttcattgctctctttccttcgtatccggcgtcgaatacgcaaagtcgcaaaaatcggcgattccaccggtctcttttgtcgaatacaggaacaatccgatacggcaacctgtgaaatgatccattttgaagatcatccggtgcgctgtccccaatggacaccattcggattccggcgtatccgcatcgcggtagaagaacgtcacttcatccttgcaatcggtgaaatcatataccgcgcgcaggcgcatgcaatccgcatccgccatgatttccgcatccgttacggctggactgtcccaatcatcgtcggagaagatggaatcgtcattcgccggcttgtattggacggtcagcatcgtgcggccgttccttcgcgtaagcgcgatgtaggaatagcatccttggaacgccgccaatccagcgaagtcgccatcatgcaatgtcgacgcgtcgacggtgacttcggccaccgtcaccggccccatcgtgcgctgcgtcagcgtgttccatgcatgattgagattcgagctgatgcgtccggaatgcagacggaacgctcccggacgttccgtcaatgaccagtattcgttatgtgggatgtgattgaactgccagtatggctgcagacagttggcatcgactccgccttcggcgttatgccgggctatgaattcgctgccgttgatgggcgtgacaggttcggcacagcttgcagccggtacgctgaccgactgcggcactttgccgttctcgccgacgacggggaatccgtcctcgccgaaccgcatcggcatcagtatcggcacgcgtcccacaccgccgcggtcctgcatcatgaatgcataccagtcgccgtccggagtgtccaccataccgccttgcgcgactccgtaaccgtggaaggacaggtcgtcttcgatgatttcacgcacttcgaaagcgccatccaaggattcggccatcaagcaggcttctgttttgcccttgccttgcgggaagtgacaggtgaagacgtaatagcgtccatcatgcttgtacaggtgactgccctcataaccaaggtcagcctgcggatcgtcctgcacgatgacccggtcgagcccacccggcatcggcccgcttaattcaggattcaactccgtgatgcgcaatgtcgactgcccatgtacgacataggctcgatcatcgtcatcaaagaacagtccgctgtcgtaatagaagccgtcaagctcacgctttcgccatgggccgcatggatcgtccgccgtcagcagatagctggcatgcgtatcgttggcggcgaacaacacataccaggtgccccgatggtaacgcagtgacggcgcccacatgcctcgaccgtaggcgttggcaccttcacattccaaacgttcttcaggggtatccgccacgatattcaatgcgtgcgcaatgaattcccaatgcactaggtcatagctgcgcagaatatcgcacccgggtgtgaaatgcatagtcgtagtggccatgtaatacacgtccccgacccggatgatgtctggatcaggaaaatccgtgtagaccataggattagttgaggtaatcatcattcataccgatactttccgctcaacgccagcatggcgaaagcatagaggaaattgtcatagtaacgacgcgtgccggttcgcatcggcgtattccacagcatgcgcacccattcacgggcattatgctccgcgtcgggctgggccgaatgcaccgccgcaagtgcgccttgcgcggtcgcggccaggaatccgaccggatgaagcacgacctcgtccacggcggtgccgtcgatggcgtagacgctagtacggtcgtgggtcaggaagaatcgctgcagcgcggcgacgcggtcgcacagcacttcctgcggaccgttccaggctgcatccagcccgatattcgccgcggtacggtaggcgtcggaatagaaatgccaatgattggactcgtcgacatgcggctttccgtcataatccgcgtattcagcgttcatgccggtccgctcgtcgcaggccgcctgcagatagcgacggcttgcggcggctgcctcatgccaaaatggacggtcttcttcgtcggcttcttcggcgaatacttcatagaagtgcggcagatggtaggacggatcgctccactcggtttccggaatgaacttgatgagcttgttgtcgggattccacatgggctcgccgtcgtagcgttcgcccttatgaacgcaatatctcaagatctcgcgtccccatgcggaatattcgtagatatcctcgccatcaccccagcgacgggaggcgaggaacaggtccatcgcgaaatattcctcgccgtcaggtgcaggaccattcgagttcggcgtaccgtccggcgcgaccgaccatgcgaaataatgcgcatgatgaccgtcctccatgtacatgtgacgcattacccagccccacagcttgtcgaatacgtccttacggtcgtattgcagggcgatcatcatcgcatagctcataccctcggtacgtacatcgttgttgccggtgtccatcacataggcaagaccttcgtcgttctcccaatagaatttgttcggaccttcgaaaatttcatgccagacctgtgacacgcgcttatcgatggcgtcctgggcatatccgcactgtgcgaacatggactcgcccaatgtcttgttggtatcggttgcatttgtcatatcagttgttccattcccagattcggatgcgattctctccggagacaagaccattcaacgccccggccttgcgttccgttgccgtcaaggcttgttccagcaagtcggtgtccagcacatagtcactgccatcgggctgttcatagcgttcctccacgatgcgaggcacgccgagcatatcgctggtgacgacctgcatcctggtatcggcgacggcctgtggcacagtgcaccgcaggtacagtccatcgggttcttcgaccaatgtcaccggcatgggctcatcacacgcaacgctcgtggaggcggtgccgccgaagaacggggcgtcctcctgcatgcgctccgaatcgtcggctgtaccttcctgcttgttcagcccctgtgcgccggacagatagatgttgccgcccgcgtatagagactgcagaggattgcgctcgccaccaccctgcgaaggatctgcccacatggcccgctggcgttccaagtattcatgcatcgacatcgggcaatcgctgtaggcggacaaaccatattcaccgacagtcggtttcaccggttgcggcgcgaacatgttgttcagccaacgctcatcgccgccggacaccacagcgcacccggccacctcggtggtgtgcggatagtgatacggcgtggaacggtcggggacggtatgcggttcaatgccgccgcaaatcagattgttgacgaaggcaccaccttgcgaccagttctggaacatcaccggcgaggcgaaaacgttattgtccaccagatacggcccatgactcacttcaatcatgaggtcacggacgttatcgtggaacacattgcgcgtgatgcgcgtgccctgcgtctgccaatccatccacatgcccagcgagcagtcgtggatgttgttgttggcaatgaccgtatccaatgcggcatggaatttgataccagcgacctcccatccgaagaattcacgcttcaacgcaatgtgatggacatggttatgctcgatacggcagaatgcgctgcccatatgtccgacgatggcattctgtccgcactcgtagatgtcgttgttgcgtacgatatgaccgccaatcagccccttttcccagccgatgcgacgggccttgaatacggcctccaactggtactggtaaccggtcttgcgctcggttttcgcccactcgttgtcgccggatgagatttccttgcccaatgacaccgcggagaatttggcgtcatgcagcacgttgtcttcgatgatccagccatacgaccagttcgggccgatcatgccccactgctgcgaggtaggcggcgcccaatctccagtggcctgcgccatttcaaagccacgcacggtgatgtagttgacatggttgcgggaagggaagaagcatgtgcgacgaacactgacctccaccagttcctcattcggattggcaccttggaaattcgcccagatcgttgtggtgccggcattttcgtccacttcggcatgccatacataacgtgtacggtccacatccggcacagggcagggaatcttcaacacgaaatcctcatccgtatcacgcggctgcggatcgtatacgccttccaacgtcgtcgattcgaagaaggaaacaccgttgagatacacatcgccaagatgtttgtccggatccttgccgaacttaggcatttccagccagtcgccgaaaatcggggtcgcgaatggattgaaatccccgaacatcgtattatcaagtaccaccgtccacacatgcggatgatcggccaattccgtccagccctgcacgcattccgagcctttgataaccggccgtgcttcgccttcggctccgcagtaggtgatgcgctcatgctcactcagaccgccgcgtttcggatcgacttgttcgcggtatacgccttcatgcacgattaccgtatcacccggagaggccatctgcgcggccttggaaatcgtggcgaacggatgctccgcgtcgccgcacgccgcatcgctgccggttggtttgacatggtattcaaacttcattgctgaatctccttattcacacatgttcctaaaccgtgacagtaacgctccgccatggttcgcaccaaccccataccggtacgtcctgcccggattgcagcacacatccgtcatcgaaaatcttcggcatcgcaagcatcgttgctcttccttcttccatctttgacaagtccacataaagcctccgtatacgattcatgacggcttgcatacgtcagtggcgacgaaaacacagctcccgtcgccaccaaaacacctactcgttatcgggcaattcccgataatcgaattcgctgaatttcgcaaccctgtcgtatccagaaagatcgactgcagccaaaccgacgaatgctccggtgaagaatccgccatatcgacgcaggatatagtcgtctgacaggatcttcgcgtccagtttcacgcccaaatcaacccatgaagtcccatcaaacgaatattcatacgaataccactgcttgcgcaccttcgtgcgcagccacacggacttcacgtcatccggcactgctggagcggtatcccgcaggaacgacgtgtagttgttgaaatcgttctgagcgacctcaatcacgcggcattgccgccgctcgtcccaagtcacgaacacccacgaccagcataaatcatcgtagtagttcgtcaggccggccatctggcggtagttcttcggatcgaactcaacctttacggtcgcatcgaagttgaacgcctgccaacgacgtgccaccaatgacagatcgaaaaggttgcacagcgagccctggccacgcagttccaacacgccgccaccgaccttgcccatctcgccatcgaacggcacacgcagcgtattccaattcaaatccaacgtatcggacatgaaatcgtcatgctggctgtgatccgcaggtgcctcggtctcgatggcatccttcggagcatccacataacgctgtccgccatggcctccgacaatatacggccagccatcctcggtccattcgaccttctggatggaggtttcacgccccagcgtgcaccagccgcgcggatcagtgaaggattcattgtcgtgatgccacggacgaccgcacagcgaggcgtaataccattcgccggacggggtatcgaccagcgcgccatgcccctgcttttgcagataggaacgcggcgtgtcgaaattcgtgatgaacggattcgacggcatgccttcgaaggacaacgcgtccaaagacttggatcgggccacgacttcctgatgcgtatacacggtaccgccttcagcggcgaacaggtagtaatagccattgatcttgtacagatgtggtccctcggtgagtttgacgtccgtaccgcgccaaatcgtacgttcagtttccggcttgagcttcatcgtcttcacatcgaattcggtcagtgtgatgccgtcgaagccatgatggtactcacgaaaatcccaagtctgctgcaccagatacttgcggccatcgtcgtcatggaacaggctggcgtcgaagccgacaccgttcacgcgaatcggctcgctccacggaccatggatactttcggcagtgaccaaatagttcgtgcaatccttgaacgcaccgttcacgaccttcacgtccgtgtagatcagccagaatttgccgtccgcataggaaagatccggagcccagatgccaccggatgacggattgccgcgcatgtcaagctggctcgtgcggctcagtggactcggcaacaggttccaatggaccatgtccttggactcgtgcagacggacacctgggaaccattcgaacgtggaattggcgatgtagtaggtatccccgacccgaatcatcgagggatcggcattgaatcccgggagaacggggtttgcgatttgcataaagtactcctttatatggaaccctcggccataggccgagggagttgcaagcaatcagatgatgatcagacgtattccatgcggcattactgacggctacgctcgtcacgaatcttcgcgaaatgcttctccggatcaggcgcggcattaagcaacactttcgtgtagtcttgctgcggattcaaaatcacatcatcagaaggaccatgttcaataatgtctccatgacacatcaccataatctcatccgaaaaatggcgagcagtcgccagatcatgggtaatgtacagcatgccgatgtgttcttcctgctgaattctagacagcaggttaagcacgcctaaccgcaaagaaacatccaacatcgaaacaggctcatccgcaattagaacctttggcttaggagccaatgcacgtgcaattgcgacgcgctgacgctgtccaccagacagctcatgagggcgtcgatacatgaacttgacggcaggcgttaattcaacacgttccagcagttcgataaccttctgctcatattcctcttggctatttgccatgtgattaatcataagaggacgaagaatatggtggaaaatcgtatgatatggattcaaggaagcgaacggatcctgaaataccatttgcacattatgacggtattcgtacaaatccttaccatgcgtagggacaggcttgccgtccaacgtgatgcttccagaagtcggcgtctccaaacatgtaatcattcgggcgattgtcgatttaccggaaccagactcaccaacaagagcaatggtcttatccgaagctaactcgaatgatgcatccttcaccgcatgaatcgtcgtggttttcaaaccattacgcagggtaaaatcttttttcacatgttcaagcttcaatactgacatgattattcctttcacgcatggcgtggaacacgaacgaatgagccacgatctcctgtcaaagatgggaacgagctcagcaaccgttgtgtatacggatgcttcggattgaaatacacgtcttcagaaacgccttgttctacgatgacaccatctttcatcacagcaattttgtccgtgatctccaagagcatcggcaaatcatgcgtaataaaaataacagagaagcccttgtcacggcgcaattccgaaatttcctcgatgatttcacgctgtacaacaacgtccaacgccgtggtcggttcatccataataatcagctgcggctcaagagccaaagccatggcaatcatcacacgctgacgcatgccgccggaaagttcaaacgggtaagcagctagacgattcggatcaacatgcaccatctcaagcaaatgtgcgcaacggtcttgtcgttcgctcttcgccatctgaggacgatgagttttataaatatcggcaagttgcttaccaatcttagttacaggacttaatgaattcatggcgccctgaaacaccatggaggttttctcccaacggtattcacgcaatgaacgccccgacaaagcacggatatcaatatctttccctgacttatcatggaaaatcacagagccagagttaatcttacccggagctttcagcatttgattgatgctatacgccaatgtactcttgccgcaaccggattcaccagccaaaccaagcatctcaccgcgacgcaattcgaatgtagcgttctgcacggcgtgcaccggattatccgtatcgtagataacgtcgaggttatcgaccgaaagcaggatatcagaattctgagtcgccatcgtgttcaccctttccttcccttgcttttcttggtaggcttacgtagtcgcggattgatgacttcatcgatggagaaattaatgaaggacaatccggcgccgatgatagcgatcatcagtcccggtggcaggaaccaccaccatgcgcccgtgttcagagcagaaccgttctgcgcgtaatacagcatggttcccagcgagaaggattgggtcgatcccaggccaatgaaggacaacgaagactcactcaggattgccataataacggagaacacaaactgcgatcccatcacaggcaacagattaggcagaatttcaacggtaatcacgcgccacggacgttcacctgcaatttttgcggcaagaacataatcacgcccacgcatcgacaatgtttgcgcccgcagtacacgggcaccgccagcccatgcagtgattgaaataacaatgaccaacatcatcgtgcccttggaaggcatcaatgcagaaatcacgatggtcagaggcaaccccggaatcaccagcatgatattggtaatcagagagaacaaatcatcccaaattccgccaatatatgtgcccaaaacaccgaaaatgaacgacaacgcagttgcaatcaagccaacagcaaagccaataatcagagagccacggacagaatagccaagctgagtgaaaacatcctgaccagactgcgtagtgcccaaccaatgctgggcagatggcgcagacaagccaatgtcattgatcttattaggatccttcgtgaagataggaacaataatggcgaacaaaaccattgcgatcacaatggttaatccagccgtcaattttgcagaacgctcaggaagaactcgcttgagagaatccaaagcggagcgacgacgtttagcttggctacgagccacagcagcagaagaatttgttgcagacatatttaacctcaatcctgttgccgcgtacgtggatcgataatgccgtaaagcaaatcaatgataaagttcacgactagaacagtaacggtaataatcaggaagataccttgcatcagcgcgtaatcgttactggtcaccgcttgcaaaagcatctgaccaacacctggataggagaacacctgttcagtaagcagcgatccacccaccactgcaccgatagacgtgccaaagccagaaatggatggcaacactgcattacgagctgcgtagcacatcataacgcgtttaggacttaaacccttggcctcagcagtaacaatgtagtcctcagacaacgtggagaccatcatattacgcataccgacaacacccatgcccagagagctgacaagaatcgtcaaggccggcaagattgcatactgcactgcgctcgagaagaattcccaagtgaagccgggcacaacctcacgataattgtatccgcctgactgagggaaccaatgcagcgtacgggcaaacacccaaatgaagatgagtgcaagccagaagtaaggaacagcttggaaaatggtggacacaggggaaatgatgttatcaaaagcgccaccacgacgccaaccagcccagataccaagagcctgttgaacaaagaacgatataatcgtggttgtgccgacaagacaaatggtccaaggcagtgcagaagcaatggacgttgtaacttggttggggaaatacgttacagatacgccccagttgccggtgaagatattcttcagataaccaatatactgctggaagatgttgcctccatcttgtcccagcattgcagtaatcgcttcccttgtttcgggcgcaacagtaccacctcgcgatgcaagcctggtaagaacagctgaaaccggatcacctggcatcagtcgcgggatggcaaagttcaatgtcaaagccgcaaacaatgcaacaaggtaaaatcctatctttttcaggtagaacctcatgttacctcatttctacatggaaaaatggtgcacaaaacgcacagctaaaacgccttgtgcaccgttgattcataaaatccgtcaggttacttcttaaccttcaggttcttcaggacaatgcccaaatcaggatttgcccaagtctgcggattagcatagacgttatcgtctgtcggccaaccggtaaccttatcgctccacatttcgctcagaccggattgacgcagaatcgggatatacggcatgtcctcaaacacctgagtctgaatcttctcatattcagacttcttggtcgccacatcagtggtggtattgatggcattaagagcatcatccacggtcttattgctgtagcgagcgtaattaggccaagcgctcttacccactgcagccgtactggcagtggaatagaactggttgtagaacatccatggttcggcacctgcgacccacagaccataaatggacatttcaaactggccctgctgcatcgcctgagtccattcattagaagacatttggtccgcatgcagatcaataccgatctttttcagctgctgcgaggcgacgttaatcgcgttgatccagtcagagacatcactcataacagcgactttgatgctcagcttaactccgtccttctgatagatgccgtcatcacccttcgtatagccggcgtcttccagtaccttgacggcttcatccgtacgtcctttacccggaataggtgaatccgggacatcatccgaagcgtacttggtgaactgtccatacggatagagagaaccagccagctcactgtactggccattcagagcgagtttattaatctgattacgatcaagagcgtaatagatagccttgcgcactgccggatcagtggtaggaccactgcagccgagttctttgttcgaacaggtcatgaatgccaactgactagaaggaacgttaaccgtcttaatatcaggatatcccgacagcacatcatccatattcgggaagatcgcagacatccagtccacatcgccagcggtcaaggcattttgagaagcttgggtgccaccggtgatcagaacataacggacgccatcaatttcaggcttaccttcatcccagtagtacggattcttcttaaacgtgtaagcggttggggaaaagttcccgcccttaactgtgaaaggcccagagccaacagcgtctttattggtataggtcaccggatcatcgatcttttcccacacatgcttcggaacaatcatcgtgccggacagatacgacagagcattcaccgattcaggcttgtccaaagtgatacgaacttccgtatcgctaaggaccttggcagagccagcaaagccactggtattcaaagccttgttggaattaaggaggttgaatgtgtatgcaacatcttcggtagtgtaaggttcgccatcagaccacttttcaccgtcacgaatcgttacatcaatagttttcgcatcgtcactgatagtgtaggatttacccattagcggttccagcttagtagggtcgtccttaaggttgttcatatagaacaatggctcgtacagagcaccgaccacaccggtcaaagctgtagaagagaacggattataattcaacgacgcctgcgaagttgaattcataacactgttgataatgactccgtccttcgcggtgttattagtacctccgccgcaagcagccattgaaacggccgctacaccagcgcaaacagcagcaagcactcgttccaagttcttgacttcatcatgtctttctcctttggtgacatgcatgaacacacatcgtcatgtttcatagatgctttagcatttcagttaaagcactgcttgattatatgacttgattttcaagaaagtcaagtcacttaactaaatacttaaaattttttgttacgaaagttctatatgcaaatatttacgaaacttttgaatagatttaagtaaaccagggacgacgccctgcggcctagcctacgccgttcactttgccatcagcgacatcaacagctgcgcatagccataagacgcatgggcgttggactccccctgactccgcagataaaggggcttccagcgattgccggaagccccttttgcatatcggcttagcgcgccaaacgctcagcagcggaagcgatcgcctcgtcgctggcggtggcggagaaacgcagacattccggcgcaccatagaactcgccggggctggcgatgatgccaatcttggcaagctgctccatatcggtccaacaatcgcccgacttggctctcacccacacatacaatgcgccatccggcatgtcggtgcagtatccgtaagcacgcaacgcgctcaccaacacgccgagacgttcccgatagcgcgcatgctgaaccttgacggattccagatcacgcaatccggcagccatcgcagcctgcaccggaccaggaataatctgaccaatctgcttgcgatatgcactcatcgatgcaatcaaagactcatctccggcaatgaacgcggtacgatacccagccatattgctctgcttgctcaacgaataaagcaccagcacgccctcggcggagcccaaacacacatcgtcacaaagcgcgcacggcgtcgacgcaagtgaatcagcttcaccttcagcgccattcacagcacccctccactgcatcagcgcatagcattcgtcggaaagcaccaccgcgccgatctcacgcgcagctgcgacaatgccagccatccgctcggccgaatacacctcgcccgtcggattgcaaggggaattcacccataccgctttgacaccaggcacattgcgccacgacgcaacatcagccacatcgtcgaccttaagcaccttcgccccagccaactgcgtgccgatctcatacgtcgggtacgaaaccttcggctgcaccacaacatcatcctcaccgaaatgcagtagcgacgccatcaacgcaacaccctctttggagccgacggtaggcaccacatcagcatgaatcgccttcaaatcaacattgcgagtcgccgaaaaccattcagcaatcgcagtacgtaaatcggcagtacctgcagtagccggatatccatacgcattcggatcattcgccgccgctgcgagcgacttgcgcaccgagtcgggcacaggatcgacgggagatcccacggacaggtcgatcatgcctccgaacgcagcttttgccgtgcgcttgtatgctgcgatacgcgaccaatcgtatggcgaagaaaactcatgaaagcccatcgtgaaaactccttaataatcctctataaacaaaatatgcggcctcttccaacgggaaaaggccgctttcaaatgccaatcactgattttgcggcggcagagcagctacctgctccggatccttgccgatcgggccggctgcggaagcgccgcccatatcaccaacttcggcaaagaagctgaccgcggcatccttgtaccaagcccactcgtctggcagatcgtcttcatagaagatggcttcggtcgggcacaccggttcgcatgcaccgcaatccacgcattcgttcggattgatatacagggaacgggagccctcgtagatgcaatcgaccgggcattcgtccacgcaggccttgtctttgacatcgacgcacggctgagcgacaacgtatggcatggttacctccttaacacttaccgttcaagactactcttaattgccaacttccagctctcccgtgccgagtcgggcgtggcggtagccgtagccgaagtagatgcagaagccgaccgcaagccagaccacaaatcgaatccaggtgagcacgctcaggttgagcatgagccagatgttggcgagcgcgatgatgataggcacccatggattgccggggattttgaagactcgcttcaggtcggggcgcttcttgcgcatgatcggaatagagattgaaacaagggtgaatgccgacagcgtgccgatgttcaccatgtcggcaaggatactgacgttgcagctggctgcgatgagtgccatgaccacgccgacggcaatctgcagacgtgctggagtgccatgcttgcccgtgtgactgagcgagcgcggcagcaggccatctcggctcatggcgaacaccacgcgggtcaggccgagcagcagcaccataaccacggttgccaggccgatcacaatgccgaaactgatgattttggcggcccagtcagcaccgaccatttcgaatgccgtggcgagcgacgggtctttctgcttggcgaggtctttgtaggagaccatgccggtggtgacgatggcgacgagggtgtaaagcacgatgatcagtcccatgcccacgcctatacccagcggaacgttcttcttcggattgacggtttcttcggaagtggtggcgaccacatcgaagccgaggaacgcgaagaacacgagcgcggctccggagatgatgccggcaatgccgtaaatgctgggggtcatgccggtggtccactgccataatggctgttccatggttgcggccaacccggatccggtggcggtcgccggttcgctcggtggaatgaatggggtgaagttctcggctttgacgtagaagaatccgacgattaccacgaatagcacgatggcgattttcagcatggtaagcgcgccgtcgacccgtgcgccgattttcgtgccgcacaccagcagtgccgtgaagaaagctacgacgatgattggcgcgaaatcgaaattgaatgatccgatggtgacgttggtattgatattccatccgacaagtcggaagaaatcgttgagatagacgccccaatatttggagacgacggagcctgccatcagcatttcaaggatcaaatcccagccgatcacccacgcgacgatctcaccgacggtggtgtaggtgaaggtgtaggcggatcccgcaaccggaatcatggacgcgaattcggcgtagcacattacggccgcaccgcataccacgccggcgatgaggaaactgatgatcacggccggacccgcatggaaggctgccgcctgcgcgccgatggaaaagatacccgcgccgacggccacggccacgcccataatggccaaatcccaccaggtcaggtctcgtttcagggagcgccccgactcctctgtttccgccagcgtctgctcgacggatttcttacgtaatacgttcattgcgtttcccttctcccttcgttcttacgtttacttaaggctcatgccgatgacgaccggttcgggaacgagacgaatgccgaatgcccgttcaacgccatcctgcacggttttggcaagttccgcgatatctgcagctgtggctccgccgcggttggtcaatgccagcgtatgcatggtcgaaagccccgctgcggcatttccgctggttttgtagcccttatggaatcccgcatgatcgataagccatgccgcggatgttttgacgcccggcgtgccatccggcaaggtcgcgtcgaatcgtggcgcgtcttcgggaagctttgccgcttgttctttggtgagaatcggattcatgaagaagctgccgcagctgtggcgattgtagtcgggttcatcgttgcctgtctgcgtgcgctgtgcgtcatgcgcgatggcgaccagttcgctctttttggtgcctcgcatggcttcggtcagatatcgatgggaatcttcaagcatgcctttggaggcgcgtactttcaacacggcgttgcgaatatccgcggtcgccatacggtcgcccacttccacgcccaatgctttggcgagctggccgtagccaactacgccggtttcgctgtgatgcagcgcgaaagtaacggacaacaccacgtagcgcggtgtcgggaagaagtcggccgcaggcgttgccggagcgctgtacatgctcgctttgagcgcgctcatgcgatagccgaaatgaagttcctgattggtgagctccttggtctgcttgtttttgcgatcccagacctccacgctttcgacgctggatgcgacttcctggccgtatgcgccgatattctgcacgaccgacgcgccgacagtgcctggaatgccggagagtccttccacgccctccaagccgaggttgacgcagtagtcgacgaaatcatcccaattgcaacccgcttcggcgttgacatgcacgattgtttcgccgttttcgacgggagccgcctcatcaagcacgcttacggcgtgtcgcgcgtcacgcaccacgacaccatcgaacggcgtgtcggccacgagcatattggatccgccgccgatcacgcacagcggcaatcctttggcgtcggcatcctcgacggcttcgataacgccgacacgcgaggtcggttcgataaaggatgcgattggtccacctacggcgatggtcgtgagatctgcgaaattggtcatgatgtttagcttagcgtgcggggaaggcagttggaaaggtgtcaagaaaaggttgaaagaaaacaaaaaacccgaccatattggtcgggtttcataaagctttgaactcgctcagcgggtctcgcgatgcacggtctgcttgccgcagcgggagcagaacttcttcagctcaagacgatccggcgtgttacggcggttcttcgtcgtgatgtagttacgctccttgcactcggtgcatgccagcgtgatgcccggacgaatgtcggcgctcttgcttgccatttaagttcacctcttgtggttcgttgctatgccgacgttccgtcgacctttgtagcgagaaagagactcgaactcttgaccttacgattatgagtcgtacgctctagccagctgagctatcccgccatgagagcctcgagtgagaatcggactcacgacctcttccttaccaaggaagtgctctaccactgagctatcgaggcgtggcggatagtggattcgaaccactgaagcacgaggcgactgatttacagtcagttccctttgaccgcttgggaaatccgccgtgctgcctgtttggttgaaccccaaccggcaacccgtttagtatgccacagatcatgcgattaacgcaaatacggcgtgtcgcggaagccaaaaagtctcaaaatcgttgaaattccaacgatttctcactatcagccacatgtcggtgtcaatcggagcaaatcctcccgaaaaaaattccaaaaagaaaaaacacgagtatttcttccgaaccttccctgcagaccatctgaacagcacgccaacgccaatgaacacggcatacatcggctgcgcacggcctattgcaggaaccccaagtgcttgaaatcaacaagaccccgccaacgcaacgattgttcaccaatcgttcgctgacggggtcttcaaacagctacgcgctacgctcagccgagaatggccagaatatcgcgggcggagacgatcaggtaatcctcaccctgatagtgcacctcggtgccgccatacttggagtacagcaccttgtcgccgaccttgacgtcgaccggaatgcgctcgccggcgtcgttgcgacggcccggaccgacagccaggacttcaccctgctgcggcttctccttggcattgtccggaatgaacagaccggatgcggtctgggtttcagcttccgcctgcttgacgatgatcttgtcttccaacggtgtgagtgagatcgacactgtggacctcctcttttctaagagaaatcgttacttaccgcgccgggacccgctagcaagaggctgacgatcacttacggcgtcgtcctttcgcgctgaaacatatcctagcgcgattattagcactctgccaactcgagtgctaacgctgagagcaaaatatacgaaaaagcctgaaaccatgcggtttcaggctgatgttctttacgcttgttcgtatgtttcgtgcgtttcgtgcgttcgctttccctccgtcacgccccgcgacgggccatgatggacgccaaacccacacccagggaatcggaggtgacgctgggagcctcaacgtcggcgctgacctcggagtcgtggaatcccacggtatccacgtcctgcagatgcacaccagcctccacacgggctgcggcctcgtcggaatccatgctgctgatcgcgtcggtcggcacaatcaacggctcgacattgtcggaaaccgtactcgcagtcggaggcacggccttggcgacctgacgagtggacttgatttccatgctttccggagcggctggcgcgatatcgttaccgttgcgtggcgatcccaacgagaacgaaatcagatcctgcgacgcgccggccacggcggacgaatccgcatcgcatgcatccacaccctcggttttggcgatttcatcacgctcatcgtggatggacagaccgttcttcttatccggcacgacttgcgcatctacaacgttcggttccgcagcggatttcgcttcggtttcccccttgcgtttgcttacaacaacatcacggtcggccttgccgcgatcgatcgcctgacggatctcaccttccggcataacatcggtcggcacctgagattcggcgatcctgcgaatttccgcaagctcctgctcccgcaaacgagcgcgctccgcctgctcttcctgggcgcgcttgcgctctgccgcagcacgcttcctcatcttggaacgatacttggcgactttccgctcccacgctgcggcctgcttggcggccctcacccccaaagcgagcactccagcaagcagcgacgcaggaatcaaagcaaacaacggactgaaatgcaacacaaacgcacacattaacacgacgattgtgatcaccagcatcgagacaacaataatccgccttctgcggatcgcggcacgacgaagggcacggacatgcgcgatcctttcgtcggtcagcttgccctcatgcgtctcgttggactgcattattgcccctttcgcctttgcggcggtctcatcggagaatcgcgttccactgtcggcatccaccagatgcagcgacggcgaaaagcggtcctctcggtgctcgattacccgcttcatgcctttgaccgtccgtttgggcagccagaaaaccatgagaataatcacaatcgcaagcaccacaaccgtgcttaacgattcataacccataactcataagaataggtgacattccgacattctccggggtgcacgcccccgcgtgtcgaacatgtgcgcgaaagcgcgtgtcgaacctcgccaacggctcactcgcccatcaaccgtgcggtaaagccattcggtgcgtactccggcagcaacgcatacgattcatggtcacgccattgcccgttcacgaacatgtacgccttgcgcatcccctcataggatgcccccactttgagtgccaccttacgtgaacgttcgttttcgggaagcaagtcgatctccacacgatgcaattgcggcccggaagggtcgaacatcgcccaatcagccaatagcgtaacagccatcggcgcatatccacgccccgcacaccgctcatcgacccaatagccaaccacgccggtacgcatggcgccatagcagatggcccctaacgaaatctggccgacgatacgcccatgatgctcgatggcgaacaccactccggtgccgtttcgctcgttgcgtcgcatcgcacgcacccactcgttgaacgacatcgacgcgccatacaccggatccccggattcccaaggcttcaaccaatcgtcgttgcgccagcggacttcgttccattcgtcgcagtcgtcagtagtcagcggacgcaggattatgggaacgtgaagcccatgtgcctgaatgaaccgcggaacatcaatggcattgggatccgaacgcatcatgccccgtaaagatcgcaaaatcgtcacgccctcattctgccatacgcataacatttccgattgcgcgcaaccatcccgtggtacaacatgcggtatgaccacgaacatgcaagccgacgtcatggaaaacagcgtctgtgacgaagccgcgaaccaacgtgagctgaaaaagcaatggcgcgcacacgcaatcgcacgaagaaagcagaccagtaaggaggaacgactggaagccggccgtaagttggccgaacaggcgcggaaggcgaatctcattcattcgttcaccacggtggccgcattcgcgtccatgggcagcgaaatgtcgatgatgccgatgctgcaggcattattcgattcgaattgccacgtgctggtgccacggctcggatccggcatggatattggctggagcgaacttggcgacattcacgatctgcaggaccagaccaacagcgacgggtccatcaatacgcaccgcccgcaagagccgggcaatagcgcaaacggacctgaagcgctgaaaaacgccggtctgatcattgttcccgcccttgccgtcgaccaagagggattccgtctgggacgtggcggagggtggtatgaccgcgcgctcgagtatcgtgcggccggtgcacgggtggtggcggtttgctggccgtgggagccgacggacaagcctgttccgcacgaagaccacgatattcccgtcgatggcgtgctcactccgaacggatttacggccatacgcgaataagacgtccgaagataagacgttcacgcagccgtctcagggaacgtactaggatatgtcccgttaagaaatttgagaacctggttgaagcgaggatactttgcctacttaccattaccgttgcaagaactgcaactacgatttcaccgaacagcagtcattcaccgacgatccgatcaccgtttgcccggaatgcggcgaagagcaggtccgcaaggtgtattccgccccgccgatcgaattcaagggatctggtttctatcgcaccgacaagtccaagtgagcgaaaacgaatacacgtaaccgagcagccgaagcaaggaaacgagtcaaataaccagggtcagcaaaccttggaaaacaaggcgacacgccgaatcctgtggataactcgcatcctccgaccacaaccctcgatccggcttgcgcagcaactattcgtaaggtcatcatgcatgaatggtgaccttttttcatgaccttagccaacgtctgcaaggcacggacggcaaacacacgaaccgcgcaccgtcttcggcgcctcatcgacgacgacgaaacgcgcaattgcatcgtctacttgcttcgctgtgcgccggacttgccatattcgcggccctgcagtgcgtgcgattgacgatttccacgcaatccgtcgtcattgcggcgaagtccatcgccaaaggcggcgtgatttccgcggattcgcttgctttgcgagatattccatacgatgaggccctgcgcagcgttgctcacgatatcgatgatgccgtcgggctgattgcccaagtggatattgcggaaggcagcatcgtcacctcggccatggctcgcgcctcccccgttgttcccaaaggatatacggcggtcgaagttcggttggcgagttccgccgacagtctgacgattggcgatacggtgacgctttccagcgccacgatgttcagcgaggccacgccggaaacggtaccggatatggatgcggtgtcgttacgtgagctgtgcacgggagcgatattgaccgcgaaaccttcacggaatgcggacggcgacacgcttgcggtgtttgccatgccccctcatgaggcggcaaccgtattgcaggcccaagaatacagcgcgatcatcgccatcgtcagttcgtaacggcattcccaagcgaatccgcagcaccatcatgcggaatatatgaaattcggaaggtctgaacgtatcagaacctcccgtatagcagacgaacgtcagcgctcccgctcggagaacacgccccaatgcggtggcaactcgcccagaatacgcttgtcgtcgtcagcattgcgctggcgttcggtaagcacatcggacggttcaagcttgacgccatcggcatcgaacagttccgtaccctgccgaaccacacgcttgtgtttgcgcgccgtacggcgggtggcggagtatccggacaccacacgcacggcaggctggtcagattccgcggactcttggatggagggttcgtcgacgctcacttgacctcctgatacaggtcgctcaagcgtgccacgatgcgatccacttccttgtctggattcacgaacgcgccaacgctccacacggtcataacggaccagccaagcgattcgatgttctgcaaaagcacgcggtggcgttccctggtggactgcaatcccatgaactgcgcatcgtcggtaagcacggccaatgcgaacggcttgtcgttcaggccaaccaccagcggcagcttggaaccattgtcgaaaccgtagtcgacggccacattcaaaccgcgggcacgaatacggtcggcaagatcgttgagcaatacgttcgaaccgttcgtcttgacgactggacgcaccacgctgtcatcgagctgttccgcccagcgaagcaccgttttcagcatcttcggaccagcttggtgcaggcgctcgtcatccatgtcagctgacgagaatgcggacacgatgtcaagatgacgatccggcacggccaacgcatccagcaacataccccgtccgccttcggattccaacgctccaaactgttgcagcagccttccatgagaagtcttcgcgtagcacatcgcaagaatcgcatcggtggcatgcgcgccggccacatcggaaatgtccacgatgcgcacatgacgcaagaacatgcccatggccttgttcttattggcgatcgccttaagctcggctcccagtcgggtgcggaacgtatgggtcagcgtcaccacggtaagcatgtacgatgcaggcacgatcgtgaaaccggcggcacgcttggtgatcagcctgaccacctcgtcgatttcctgctggctgctttccaccagtccggacgtgatgaccggcacgccattggcatcggccacaaaatggtaggcgacctcgccctgcgcgccttccctggccacgtcgaagggcacggaaccgtagccttccgattccaggaacgcgttgagcttcggtgcgcggcgaacaggacgattggcgattttcacgctcggcagcaatgcgatgagacgcttcagaccgtcggaagtgacggtttcgcgatgcgcgatcaccaccacctgcttggctcggctgatgatgctgagcagttcgatggattgaatatgcgctgcggcatcgatgatcacgacgtcggccaatggcgccggatcggtgatggccgcaagcgtggcaggagtcgcaacgagaataggcttcgccgcggcgagaatctgcggatgctccttatgcaggcagttcagcgaaacattacgggcgccggcaagcgtggtatgcagcagattggcctcctgcgtacgcgagaacagcatgtcgcacagacggcgcatggattcctgcgccaccatcggaccgaccgaacgcacatgttccacatcgacctgggcgaaccgctccgcagcgccctgcaatgccgacccatcctgattggaaatgatcgcggaggatttcacgatgtcttcgaacgccgtggtccaccatgccagctgcagttcccctgcaacggcatcgttggcaacgccacgattgttcagatcttcgaccagctcgtcgaggccgaccgaatggaattcacgttccagacgggcgcgctcaggcagaatatcaagcgactgcttatcgtcatacagggccttcaaacgctcttcgacctgattgaaatcaacggtttcaagattgccgccctgcggagttgtggcaagcaccgcattcaacgcggtcatatcccgattgagattctcctgcgtttcgataatgtcatccagcttggcgggcaataccggccagccgccatgaggcacgaacatatgccactgatcggcctgcttggacaccaccagcaacgcctcatgcaggttctccacttgggcaccgacgcgcagcaaacccttggcttccttgatgtggcggcgacgctcccaaaagcccatggacgtaccttcggccttgcgctcggccttcggcttggtcgcctcgatcatggatgcaatgtcacgttcgaaaatctccggctggaatacgtcaagcacacggcgcaggttcttcagcaccatgacctgacggctccactcctgcgcggtcgtgggaatcgggaatccgcaggtctgtaccgtactggccacctgctcgcgggtggcgggcaacaccttgcgcaacagctcaaccacacgctggtatgcgctcaccgcctcctcttcggaatacagcgatgccttataccatgcggtgtcgttctccgtaatggtgtattcgccaagctcgcccgcacgctgcagtttcgcagcccaatcctcgatcttgtccgcgatggaatgcgcggtctgcttgttcaaacgcacatgcgtggtcggatgggtgggcaatgccgcaatctgcgcgagattctgaatcgtctggtaggcggatacaccccactcctgactcacgccgtgaagatcgcccagataacgggtcaaacgcgaacgcacgccaaccagctcatcggcaatctgatcaaaacgggaggaagcaacccccgattggaagccgacggctgcaatcagctgacggtcaatcgcagcgttggcaccatcatcggcgatatccagcagctgtccgctcatttcgtttgcggcaacggcctgtacaaaacgacgcttctgatcggtcacacacggcacatagagcacagaccgtccgttcatcacgcaacgcgacgcaatcgccgcggcctgctcggcggtattgttggcgatcgcactatccacaaacagcgaatggcccgcggaagcaagctgcgaggcgtatcggacggtattgtccgcatcgccgacctcatactcgccatgaggatcggcatcaaacggactgtactccggaatttcggcaccttccaacgcttcggcggcggacttgtctcccgccaaagcgtccaaggcggtattgccggtcggaccttgcgccaactggtcgatgatcttccggctttccaccagcatctgcgatgccggatccataaagcatccgagaataatgtgccgttcgatctcaaaatcagggaacgcgttggccgcaaggcgtgtgatggcagcgaacaccgcggatgtttccggcgtgccgctttcgtaattcgaaccgtcgaacagcttggactcgtccaatacgacgttgttctcgcgcagcacggcggcgaaagccgcattcaagcgtacgcgccctgtgaacgcgatcaccgtaccgttttcaatattgcgtccttctttgcgcacctcaaccggatacatgagtaccggcatctggttgcctttccagatggccacgccaaccaccaaagacagttcgcccacgccgctgacacggcttttcgcctcacgatcgtcgagcacacgctccacacgacgcccggcggcacgcaacatgccgttgtcgcggaacaaggaatcaagttgcacatgcccgctggcgaacagctgcgcgatgccggacggatgcgcatgcgtcatgtcaagctgggcgctcagctgcgtcacgtcctcaagcggcgacggcgatagaccaagacggtacttctcacgccacccccgaatacgatccagcgcggtgacggtctcgttgctttcgctcatgtattgactcacttccctaccgctttgcggtattccgcataccccggattatgtgacagggccgcgtcgatgtctgcattgcccaaagctcccagccatgcgtacaaatcgtcgtacagcgacgggttcatggcaaggaacggcagcagctccggatgacgtgccatctcgaactgcacggtgaaatcgtcggtgcgtttggcatcatccgacgtcagtccgtcgacttcaatggtctgttcctgcttggcaagctctcccttggcgactcgatcgaacaccgatccgggttcaaaagccggtttgaatacgctggtttcgtccggtgtcggctcgctcacaatctgtggctgctccgtgttatgcggcctgaaacgctcgtcgtcggcccgttgcgccgcttcttccggttgaatcggattggtaccggattgttctgcaatttcattgcgctgctcgtgcgttttttccgcttgttgttcaggcatgtcgctgctatccggcaatgccacgataatcggcttgcttggtcttgcgctgaatagtttgctcacgggaatcgtgtcgtgttcgacgtcgttgcctgcgatggcttgcgtccgcgattgggattcgggcagcatagccggcttttccttttcggcggcgttcttcttggccccttcttccgccgcctgctgttccgccacggcatctgcctcggctgcggcgtcggcgaagaggtcacgtggcgcgttatccacgacgtcgttatgctgcaccagcgaaacggatgggagatccccataatccggctcgttggatcgaactggcgcgaaagactgacgttcggagcgttgcatgagattcacacgattgacgacgttgcgcgcgttgaacaatgcggtcggctctccggcacgcagattgagaatgtcgtcgaccgacatatcggcggcgtcgggctcctgcgacgcctcatcggacactgcataagagaacagattagataccggagctgacgtggtactctcggattcgggcatggcgctcacgctgtcacgttcaaaagtgacgcgtacgtcgccgaattgcaaggtcattggcgtggatggcagtttgaaatcctcatccgcgggcagacgcatcaattggccgttgtcggccactacaaacgaaccattggtcgacttgagatcacgtacggaagcgttgccctgcgcgtcgactgaaacaatggcatgccgtttcgacatggatttgttcgtatccataatgtcaaggcgcgcgaatccgtcatccgccagaggacgtaacggcttgcggccgatttccacgctttcgccgctgcccagcttcttcagttcgtttccatcaaccttgacggtccactgctgtgccgttcgttgatcttcgctcaccgttgtcggccttcctttcacacataccactacttgtcattgtgtcatgccttgccacgtatttcaggattatgacgcgattaattgacaactttcgcctaattcccccattgtatggcacgatatggaagcattcatgcctaaatcggattttattggatcgtcagcgaaagaaaatcccgcaatatgcggaaaaccccgccgccttgtggcgaacggggtttccactcaagattgtgatatgcggcttcaagccgcgcgaatcacttgagctcgacggtagcgccggcttcttcgagctgggacttagccttctcagcgtcttccttcttggccttctccaggacagccttcggagcgccgtcgaccagagccttggcctcagccagacccagggaggtgatagcgcggacggccttgatgacctggatcttcttgtcgccaacggcggagaggatgacgtcgaactcgtccttctcttcctcagccggagcagcagcgcccggagcggcaacggcgacagcagccggagcggcagcctcgacgtcgaacttctcttcgaaagccttgacgaactcggagagctcaaccagggtcatctcaccgaaagcttcgagcagctcatcgttggtgtacttagccataatggcttcctttcattcttggcgacggtttgattgaagaggtgaccgtcacctaaaacaattatttttcttttatggtcactatcattcacgcggctaaccgcaatgaaatcaggcagccttttcctgcttctcgcggagcgcatcgatcgtacgcacggccttggtcggcagagcgttgaacaggtacgcggccttggacatcgtagccttgatgtcgccggcgaactcggcgagcagctgcgggcgagacttgaggtctgccagcttctgggcaccttcagcatcgtagacggtgccatcagcgaagccgcccttgatgatcagtgccttattggtcttggcgaagtcacgcagggtcttcgcagcttcgatgaagtcacccttcacgaaggtcacagcggtcggaccggcgaggatctcatcgagaccttcgatgccagcttccttggctgcgatgcgaatcagcgtgttcttagccacagtgtaggaagtatcgcggcctagcttttcgcgcagttcagagatctgcggaacggtaagcccgcggtactcggtcaggtagatagcgtcagcttcacggaacttatccgtaagctgggcgaccaccgcttccttttcgggcctcttcatggcgttccttccttagtcaaccattgactgtgaagcaggaacgtttcgccggacaataaaaaagccctgcacgcaggcagagcaacattcgaccgctaagcggaaagcccttggtgggcgtatgttcttcaacctgcgttggcttggcgaaccaaacttcgtgagcgcttgcacgctccaaccaacggtctgtggtttacaggtgaacaacttacggccatgcttggacttgccgtcatccgggcgtgtcgcgctttacgaaatcttcatgactcactcaagtgttacggttaagccttgttcggaatcccacgattccacaaggcgagtcgcaattctcgccggaacgcgccgcccaatagtcggaacgttcctaccaacccaagagaaatagagatagggaaaaatggaaaagttcttccatcttaaggagaacggcaccaccgtgtccactgaggtcatggccggtctgaccacgttcttcgcaatgtcgtacatcatcatcgtcaacccacagatactgtcgcaaacgggaatgccgtggggcggcgtgttccttgcaaccatcatcgcagccatcgcgggcacgctcgtcatgggcttgttcgccaacgttccgtatgctcaggccgccggcatgggcctcaacgcattcttcacctacaccgtttgcttcggcctcggcttcacctggcagcagaccctgtgcatggtgttcctgtgtggcctgatcaacattctcatcaccgtcaccaagattcgtaagatcatcatccaagccattccggaagtgctgcagaacgccatcggcggcggcatcggcctgttcgtggcctacgtcggcttcctgaacgtcggcttcttcaccttcaccaccaaggccgacgccaagaacggcgacaccgtgcaggccaccccaggtctggccgtcatgaataatccgaccatctggctgttcatcatcggcctgttcctcgccatcatcctcaccgtgctcaaggtgcgcggcggcatgctgatcgccatcgcggtcaccgccatcgccggcattccgatgggtcagaccaccatggccaactccatctccatcggcgacactttcgcccagctgccgcagacctttggcgctatcttcagcgccgaaggcttcccatcgctgttctccgacatgtcgaagctgccgatcattctgctgacgatcttcgcattctccatgtccgacaccttcgacaccatcggcacgttcatcggcaccggccgccgcaccggcatcttctccgcggaagacgaggaagccctcgaaaacggttccggcttctcctccaagatggacaaggccctgttcgccgattcgatcgcaacttccatcggcgccatctgcggcacctccaacaccaccacgtatgtggaatcctccgcaggtatcgccgctggcggccgcaccggcctgacctccgtggtcgtggccatctgcttcgccctgtccgccttcctctccccggtcatctccgccattccgtccgccgcaaccgcaggcgtgctcgtggtggtgggctgcatgatggcgtcctcgctgaaggaaatcgactggggcgatatctccgaggccgtgccggcgttcttcgcttccgtattcatggcgttcagctactccatctcctacggcatcgccggcggcttcatcacctactgcctgatcaagacctgcaagggcaaggccaaggaagtgcacccggtgatctgggttgtgtcgctgctgttcattctggacttcatcatcaccgcgatcctgtagttctgaacgtcaggttcaacctgaccaccagccgaaattactggttcagtaaataaatttaaattcggcaaatggaataggggcgattccgctctcactgcggagtcgcccctattgttgtatcgcttgttttcgtactgctttttagtgaaccgtcttatgcgatggctttcgagaaggcgtcaaccagactttccatccaggccgtcaaggaatcgtattgttccggcatctgttcggtcagttcaaccatgggcacgtttgcggatttcgcggcattcgtgattttgcccgtcagctcgctttcctcctgcgtattgacgatcaacagtttgatttcacctgatttcaatgcgtcggcgaactgcctgatatccgttggcgtcggctcgctttcgttcgctgtggctcgcgcgtacccgcttggcgttgcgtcggtcaaacccatgtcttccgccagatagcttgccacggattccgttgccgcgtacgccaatccatccgatttctgtttcacttcggcgattttgctttcgacgttgttttcttcagatttccactgatcgtgcagcttgtcgaaatcactctttttcgcggcgtcggcctgttcgtacgcttcggtgatcgcctgtgccactgccttgcgcacatcggcggagaaccaaacatgcggattttcgccgtcattcaccccgccgactgcagcggcattgacgatggttgcgttggcggattgcgccgctttgaccgcccatgcgtcgtagccggctccattgacgatgatgacttgcgctttctgcagtttggcgatatccgacgtcgttggctcgtaatcatgcgcatccacattggtggaattgatgatgctggttacgttgacgttgccaccgcccaaggttttcgccacggtaccccactgattcacggaagcgaccacttcgatggttccgtttttttcggacgacgatcggccgcttccacacgcagcaaccgacgcaagcattcctacagaagcaagtgcggcaatcgcaattctcacaatacggtacatgatagatcctccctaacgtgatataacaccatcataacttaattgagaatcattatcaatagagcgtgtcgcgatcaggtatcacatacaaaaaactcccgctcaggggaatggccgccacgaatgggatcgaaatggttagcgaagcaaccactttcgaccgcacatccgtgcgacaatcccccgcaagcgggagtaagagatgatttgccgatcagccgcgtgcaattaaggagcttcgcaaagcgaaacataatttgctggctcgctaaagctcgcttgcgttgacccactgggccaacgctacgctttggcggatcggctttgccgatcagccaaagcgtcccgatacgtagcgctcggcttcttcgttctgggggttgttgaacatggtggtcgtgtcggtgaagtactcgaggtgacccggctggccgactgccttcaggttgaagaacgcggtgtagtcggcgatacgggcggcctgctgcatgttgtgcgtcacgatcacgatggtgtagtcgttcttgagctcgttgatcagatcctcgacagccaacgtcgaaatcgggtcaagagcggagcacggctcgtccatcagcagcacctgcgggtgcacggccacagcgcgggcgatgcacagacgctgctgctgaccaccggaaagaccaatgccaggattgtcaagacgatccttgacttcgttccacaggttggcgccacgcagagcccattcgaccagatcgtccgcatcggacttcgagatcttgcggttgttgagcctcacgccagcgagcacattctcgcggatggacatggtcgggaacgggttcgcacgctggaacaccatgccgacatcgcgacgcacggcaaccgggtcgatgtccttgtcgtacaggttcttgccttccagcaacacctcgccttcgcagtgagcgcccggaatgatctcgtgcatgcggtcgagcgtgcgcagcaccgtggacttgccacagccggaaggtccgatgaaagcggtgaccttgttggcttcgatgttgatgttcacatcttcaacggccaggaagtcgccgtagtagatgttcagatgattgacatcaatacgttgtcccattttggttccttatatgttgtttctgtatgtaagactaccgctcatcgttccgacttgacggcgaagaccttcgccacgagtcgaccgataaggttgaggataagcacgatgaggatcagcacgagagccgcggcccatgcgcgttccatcgggatggtggtcacgcaggaagcgtcggcggaagccgggcaattcgcgttgagcttggagtactcctggtagacgtacaccggaagggtggtcatctggccggagaagaggttgacgttcgtggaggcgatgtagcctgcggtcatcagcaacggagcggtctcaccaatcacacgggcgacggcgagaatcgcacccgaaacaatgcccggcaaagcggtacgcaacacaatcttcgtaatcgtgcgctgcttggtaacacccaaagcatacgacgcttcacgcaagtcgtgaggcacgatcttcaacatttcttcagaggacttgaccacggtcggcagcatcagcagcgacagtgccacggaaccttcgaaaccgttgatggtgccaggtccaatcagaatcgtgaacatcgagaatgcgaacaaacctgcgacgatggacggaataccgctcatcacgtcgaccagcagggtgatgacgcgagccagcttgccacggttggaatattccaccaagtacacggcgcacatcagaccgatcggaatggagatgatcatggcgccgaacgtgatttccagcgtaccgatgatggcgtgctgaataccgccgtagccaccggacggcgtcggattgccgccgaccacaccggtcatgttatagctcaggaagttgaggttcagcctcttgacaccgttgacgatggtggtgagcagcaccgagaacagcggaatcagcgccacaatgaacgcaagagcgatcagtacgcgcatcgcaagatccttgcgcttacgtgcagcggtaaaggaacgcgtcggcttgaacttgtcgaaatcgatgacgggggcaccgtccatcggagaagcgttgttattcactgcggtcatcacgcactcgctttctcggtaagcttacgggcgatgaaattcaccacgaaagtaatgaggaacagcaccaggccggtgccgatcagcacggacacgccgagatcgttggcttcaggatactgcgcggcgatgttggctgcgatcgtctggttctgcgaagcctgcagcagcttgatggagtagttgagacctggagacaggatcatgagcacggccatggtttcgccaagcgcacgacccaagccaagcatggaagcggacaccacaccggacttgccgaacggcagcaccgcaagcttgaccatttcccacttggtggcgccaagagcaagcgcggcctcttcctgaaggcgcggagtctgcaggaagatatcgcgggacatggaggtgatgatcggcaggatcatgactgcgagcaccacggccacggtggcgacggtacgggaaggattggcggcaggacctgcgaacagcggaatccagccaagatacttggccacccaattccagaacgggtagatggcgggcaccagcaccaggccaccccacagaccgtagataacggacgggattgcggcgagcagatcgaccacatagctcaagacagtggcgagcttcttcggcgcgtagtgcgagatgaacagtgcgatgccgaccgacacgaagaaggaaatcaacagtgccagcgcggagatcaacacagtaccgaacagcagcggtccgacatagccccagaagctggaagccttgccgccggtgaagttgctgatggtgtcgctgttggcctgctgatcgccgccgatcaacggccatgcgcggaacagcaggaacagcgcgacggcggcgagcactacgaggatcaggatgccgcaggcgtaggccacgcccttgaacaccttatccgcgtttttgccgctcaccggctgctgtgccgttttgctttgcgaactcacgggttctccttaacttgcgattgtttgaaacagatctgcgattacttgcgatgactgcgttttttgttttacctgcaggtaccgtttcaggccgcacccgctttcatattgcggctgcggcctgaaacagacggtcagttgccgttcaccgagagcctatcgcttactgtatcaaagctcacttggtttcgatggcgtcgatggacttgaggaccttctggcgcatggtgtcggacagcggagcggagcctgctgcggaggcagcggtctgctggccttcgtcgctgaccacgtaggtgagccaggacttgacgaacttggcggtgtcggcatccttgtatgccgggcaggcgatgtcgtaggagacaagcacgatcgggtaggcgccagcctcggtggtgttgtggtcgagcttgacgaccacgcggttgtcgccagtggcggattcgtcgagcggggaagcgtccacaaccttggcagcggcttcagcggagaacggcacgtaatcgtcgccgaccttcactgcaacggtgccgagctcgccagcctgggaagcatcggcgtagccgatggtgccgtcagcctgctgcacggtggagatcacgccggaggtacccttagcgccctgaccaacctcgttcggccagttctcgccgagctcgtagctccaagcgtcgccagcagcatccttgacgtagctcaggaagttcttggtggtaccggacttgtcggagcggtgcaccacggtgatgtcgagatcaggcaggtcgaccttcgggttctgctgcttgatggcgtcatcgttccacttggtgatcttgccgtcgaagatcttggcgatggtgtcggcgtccatgttcagggtcttgcccttgccggaaatgccgttgaggttgaagaccacggcgatcggggagacgtagaccgggatgtcgaaggcgttgccggaagcgcacacgctcttggactgctcgacctcgtcattggacagggcggcatcggagccggcccatgcggtggcgccggtcagaaaggtggaaacgccagcgccggaaccagacgggttgtaggcgaccttggcatccgggttggtgccctggaagccggcgatccaggcttccacagcagtctgctgggaggaagcgccagcgccggagaagttgccggacacggcttcggtggtcttggtgtcggtgctagccgaagaatcagtgttggaagcagtgttgtcgccgcaagccgcgacagaagccagcatcacaatgccggacacagctgcaatggagcgtacgagaatggaattacgcattattcttttccctctgtcaacattctgatggcgtatgtttctgacatttcatatgctgttgtcgccatcgttcttcatgacactgtcaagcctattggtggtttgggtcccgcaaaaccaaaatcggtgaacggaagatgaacactctacgacacttcggacgttttcgtcatttccattcaccgatcttcggcgactaccgtgataccacggtctcacattcagttatcaattaataatcaattattcggaaacttacgatgagtactggaatcgcagtgttttatcttatatatttccatctatcgcgatatttccgctttattccgcaggaacgtcgattttgtagcccaaaccgcgcacggtggtcagatatttcggatgcgccggatcctcctcgattttggagcggacgcgcttgacgtgcacatccaacgttttggtgtcgccaacgtaatcggacccccaaatgcggtcgatcagctggtggcgggtcatcacacggcccttgttctgcatgagatattcgagaagctcgaattccttcagcgggaagaacacgttctctccgcgcaccatcacctcatgctggccgatcttcatggaaatgtcgccgcagatcagcggaatatcgtcatcggaggattccgtcgcgtcggccaccatctggttgcgtcgcagcaccgcacgcacccgcgccagcagctcgcggaacgagtacggcttggtgatgtagtcgtccgcgccgatttccaaaccgaccaccttgtcgatttccgcgcttttcgcggtgagcatgatgatcggtacacggctttgctcacgaattctgcgacatagcgcggtgccgtcaagccctggcagcatcagatcgagcaacaccagatcgatgccgcctttggtgaacagttccagcccttcctcgccggtggccgcggcggacacgtcgtagccttcgcgggtgagctggtagaccagcggctctcgatacgattcctcgtcctcgacgatcagaatacgtgtcatcagtgcttctcctctgtgctcttgttgattggaacgttgcttgttatttgctgtattcggtttagctcagattattcggattactcggattgcgtagtttcgatgcgttcggtttcgcccgtcacttccatgcgatccgcttccgcagtttgtacgtttcccgcagtctctgcagtttccgctgtttccaccgcttgtgcctgaggcagggtgatggtgaaggtcgatccctccccctcacgcgaccacacggcgatagtgcctccgcaatcctgcacgcaatgtttggtgatggccaaacccaatcctgtaccccctgtttcgcgggaacgtgcgggatcgacacggtagaatcgctcgaaaatacgatccagcgaggattccggaatgccgatgccctgatcgacgacacgaatcgcaacctcgtcatcgccactgccgatgccgactgcgacggtggtgtgttccggagaatagttgacggcgttttccaccagattcttcaccgccgttttgatggtttcatgatcggcgttgatgaacagatcatcctcatcgacagcgtttacggcaccctcgacgtgcaccagcttctgcttgccattcagcgaaagcaccagattgatatgcttcgattcggccttcacctggttttcgacgatcgcctcgcgtaccaacgcaagcacggaaagccgttccgcgttcagcaccgcagccgtgctttgcgccttctgcaagtcgatcaagcgatgcaccaattccgtcaatcgttcggattccttggaaatgcggcccgcaaaatacttcaccatgccgggatcgtccgcagcgtcgccgatcgtttcagcaagcagggaaatcgcaccggcaggagtcttcaattcgtgcgaaacgttcgtcacaaaatcgcgtcgcataatctcaaaacgacgctgctcgctcatatccgaaatgaaaatcgcaaaaagatcatcggagatctgaccgacccgcacatgcagatacagcgtgtcggaaggacggaacttacctgcctcaatgcctttgccgtcagtgtttttcgcggccgcacgggcggctcgatccagcggaatcgacaattcgcgttcgcgcaccacgctgtcggtcgacaccaatcgcagaatatcgcggatttcggcaagcgtcatcgcactgtcctcaacaatgccgaaacgttgcgcgcccggggaaacgtatgtgaccgacgccagtgaatcgacgacgatcaacgcctccggcatgacggcgatcagctggcgttccgtggactgcacgggcacgcgcggcccgaacagcgacatgttcttctgcgcgccgaacaggcttggatcgttcgggtcgatctcatcctcccccaattgcacgccacgggcacgccccagcaaaaaggcgaccacagcgacggcaacaaccacaatcgccatcaccacgtgctccagcgtcatacgttaaccttccgataatccgtcattcttcttcaacagtagcggttccggaaagcgatttccgtgcgcgattccctcacgccatcggaagtttccccgcagttcactttcgtgagattcaccataccgaaatatgagacggcccgtccagcaaccgatgcgttggacgggccgtctttcatgcgcttacatgcgcttgacgatgttcaccgcgattttcgccgcggtgtcggcatattcggaaatgtcgaattccttgaattccacgtaatccgtgtcggcattgtcgctcaacgcgcggatgaccagcacgggcaggccgttgcgcgccgcgacatgcgccaccgcggcgccttccatttcgaccgcgtccgcgccggtttcgcgaatcacctgctccactttcttcggatcgtccacgaaatagttgcccgtggcgatgatgccggtgatgtgatgcacgctcagatcggtcagcaccttatcggcgacttcgatcagacggtcgtcggagtggaattcctccaccggctggtccgcagtgcctggcttccactggccgacgagacgcatgtcggtgtcgaggtagcgcaacgtgccgccaagcaccacgtcgttgatgtgcagatgcgtgttgagattgcctgcgatgccggagaagatcacggcgtcaggctggtccgcgtcgatgagatgctgcgtggtggcggcgatattgacggtgcccatgccgccgaccgttgccgcaacgttgacgcgagtgcccttgttggtttcgatggtgccgcgtgtcacgctgacgccggcttcctccgttacggtgatgtcgctcaatgcggatgcgatattggcgacttcctcgtccatggcgccgatgatggcgattgtgctcatgcgttcgttcctttcgattgcttcacgcttttcgctcggtttcgcttattttcgcttcgctcacttccagcggcgcttgcccacagcttgcgcaagttcgcgcagcaacgcttccgtaatctgccagctcaagcatttgtcggtgatggattgaccgtacgtgagttcggcgagcggtgccggtttttgactgccaccttcgatgaagctttccatcatgatgccggtgatgccttcctcaccttcggcgatacggcttgcgatattacgtaccacttcgacttggcgatgttcgtctttgccggaattgccgtgcgagcagtccacgatcagaccgtgtgccgccgcggattcgaccggcatttcctcacggatgagcttcatggcattcgccacggattcggcgtcatagttcgggccgctgctcgaaccacgcaataccacatggcagtcgggattgccgagcgttttgactacggccgcacgacccatatgatcgatgccgaagaacgtatgctgctgtgccgacgcaaaacacgagtcggtcggcgctttgatggaaccgtcggtagcgtttttgaagccgatcggcatcgacatgcccgaagcgagctggcggtgcacctggctttccgtattgcgagcgccgatcgcaccccagctgaccgcgtcggaaatgtattgcgggctggttggttccaggaattccgtggcggtggccaaacctgcgtccaatacgccaagcagcgtacgacgggccaaaagcaggccttttttgatattgcagctgccgtcgatgtcgggatcgttgatcaagcctttccaaccgaccgtcgtacgcggtttttcgaaatacacgcgcatcacaatcagcaattctccgcccagctcgtctttcaacgcggccaagcgacgggcgtaatcgagtgcggcagccggatcatgcacggaacacggaccgacgatcaccagcaaacgatcgtcctggccgtacaggcaggcacgaatctcatcgcgtgaataggcgacgatctcttgcgcctgatcgctgagcggcaggtcccccaacacctgcgccggcgtgggaagcacctcgaattcaagcaccctgcggttcacgatgcggctgatgccgacctgatcttcccagcgtggcacatccgtagccaccagcggattctttccctcatccatggcctcgcggatggcgcgaagctcttcaggcgtgttcagctgctgctgcatttcactgctctccttgacaatcacctatctccccaagaatatcaatcaaatggcagtcgctatgcaaaaaccgtgcgattacgcagttacgcgtattccgcacggttagttatttgcgattatttgcgcttatttggcgagtgcgcgacggctttcgaccgcttcggcaagcgtgtgcagcaactgttcggtacgttcccacggcacgcaggcgtcggtgatggatttgccgtactcgagctggtcgagcggagcgggcttctgattgccggctttcaggaagctttccatcatgatgccgctgatgcccgactctcccgttgcgatacgggaggcgatgttttcgatcacttcggcttcgcgcacttcgtccttgccgcagttgccgtgcgccgcgtcgatgacaagaccgtgttcgctcgggccggacgccttggaaaccttcagatcggccaacgccttcgccacggattcggtatcgtagttcgggccgtgcgaggagccgcgcaacaccagatggcaatcgggattgcccttggtttcggcggaaatcacacgaccgtcaagattgatggacaggaaatgatgctcgaaggcggccgcgaagcaggaatccgctgccggcttgatcgaaccgtcggtggcgttcttgaagccgattggcatcgacatgcccgacgcgagctcgcgatgcacctggctttcggtgttgcgagcgccgatcgcaccccagctaatcaggtcgcagatgtactgcggggtgatcgggtcaagccattccgtggctgccgggagtccaaggctcagcacatcggccagcaccttgcgtgcgagccacatgcccttgcgaatattgaactggccgtcgagatcgggatcgttgatcagacccttccaaccgatggtggtgcgcggcttctcgaaatacacgcgcatcacaatgaccagttggtcttccagttcttttttgaccgcggcgagttttgccgcgtattcgtgcgccgctttcggatcatgaatcgagcatgggccgacgatggcaaacagacgatcgtctttgccgttgagcacatcgcggatttcctgacgggacttcaacaccagatcgctcatctcgtcggtgagtggaatttccttcagaaaatatcggggagccggaatcgggtccaactgtcgaatattgacatccacggtctccggaaacacggcgttatccaacaactgcgcatccttcgaactatctggaccgcgaagacctgacatctcttctgctcctccttatacctgcatacctgcttcatgcatactgtgcatggatgataatcaccgaagttaccttaacggataaaagtggcataacacgaatgccgactgcatgctggactttttgcgaagtcccatgcagtcggcattcgtcaatcggtttgtcggtttacgtatcagtcagccagagcgcccatcggatcccatgcggggagcatggtggctggctcgtcaagagcggcctgatattcggcagggagcagcgccttcggcacggcgacctcgtacacgtattcggtgaaccagtcgtcgctcatagtgaagtagcccttgtctgcgatcttgtcgccccaagagttctccacacgccaacgacgggtggtcgtgccgtcttcggccacgtccacgccgacgaacgccatagcgtggttcatcgcggaatcggcgaaacgcacgcgatcttccttgttcagatcgaagtcgacgccatacaccttgccgtattcaaacagatcagtagcccaagcgccgttttcacgatccatcatcgggtggcagtcagcaccgaaccatactggaatgccctgctcttcgagaatctgacgcacgcaatccttcatgaactggttcggcacgttcaggtattcggtcgggtctcccccggccacattacccaagtgctcgataccgatcttcttgcccttcgcatgctcctgacgaggatcgtcgaccaggcacacgtagctttccaaatcagcggaaccgacgtacttctgccagaattccacaggcgtgacctcaccatcgcggtggaactcgccgtccttgtcggtccactcccagtcgaagctcttcggcggctcgcccaagtgaatcgtcagaatgcggtgtccggcggcggtcgcttcggcgattaccgattcgatcgaagccggatcagcatacatgtgcgcgacggccgtatgcagcaggcgacgcaattgcacgttcatttcgccggtgttcttggaggattcggtttccgggaacagatccttcggaacggcaccgtacttcttgtacacgttcatggccatggtccactggccgccgtcgcccatcacgtcggcgagcagatgctggatcaggcgggagtcggacggctcgccggccttcaccagttcggccacgtcctgcaggaagtagttgacgcgctcgagcttgtcgtagtacatggcatagttctgggagaactcgaattccttcagccccatgttcttcttggccacgaaacgagccacgttcagcgagctgaacagccagcaacggccggaacgatcctgatgggtggcggtgccattgtcgacaatggtggagaatcggcgctgcatcaggcgggcgcggtcatagttgcgtgccaccttgttgatgccagccgcggtgaccgcgttcatggccatacggttgtggtcgctggcttcgaaatcctcaaccagcgttgccaatgcatcagcgctcaacggcgtgatgtcagtcattgttctgttcctcctgtgcttcttcgccctggtcagactgctcgtcttcggacggttcttcacaatcgtcattattctgctgttcgtcggagacaacatcctcgtcgaaggtcacttccggttcgcccgcaacagtttcgccactctcgtcgtgcgattccgccggagtttcagcttcagctgcggaatcatgctgttcgccgtcgatggaattgaccacggacaggccgttcgcgccgaaaccggagaacgcgttggcgaacatggcacgcagttcactgacacgctgcgtgatctgcgcctcacgggtctgcaggtcggcgatgcgctgctgcacaccttcaagctcgctcttggctgcctcacgacgctcgttgatctgctcgtcggcctcttcggtggcctgcttgagaatgctggcagcctgcttgtcggctgcctcacgcttgtcggaagcgtatgcctcggcctcatcgcgcgtatgctgcgcttctgaaatcagctcgtcggactgcttcttggcgatttcacggcgttcgttcaggtcggcgagcagctcgttgaccttcttcgtagcctcatcctgctgggcagaaatgtcggcgcggatctgctccacctcggcattgacctggctgatggtcttggtgcgatgcacttcggcctcgtcggtgatctcctgtgccttggctttggcggtatccgtgatttccgaggcacggcgctgcgcgtccgtcatcatcttggacacctgctcacgcacgtcggccagcttcttgttggcttcggccaacgcggattcgatctggtcgttggtctcgcttttcatgcggttgatctcgtcattggcgttcttgcgctgcgccgcgatctgctcggtggcttcggcgcgcagatcggagagctcgcgctcctgcgtggcgcgctccgatgcgagacgcttgtcgtgctcctcacgggagttcgtcaattccagatcgacggtctggcgctgcgccaccacggccttctgcgcttcgccacgcagctggtccgcttcgcgctgggcgttggacttcaacgtgtcggcatcattattggccttcgacagcaccgcttcggccttggcgttggcctcgtcgagaatacgcttggcgtcgagcttggcgttgttcagcagggtttcggcctgaagctgcaccgtggcgcgtgccgcggaagcgtctttcttggcacggtcgagcagctcggcgctggtctgttccgcgctggcgagcatctgctgcgcgttggcgcccagagatgcgaacgaattcgggttggccttcttgtttttctcttcctgcagctgtgcctgcagttcaaggatggtctgatcgtcggccttgacctgatcacgcagacggtccaccgtctcctgagccaaagcgaacgcctcatcgaccctttccttgtcgtaccccctcaacacgattgggaactgctcaaccatggtattcctttcacgaattcccttccatcgcgcatcttgcccgcgcctatccgttttgaactttagcgcagaacaaacgttcggcacacggcagtcgcataattctcacagagagcacagaaatcgttcgaggaaacgccgacgccgttcagccgagcagaatctcacttgaggatggctgcagataataacgcaccgattcgcggatcacatcgttacctgcggcgatttgctgcgcgattgacagtccatgttgcggatgtggctgctcgttgacgatcggcaggcttacgaaacccgacagaatgcgcttttcctgcgctgcagaccagtcgagcaaatggtagaacagcgaattgcagacgaacgtgcccgcatccgaactcaacgcggcgggaatctcatgtttggcgaaatcgcgcagaatcgaacgcaacggcaggcgcgtccaatatgccgcaggcccttccggattgatcggacggcgaggcggaatcacattgtcggcgtcaggcttggccgcgtccatcagattcgtggcgcatcgctccaacagcacgccgcgggccgaacgcttcaaaccggtggcgatgacaatatcgggattcgcctgttcgatggcgttcagcaacatgggccaggcattggcgaaactgaccggaagcgtcaccgtcgtcacgctcatggaaacatcctgcagaagatcgtcggacagcgccacggattgagatggatcattccaatattcggcgagcgccacgggaacaagtacggccggattcacgtcgatgccgtcgtacggggtgaaacctgagatgacgatgttgatctgctgcatgtgttccagtgtacgtggttgaaaggtgggttcgtttacgatcagtgcttatgcatttgcgagaatgcttcggcgaacaccgcgtgcatgcgcgctttcgcttcttgtttggcatgttccgggtcgaggctgcgcgcgatgttctcggcgatcggcatgtcggcctgtgtggtgattttgagattcgtttcggatccggcgacgatggcgaccggctcgttcggcagatagtccaccaccacgcgggtgtcgtcggttgggtggaagtcgggatcggcggtggcgagctcgtaggctttggtgatggtaccgaaacggaaggcctgcggggtttgcgcgcggaatgcgttcgtacgatcaggcacggagcgcaccaccttgcgctctccaagatcttcggtcagtagaatcgtgtcagtggacgcgtatgccacggtcgccgcgttgaactggtcgaggctgtcgatgcagccgtcgatggattgctgttcgacgaacggtcgcacggaatcgtggatgaggattttcgcgccatcgggaatgcctgcctgcttgagcagatcaagcgcggagcgggtgctgtccacacgctcggagccacccggaatcacggcacgcaccttggtataaccggcttcgtcgatgagcatgttcaccatattgctgacacgctcgttgaccacgacgatgatgtcgctcacgcgatcgttgcgttcgaacgcctcgatgctccagcagacgattggcttatcccccaccgaaaccaactgcttgggattgttctcatcgaatcgcgtgccgaaaccggccgccaacaccacggccacaaccggcatcttctgttcctgcatctgctctctctcactcatacgtcccaccgtaaacccccgaatcggtttgcagcgcgttttgccttacgttctgcacgcaatccgcaatagcgcgccgctctcccactattcgcgcacgatcagcgcaagcatacgaccttcgtgcgctttgcctgcgatggtggcacggcgatgcgagaaccagagcggattttccagcgtgcacaggctacggcggattttcttgaaacgttccgcgagctgcggttcgccttcgccatcggcctggcagatttccgccaattcctcgtcttcggaaagatactgggtggctgcgttgacgcgggcgcgggaggaaacgacgttatcagccggaacaccggctttggcaagctcctgcagcgcggcggccgcaatatcgatgcccggctggccgaaacggctcagcgtgaaggttccagggaactgcgcgtcgaattcgtcggcaatgtctccgcccacctcgtagcagtcgccgcagatgcacgggcccagcgtggcgacaatacgctccggcctggctcccttggacaccatcttttcgatggtggcgccgatcacaccgttctgcaggccacgacggccgcaatgcgcggcgccgatcacgccagcttccggatcggccatgagcaccggcaggcagtcggccgcaaacatgccgagcgccacgttcttctgagcggtcacctggccgtccgcttcaaccactgccggctcatccgcggtttcgcccacctgctgagcggtttcgcccttgccgccagacacgtcgaaaccgaacggacggttcatgacgaacaattcgtccacatcgacggcaacgccggaatgcacctggctgaccaagctcagcttcgcgtcgatggcgttggagagcgccacacgattggcgagcacatggttcggatcatcgccggacttgcctccgagattgcagtgcgcataatcgccttcgctggtgccaccaagtcgcgtggtgtacacgactttgacgcccggcgcaagcatgatcggaatggtcaccgggattggattgccgtccacgtcggtcgggtcgatcgcattgctgtcaagaatcgcgtcgtcatactgcttgtcagtcatttttttgttttccttgattgttctacgattatttcaacttatttctgctgattttctgcgtctgcacgatgtttttcgcaattattccgctttgagcgtcggctttttggtacgagatcggatggctgcgttcacgggcacttcctgcgggcatggcatggagaagacatgcgccggattgttgatggattcgacccaatgtccgtcggcgtcacggaatccgcctgcgggaacggtgtaggcgagcggcgccgcgcccggtagcacgaattcgacttcctgaccggcttcgattttgttgcggctcataatggtcacacggccgccgtcttcttcgctccacgagagcacttcgccaaccaccagccaagcgcggaaatacgcggaacggtcggtgctttgctgcactttgtgttccggatagtagaagccggtggaatagtcgcggtgcgccaccttgtctggctcgtccagcaaccagtcaggcagggacacgtgttccgccgggcgcactccggcgtgataccagccttccggcaggatttccgcagccgtgttcgacttacgcctcgtactacgcgcatggtagctcagatcatccggttcgccggcggaagcgactggaacggttgcaatatccggcttccccgcgaacgcgccatccgcatgttccataatcaaatcggtggtttccggcttgccgtaatccggatcagacgggcgaatcacacggtcatggaatggcttcagcacagtgccatcctcgtcttcaaaaccgcgttgcaccatgtatgcgtcaacggcggtcttgtaagcgttcgtcatcgccgcaatatagtaggcgctcttggaacgtccttcgattttcagactggtcgcacccgaatcaagcagatcgtcgatatgcgcaagcatgttcatatcctgcgaattgaacagatacgcgccttccttagtctgttctatcggaaaatactggccgggacgcttttcttcgacgatggaatacttccagcggcacggttgagcgcattcgccatgattgccgtcacgtccggtcagataattggagaacagacaacgaccggagaacgccatgcacatcgcgccatgcacgaagcattcgatgtcaagatcgtcgggaatgcgtgcgcgaatgtctcgcacggcctgcagatccatttcacgggcaagcaccacacgacgtgcacccaactggtagaaggcgttcgctgcctgatagttggtgactcccgcctgcgtgctcacatgcagttccaggttcggcgccacttcgcgagccatgagcatcacgccaatgtcggaaacgatcagtgcgtccacgccggtgtctttgagctggccgatgtattcgcgcatcgcttcgacttcattgttgcgcggcaacacattgcaggtcacatacacgcgagcgccacgctcatgcgcgtaacgggagccttcttcgaaatcctccaaactcaggtttttcggcgccgaacgcatgccgaacgccttacctccgcagtagacggcgtccgcaccgtaatcgacggcggttttcagtcctcgcagattgcccgcgggagccaatacttcaggcttgtttcttctttgcacgcttgttcctcttactcgatttttccgctctatattctcgactattcacgggacacttctgccgcatccgggaaatacatacgaggaaaaacacatgcggaaaaacaaaggcgtccatcgtggagacggacgccttgacgcaaaacgttgcgaatctgacactcagccgagtttggcgagttcctcttcggtgagttcgagctcgtcggccttgagggaatcgagaatggtttccggtcgatgggcgccgggaatcacgaacatgtggtcgcccttggccagctcccatgcgagcaccacacgctggtagctcacgccacgggcttcggccacctcgcggaacggatcgaacaggtgctcgtcgtacgggtgacggtagccgcccaacggactccagcacacgaacgccagaccctgctcggcgcaatagtcaagcgtatcttgggtgtccagatgaatcggagaatactggttctgcacggccacaagcttgtcgccgaggatctcctgcgcgatcttcaactgttcgatgctcacgttggaaacacccgcccactgggccacgccctgatcgagcagcgccttgatgccttcgcaggactcgttgtacggcacttccggatcatgacggtgcaggtacagcagatcgatgctgtcaacgccaagcgccatcgcggactgcttgccgtattcgatcagatgctccggcttgccgtcacgcggccaaaccggcttgtcaccctcccaagcgcggcgcaagcccaccttggtggccacggtgacttcctcacgcgggcccttccacgagtcaagcgcctcacgcaccagcttttcgccggtctgttcctcttcgcccggcgtgtagtacgcccaagcggtgtcgatgtgacggcatccggcatccaacgaggcgtgcaatgtttcgataccgacatcgtgaccacgattgttttcaatggtcaacggcatttcaccatggccgatggccgtggtgcggaacggtccaagattacggaacaaagccatcccgatctccttcaacaacgtacagagtgtctttccgaatgcaaccttaccagccgacccgcctcagcagacaacaaacccaccaaacatgcgcgtaatgccgcagatcagcgaccaccgaagctgccgccgccggaaccaccagaggaaccgccgaaaccaccgccggagaagctaccaccggaaccaccgtaactgctggacggagatgccgcggcaatcgtcgattgaatatcagcaaaacctgattccaactgcgcgccaatatcaccaaaattggcgctcggcgagaaatccatcgaattcgtatcacacgaagcaggaccggcgtaatgatgattgaaataccatgaacggtaactccagtagagcagcgaatcggaagcgttggcatcaagccaactcgggtcggcaagctgcgggtacgccttgagcagctgcttcatcgccttttcggaaatgccgaacgcggtggcgtacaccatgtagcgaccccacaacgtcagatcagccacaccacgatcacggaagtcgctgaaatcctccatataccgtttcaaaccgaccacctgaccggcaagacgctgaccattgtcgttaagccccttcaatttgaggtagctcagcgcaaacacggacgcgaacatcatcggcgcggaaatcagcacgaccaacgcaagattgccgatcacgccaaaatacactatggaaaggaacgccaggatcgcggcgcagatgcctgcggcgaacgctcccccgccgcatgacgaagtggcacccaacatggagaattcgctactgcacgcattcgtaaacttttcctgatacttgtagcccttcgaccaatcggagaaattcttgtccatctgtttcagatcgaacaccggagaaccaatgcgttcggacgccttcaccagcaggtcgagcgcggtacgttcgctctggctcagcgccaatgactgcgggttatcgaacaccaccggcagtatcacgatggtgctggttttgcctgcatcacgcgcacgagctggatcattggaaatcagctgcgcgatatcggcattgcgagaccgactcatatcaatgccccgatacatggcggccggccccgggtaaatggcgattgctccacgcgaagcgagcgagagcacggaagccgacatttttcggctcgacagtgttttcgaatgcttgttgtcaacgatatgcagcagttccgcagcgctggcgggactcatttccggctcgtcacgccaatactcgatgtcaccgtggtattgcgaacgatcgaaactgtgcaatgcgagcacaacggcgatcacacacaagatcagcccggccacggcaatggcgatccacgtgatcaggcggatacgcgcttttgtgcgctgccggtcacgccactgctgctcctgttgggcctcgctttccataatgccgtttttgatggtggtatcacgagtgcgtgccacaccgctggtcgcgccgacgtcgaacatggcgaccacgtcaacatagtcgccggcacgaacgtcgtgcacggtgaactgcaacgaccccttatcaccacgttcggtggttgacgtacgttcggtgtgcagccaggcccatgaattatccgccgtaatgccatccgggaacgtgacggttccggtgaccttgccgatgggaatctgattgctcacgccgagcggctcccattggaacgtggccacgtcttgataggcggtggtcacgccctgcatggtcatggtcacatcgaatttcaggctgctcgccgacgtggtggcgggaatattccagccgatttcgattttcttggaacgatcgtcggtattgtcggcaacaagaccgtcttttgcgggatcgaacggctgcggattgctgtcaccttgcgaaacatcggcgatataccactgccccgcatgttctcgattccattcgtcggtgctatagctgcttgggattgcgatatcaccctgctggtaggtctctcccgtcgtcgcgttgcgcacgctgatatcggtgatattggccaggttgctttccttcagcgtgtactgctggtacagctgcttccacggatggtcgccgtcgtcatcgctgcggtcggcgagtttcatatcgatgtgttgggtgattttcaaatcgccattgctttgcacctgtacatcgtagtcgagcgttttgtagctcagatcggccccaccgtcatccaatgcgatggccagcaatatggccgctacaacgccaatggtgacgacgatcgcgataccgaagctgcgcaccgctcgcgacgcatgctgtttggccgtcataatccctctttctcgcttcttcttccctcagatggccgtacaacagatggccgtacaagccgaattgaacagtaaagccccatcgtcatcggacggggctttacatgcatgtcagaacgtaacttgcggaacctgacgatccgcttcgtccacctggaagtagggggcctgttcgaaatggaacaagccggcgataatattggtcggcacaacctcggtctgggtattgtacttctgcacgacatcgttgtagaactggcgtgcgtaggcgatcttctcttccaacgatttcagctgattctgcaaatccatgaaattcgtattggcctgcagctgcggatagttttcggatacggcctgcagattgacaagtgcgcggctcagctggttttccgcagcgatgcgctgcgccacgtcaccgctttgcgcggcctgcaccacgccggcacgggcctgcgtgacctgcgtgaacacttgggattcgtgggccgcataacctttgaccgtttccaccaggttcggaataagatcggtacgctgcttgagctgcacgtcgatctgcgcccaaccgttcttcacacgattacgtagcgtgaccagcccgttgtaggcgctgacggcccaaagcacaataagtacaacgatgacggcaatgataatgccaacgaccatgacgactccttcgttaatggctcttcacaccattcttgcatgcgcccaggtacgttatgacaaaactcatgcccccgtgtctcattttcatgcaatctgcatggaaacgcaaaagtgccccgtaccttccggtacagggcacttcagtcagtcagctatgctgcgagggatccttttgaggcgtcagtcctcaaaaggatcaaagtcgcggcggacgcggcggcgaggacgctcggaacgctcttcgcgatcggcacggtactcgtcgtagttctcgtcggctgcgtaacgcggattgcggtcgtcgcggcggctgctgcgacgacggtcggaacgacgatcatcgcgatcgtagtcacggtcatcgcgatcggaacgacgacgacgcggacgatcatcataatcacgatcgtcacgatcggaactgccgatcaacacgggagcgaacctgtccataatgagatgaacagcaacacagatagctacagtgacaacagtcaccagcatcgcatatacaagattcgctcgcaatgcatctgtattcatccaagaattttcgccataacaaaaatcagcactcgtttcaccggttcatgcacgcacatgatggtaagcgacgccctgccaaggaactgcagcagccagcagtcgatagcaatgcaaagcatgagcgatgatataaaaccaagcaatgctgcacatagcatccaaaatggattgctggtacttgcgtcattgaggttgacgcttagtctggtcaactcatcgaataccctcagcaggccaagtcctgccataccgatagcagcatagacagcatgcaacgatgccttcggcttggatttctgcatgtatggcatgagaaaacgactcaacaagtagccaatgcaatagaacagcatggagaagggtaggatatcaagagcccaaggaaggcggagccgatcaatcggcagatcgaaggaatgcatggcaatgattgagagaaagctgaccgtggcaagcgtcgcggcaacagcccaatcataccggatcgctctctttgatttgacgaaggtaaagattccaaggaacaacatctccgtgacaaacagacaaggcaggaaccaaagcgccgcattctgcgggtaattatcgctacctgcgcgagcgagaacaatatttgccagcgcattcggaacagatccttcgtctcccctgagacgtcgctcgataagagcccaatacgcaagagtcaccgttccgaagaacacgtatggcacgagtagccttatcgctttcctcttgaatgaatccagaaactgcctttcgtgaaacagcattcctgaaatgatgaagaacaatggcatatggaatgaaaaaatccacgacaccagaccagcagaccatgatgtgtgtcccaaaacaactagtagtatgccgaagcctcgtagcgaatcgagtgcagccagcctagaactttatgccatagtataatctcctcatttactttcttttctttacaaaacacaatacatcattatccaagcattattcaaaaacttcgttgaggcaaaatcccatactgtaattaaactccccgcttctcaatctaaaagcatcgcaaccaacagtcacattaacttatcatatagcgaaatggtatggtaaaataccatttccattaactgccaatgtgtgtaggaacatgaaaaaacaaaaagataaatataatatctttataagcattttatttttttctgtaatatagtattcaatatagtacggtatgctaagaaaattaagcaaataaaacaatgcagaaactctctgacctagtggtataaacaggccaatcataatagctatggatcctatgaaatgtaaatttctaaaaatattaaaccaatgatcatcctctttagattccgtaaacaaataaacaaagaagaaacctacaaatagtaaagatgataatgaaaatgctttgctgggatctggccagtagccggatatataattctcatactttgtccctttgagcaaaatgccaataactgcaacgaaagtaggtacgagaacagccgaagcgaaaaaaagggacaaatatatttttttgtcaagctttagatagaggagagtgataacaacaaaataaattagagcggaatagtgaaaacctaccgctatcgcaaccaagaaaaaagctgcaaaaagactctgtaatcgttttttgccatccatatttctttcaacaaacaataatgcacaacagaatagtgcggtagctattgtctggcgaaccacattaaatgagtataagaaatacccaccacacaaaaaagaaacagtcagtagaactttcgaacatggcatattatatataacaatatatattaaacctatgaatataaagcttgtaataataaatatagactgataccaactacctgcaaaatcaatgcatagcttgttaagccatagaaatattggctccattggtggaggtgtgccattatatatctgtttataagttggaacatatgtaaaaaaataatctgttccaactccatatcggaatccagatattgtaaataaaatcaaaaaaacaatagcaaaaggtaaaacctctgcttttttatttaatttatctgcaacacataccaaaagtatgcagcagaaaacagatgttatataaataaacattcttttccttattttgatgttttatattcacaaaaaggggttttgttcaagaaaattcatcccatagaacaaacagcatagccagttgatcaaatacgactaacgcttcataaaccattgccatacatgtctaaagacatccgcccttgagacatgtatggcagaccagacgcaaacagagctccgtaagccacggccaatccgcgaaacctcttcatcatcaataaagttcggtttggatgacgaagaattacatatgcagtaagtcgcaaattcagcgtcaatggcaatccggcaacttgcgccccagctttgagcaatgatgtagtgacgaaaacagagagtgcatccatggaagactccttgctgattatgcgactatctgatcacgcagatgcaagtacgcgaacgggaatatcagtctgtggttactgcaagaccgaggtaatatctgagccttggaatcgagtggaccgacaggtacgtgtttcgtccaagaaatgtccaacttcgatatacatgacgggtacttcgttatcaggcaaatgcaaaagtttgcgggttttcttttctgcagttgccgtaaacatggtattgagcggacaagctccaattcccaaagattccaaagataatagtagtgacattccgaacaggccaccgtcggtatatccctcattgcgctcataagatgtcataaacgcgcgcaagtcagaagtaatcatcagcaatgcgggaggggctggatatccattaacaccaccttgaatgtgcaaagcctttgcgataacttccttgtcgagaatgacatgcactctggtgggttgcctgttacacactgatggagtgcgcatggccatctgaattgcctggttaagttcgtctagggataccggctcatcagcaaattcacgaactgaatgtctattttcacttaacgcagcaaaggaaagatctttgttattgagcttgtcacttttacggatagaaatgcttccaccatcgtttgattcggcattcataatgtgttgccactgatctgtagtgaataacgattgctgccaagaaatatctttctccgcatcgagatgacgctgcatgtactcatgaagcgcagcaagactttctttgtacacagtgttattagcgaaattcagatctgcttgttccagacgtgtaagcatggtcggaagctcgttaaaaacttttttcccaaacccatagcgaaaattgtgatggctcagacccttttcaatttgatggctgagaaacatcactcgtgtctcgattcttactcgttcatggggcataatgcgagagtagctacgattaaaccgcttggcttgtgcccacgaatcttgatatagatgaatgctttgacgcagattcttgagaggagcgataagcggttttggcatccactgttctacagtgctcttccaattcataatgacattcctttggactcttgattaatgctgatttagtggttccgatacgctgctgtgtaaataagctaatgactgtttacgtaatgaagcgagtagagtattcggctgcgtatagtcgatgtggttgctcagcaggtcgccactggtaacatgtctgtcttttaacgccagcgaatccagcaggtcgagcatgcgtgaatttgtggtctgcttaactgtaaagaagtggaatggtttgttgtacacaatagagaacacagtgccatggaatgaatttgtcaccacggctttcgcattgcgaatcaggttcacaaaagtgttaggggaagcattccaaaaataacggtcctgatcaagtgtgtaatcttcgatggcagtaccgatggtatagactttcacgcctagcttcttggcaagccgacgtgcataagcgtatacatctttctggcggttatagccatacaccagtacgtaatcttcagtaggagtgaaatcgctggcatcggcgattacgttccaatcatccttcgcaagcagaaatactgggtcaatgacggattgaacattactaatgccgagatcttcaagcatgggcaccgacgacggttcgcgcacagacacggcatcgaaatcggaaatcagtctacgataacgatccttctgatcgtcaggaatttcaggcatggcaatgctggcagcatacgctactttgcgagcgcccgcaggcgcaaatgacaggaagaacgcatcatctttaccattaagcttgttcttacagttccaaatttggtcgctgccacaaatatagacgtcggattggggggtgtcagcctcaatctcggcaagcgtacggtaagttttggcgctcataggtatgtagtcctcaaggaatttgccgaacactttgcgccccttgaccaaatcagggaagcgtacgatggcgcgaagcatgcgaataggcagcggccgcgtagacgtgtagtagtatttggggttgtaatccagcaccttggcgtccacacccatcttgcgtagagcggtgttcaagccgtaagtttgcagaacagcgccataattagttggtctgctgcaggtaatggtgtaagaagtaattgagtctttcatagaagcctctttctctgtgctagctgttaagaatttgattcaacgtatttgaggaatgcctcatagctgctaaacataggttcgctttgaacaaacgcttgctgtgaacgttcggtattgttatcaagctggaaaaccttttggaatacctcatccagctgagtgttcctaggctcaaacagccagaagaattcccgaagtagcttttttggcggccgctttccatatgtctgctcgtactcacgtactaataacacggcttcatttaattgaagtttgcggcgtttgtcgatatacgcttccaaggaagagattttctttgccggagcaccggcatatacagcgttcccatccaaacggcctgtcaccacgctgccagctccgatgatggtgttgtctccgatctcagctcctttgagaatcaacgacttctgaccgacaaaaacattattgccaatacgaaccgttccgcatgatcccagcacttcacccgtaaggcgttgtattactgcccagctatagtcatgctgcaaaatagagcaatctgcggtgatatgtacgttatcgccgatttcaatcatccaaggtctctgagtatcgattctgatggaccatggcgtatatagatgcacatgctgtcccacgtgtactccctggcttcggagccatgatatgtattgctccgatgaagccttgtggccataaactaaccgcatcgcaagttgtttaatgctcatttttcacttgctccgttccggatgaatacgtttatgaagtaagaaaaacacgccataaagcgttggagagatggccatgagtttgagctgcaggcgacgcccacgagggagcgtcacggattcagtaacagctttcatgttttgattgacgaaagtgcgagtgtcttctgcgaaatctcgccattgctgttctttagcatgccccgtgacaagagcctgatcataaaggctcaccatacttctcatttgtccatacaacgcaaaaggaagctgttcggggaatttttgatgtaccagtttcaccatgtttttggtagcttcgtaaccagcaaaattgaaatttgtgctcgtgttagaaaggcttcccgcaacttgtcgataatggtactgcggcgttgaatcaaaagtagttcgtacgctcgctgcaagtatatcgtaggtgaattgccaatcttcgccagtgcacccttccgggaaacgaatatttcctagagtggaacgtttgatgagcttgctccaagcagagattgtcgaataacctggcagattaatgtatttaaaggattccgaagtggtcattaccagatgtaaatcaggatgataaagatatatttgtcgtccgttaggatattccaagacaccggtgatcatggaggtatcagcgttttctttggtgagagaacgatataggacttcatacatagtcggttctaaccaatcatcagaatcaacgaaaccgataagctctccggtgctgattctgattccgctatttcgagcggcacctaatcctcggttctcctgatgaatgacacggatcctgcaatctcttgccgcccaagcatcacacatatcagggcaagcgtccggagagccatcatcgaccagaatgatttccaaatttcgatacgtttggtcgacgattgactgtatacaacggtcaagatagcgctcaaccttgtacacaggaacaatcactgaaatcagggggagatcttcagttcgggttttctcaggcatggcagatggattagtactcatgctgtgtacttcctccttgtgaatatcagagtaataagaggcttaagttcataacattgcacgaatgcaataagcagcagacaaatcgatgaccagaatagataatggctacattgattcgaggtcaccaaggactggacagtaagcagcgtcatggtaatggccgtaggaatcggcctcatattgatggtcatcagacgacgcacatcaatcacacgaatcacgaaaatcaccaagctaccgacaaacacgccgaatgcagcagctgaaataccccagtcatgtacgaggacagcggtaaatgcgaggcatgctacggctcccacaactgttgccacaagtaacggctttgtacgcatataagcctgataaatcgtgccaagaaagttgttgatagcactaagataaaaggcaagcacaagaatggatataagaggccatgccgagtagaactggcgctgcataagcaccctagcgatgaacggagagagtgtgattaccaatgcgcttcctaccgacatcagggcatggtacacacgccagattacatcatagaaatgcttgagcccagagctcttaaactcttggaacgcggaaagctgccaagcctgttgaacaatctgttgaagcacattcagcaaattaggaatctttgaagctgcagcatacaaaccagaagcggaaatacccagtacacctgtaataatgaaacgactaaccgtcgtctgaatctggttgcacaatgaattcggagccaatggcagcgaatagcgccaaagctgcttacgaagagacgcgttgtttcgccatactgtaaaatcgataaattgatactgcttaccggcgaaaagatataccaggatcgctgaaccattgcctacgatataagagtagaaataccccataagaccgagattcattccggcaatcaacacataagcaagcacgcccataataagtgcagacaatattgaggcgtaagcaatgagtttcatctgatccatagccctagcgacagtacccatcacagagggaaaacacaacgccgcataggacaacaagaaccaaattttatatctacctaatccaccaaaaataggcaaatcaaatactggcagaagaattgccaatagcacacagcttgccaacataaccagcatggtttcggtaatataaaacgcggcttttgacttatcatcaagcgtaaaacggagcatgccctcgctgatgagcaaagttagtacagggaataatgtggttaccatgatggtagccatgtccatgatgccgtattcctctgtagacaggtacagggtatataacggcatcagtatgaatgccatcagtttagtggctactgcgctgagtccgaagatgccgacattgactagtagattcttgtacttacccacgtagtcacctcagatgaatggctaattgtgccatgtatgtttctttattgaattcggaacgtaatgctgttttgcgcgcgcccatggcatcacgttcgtcggagccttgagcaatctttgtcatagcattagcaagctggtcaacaagttgatcgctacgttcaaggatgatggctgactgttcatcggcgtattcggggatgcctccggaacgagtggtgatgagcggcttaccagaaaccaagctttcgattaccgcgaggggtgctggatcgtcccaaattgacggcaatacgcatatatcggccatggcataaatagctggcatatcttcgtaattcacaaagccagtgaagatgattcgatctttcacaacaggatttgaagctaaatcgcgaagtttctgttcaaatggactcacgatattcgaattaaagaagaaagctccggcaataaccagcttggtattgggaactttctgcgctacttcagtaaacgctttcaatagttcttcagcgcctttttccggagtaagacgcccggaaaacaggaaaacaatatcattctcggctatattgaatttctttcgaaattcaatcgccttgctattagcctcttctgaaccaaaccggcttgtgtcgacgccattacgccatacagctttctgatcttcgcacagaccaggctcaccatgctctcttaaatacgtgtcaagcgtgccaacaatatatttggaaactccaagtacttttttgactttggaaatctctttaatgcagccgaaatcattaagaacttcgttatgcaggtggtaatacacttttcccgcatatcgctcggaattaccgtgcttctgcatggtcatgaacaatgttgcgtggttttcgatcattatcttgtcgaaagctgggccgccattctttgcgggctgtgcgagcttcttggaaaccttgttgatataccacaggcgttgcgcaatataccgatagctcatgagcttctttttgtggagcacatgcttggctgcccaataaatgcaacgatccgccgcgcgaaccagcaatggcgtcttgataaagcagaaatcagtatgcttgaaattaccttcacccacgatctgatctacgccgggtgcccaagaagaaaaaacagtgaaatcaaaattcggagtcttctcattctcctgaaccatcatcatgtccaatgcttcgacagctccgccgagaacattcggtactggcaaatagcctgaagtgattacagcaacgcgaggattcacagcgtttcctcccatccattcgcgctttccgcactgcttacgtacagagaggtcagacgattcgcactggctgaaatgtcatatttttcagcacatgtgtttgatgtttcaatctgccgattcgctgtttgcgaggaaatgttgagtacagttgaaatccaagaagatttattttccaagcttatgaaagatgtttttctggaaatatcggcttcgtgcggaacctgatcgctgaggacacaggggcatccggcgacctgggcttcgatggcgaccatgccgagaccttcataacggctcggaagacagaaagcatcgaacgcctggtaaaggtggttgacgtccgtgcgctggcccaagaacagaatgtggtcaccaatgccgagttcttgggcgtgctgctgtacgtctggtctgtctggaccgtcaccaacgaacgcgagtatcgtgtccggcttctggggaaggagctcggcgagaacgtcgacaaggaaagcctgattcttctgcggcatgaaacgacccacatggccaatcaggaacataccatcggctatgccgagttccttgcgggtttcctggcgaaggactgggtcgaaatggaacttctccagttcgatggcgttgggaatcactgtgaagtcagcgtctctgccgaacagccattttccggcgtattcactgcatgcgaaacattctgtagggtaaaggttcgagagcggacgcagtgcaagcttcatcaggttcttggcaaactcgcccttgcccatcgtggaatgcgagtgggcgatacggaccggcactccagcctttttggccgcagacaatgggaatacgctgagcgtattgatgtggctgtgcacgatcggccagtgttcctcatggaaaagcctgaccaattccttgcggtagcgaaggggatgctggtatggagggatgcgaaaaacgcggccgcccaacgctttgatttcctcttctggaacgcgagtcgaatcggcatccaccaaaaaatcgaactgcactttgctacggtcgatatggcggtagtagttcatcactacggattcgacaccaccgccaagcatttttcccatgacctgggctacgcgaatcggcactggattaccgtcctcgaaccgggactaagccgacataacggccgttatcggctctttctgcaatcaatcgacctgtagtcggcacgcgagtcccgtcctttccctccaaatgaaccccgaattggtgtctctcaagagcaacccaaaccgcgcaggagttacccaatcccgttcatcacctgccaaggtcgatttttgcatccccctcagacacacccagcccccgtcacctactttgggggtattcttcacaggttttccatgaacgctttgcttgctcgtgacttaaaaactgtgtttgaaatctgattcagtcggttttccggacgtttctgaatgagaaaaagagccgataacggccgttacgtcggtttggttagtggtcagactatgcaatcctctgccctgcataacgcttgtggcacgattccggcactctgaataactaaggggtgaccggtgatggttaatatcgcgatgataggccataagcgcattccttctcgtgaaggcggcattgagatcgttgtagatgaactagctacgcgtatggccgcaaaggggcataaggtcatcgcgtacaatcgcaagggacataatgttgcgggcgccgaatttgacggaaacgttcattctgcaaataagccctttgtatataacggcgtgcgtgttgttccagtgccaactttcgaagcgaaaggtttggcggcgttgacctcctcattctttgcgacgctgaaagccattgcggccaaaccggacgtgatccactatcatgccgaaggtccctgcgtcatgctgcgtctggcgcattgggcgggcattcgcacggtagcgaccattcacggtcttgactggcagcgtgccaaatggggcaagttcgcttccacatatctcaagttcggagaacgtaccgcagcgaaatgcgcggatgaaatcatagtgctcagcgaaagcatgcggcagtattttcaagaaaaatatggtcgcagcacacatttcattcccaatggcatcgaatatggtgagccggtttcggcgcaggaaattaccgaaaaatatggtcttcacaagaacgactatgtactgtttctcggacgcattgttcccgagaaaggcgtgcattaccttatcgaggcgttcagcaagctgaatgcgaacaaaaagcttgtcatcgctggaggcgcttccgactccaacgagtattaccagcatattcagcagatggctaatcaggattctcgtgttattttgaccggattcatacaagggcaggcgctcaaagagctctatagcaatgcttatatttatgtgcttccaagcgacttggagggcatgccgatgagtctgctggaagccatgagttacggtaactgctgccttacgtccgacattccggaatgtgcggaggtagtagaagggcatgcagcgatattccagcatggttctgttgactccctgcggaaaaaacttcaggaattgcttgaaaacgatgatcttgtacaacgttacaaggcaaatgccgcagattacatcgttggtaaatataactgggattccgtcaccgatcaaacattgaacctgtatgggggagaatgagcatgcgaattctcctagtgaacaaatatttctatcgtaaaggcggtgcggaaacctatttcttcgcgttagctgaaggattacgcgcgctcggtcatgaggttgcattcttttccatgcagcacccgaataacgagtcaagttattggagtaaatacttcgtttccgaaaaggactatgtgggggatatttccgctttcaagaaggttcaggaagcttccacactgatttactcttttgaagcgagacgcaagtttgaggcgttgctagaggaattcaagccagatgtgatccacatgaacaatgtgcatcgccagctgacgctttcgattcttgatgcaccgtatttgaagaaacatcatgtgccggtggtgtatacggcgcatgattatattcttgtttgccccgcatacactatggtcaacgggcatggagaagtgtgcgacgcttgcttggataaacatttcatgcatgctgtgaagaacgcttgcgtgaaaggatcccgtgtcaaaagtgctttggcgaccatggaagcagagttcctgaaactgcaccacagttacgacaagatcgatttgattattgctccgtctgagttcatgaaaagcaagcttgaagaaggcggttttgctggcaaagtggttgctttacagaatttcctgaccgattcacagatggaaatggctcgtaaggttgcgaatacgcataaattcgaggatgctgttgacgggaaacgaccatacttcctgttcttcgggcgactttccaaagaaaaaggaatcctgacgctggttcgagcctttttgaaggctactgggctagcagcttctcatggttctgccgatagtaacggtgctgtgcgccgcacggccgaaagttctgaggttgcgaacgataaaaccttccttccttccaactgggatctccatattgttggcgatgggccagggcgttctgagatagagcgtcttgtcgccgatgcaggattcgaagccgcatcacgcattcagcttctgggctacaagtctggcgaagatttgcaacgcgaggttggtaacgctaggtttagcgtgctgagttccgaatggcgtgagaacatgccgtactccggcttggaatccctggccgctcagacgccgatcatcggtgcatgcatcggcggcatccccgagctggtggaggaagacaaaactggctttactttcgaatccggaaacatcgcggatttgaaagatggtctgcttaaagccgccgcggttgatgaagatatctatggcactatgcagcgtcggtgtattaagtacgtcacgctgcgttgtggacagcaggcatatgcggagcagctggttgatcggtatgcaaagcttttgaattcaggtaagaacggtaactgatatgaagattttgtacattgcatatgcgagctcgccttatggcggtagtgaggaagccgtaggctggaaccttcctttggcgatgagccagaacctcgataatgacgtgcatttgattaccaagatcgagcagaaggaagccattgaagattattcttcaaagcatcccgaactccgacttcatgtgtattactgtgatatcccttcgttctataagaaggtttacaagggatatctctatccaggacgtcatggtatctggctgaaacgtgtcgctccaatggtccacgatcttgatggacgatatcatttcgacgtcattcatcagatagcgcctgtcgaattccgctctttgatcaatcttggtaagacagatgcggtgaagatttcggggccacagggcggcgctgaatatgcgccaaaaccacttgacaggtaccttcgatctgttgcgttgtttgaagcagtgcgtcgctgctccaattggattatcattcataagccctctttccgcaaagcgtatcgttcgtttgatatgcatttgttcgcgaatgaggagagcaagcagtattttattgaccatggtattgatgcccggaatgacatcgttaaaaccgaagtgggatgttggcctgaggcttggaaagaccatcaacgtgaaagccatgcaataccgcatgttctttatgtgggtcggtatattccacgtaaaggagttgagctactgctagatgcttgcactttgctgaaggatcagggattcaccaagtatgagttgcgaatgtgtggatggggccatttagaacagaaacttcgtgatgaagttgctcaacgaggactggataatgttaccgtgttaggcaaaattccctacacggaaatggcggagcagtatgcatgggccgatttctttgtgatgccgagtgtgcgtgaagcaacgggtgtagttcttgctgaggctatgcaaaatggattaggagtcgttacttttaatcaggccggagccacaatcgctttgaatgataaggtctgcaattacgtcaagactcgagatggggcgaagggcttcgctcaggcgatgcgtgagtggtccgagcatcccgaaatgcgtcccgatatgcagactttcaaagcatgctttgaaagtctgacctggcctcgcagagcagagtactacatgcgtctgtatgaaaagcttatcaacggcaagcatgaggagaaggcgtgagcgaaccgaaagtcagcgtggttattcccatgtataacgtggagaagtacctcgatacatgcgtgcaaagcgtgcggaagcagactctgcagaatattgagatcattcttgtggatgacggttcaccggatcgctgtggcgacatggctgaagaatacgccaagcaggatttacgaatcagggttgtgcatcgcgagaatggtgggctggggccggctcgtaacagtggcatggaagtcgcgacaggggagtacatcggattcgttgactctgatgattggatcgagccgcagatgtttgaagagctctataatgctgcgacccaacacaatgccgatatctgtttttcgggtatgcaatgcatggttgatggtgcaaaaggagacaggaatgtgaatcctttcgctgaccaggtgctcactggacaagaagagattttccgattgcgtcgttccttttacggtccgttgccaaatcggcagaagtgggatccggtgccggtatcggtatggaccgcggtgtataggcgctcgctgattgtgaacaacaatcttcggttccgtaatattcgttcggaagacaagttcttcaataccgaagcttgtaaagcggcgtcagtcattaccgcgattggagagacccgatacaactatcgttgtgatggtcaaagttcgataacgcgaacattctcggagcgtatggtcgattcatatttggaactgttccgtgaattgctcaccatggctggtagtgagaatccaacgtatcggaatgaatgtcttctgcgtgccagacgcggtgttatcgattacacacgtgtggcttgtcagaccatagccggatcccgcatatcacaagttcaaaaatcgagagcgatgcggaagatggttgatgatgtttccgtatgcgtttccgttattggctatccgttctggaaactgcctattccccaagcggtgttcgcgggattgctgcgtatgaaggcaacgtggcttatgctatcattggccggtctgaaagttgcgctatgaactctgaagctatgttgaaaactgcggggcatagtagacgcaaagggctattgcgcactccattgaatgcgcgttttggcgtcttcttcattttgttctactccattgcgatggaggcgttgattgagaacctccatttaccgggaaccatccgatatcttaatgatgtagtgctgattgccgtaatatttggaattcagggtcggttcctgccaattctgcgcaaagaacattcctatatgctctggggcgcggtatgcgcattgttcgtcatggatatctttacagcggtcattaatcttgtttcgccgttactggtgatgtgggccgtacgtaatacgtttcgtggactcatttacctgttttgcgtgattgctgtgcttcatgtggaagacatgacgaagctgttccacgtcctattggggctgcaactccctaatcttcttttggcgatctatcaatctttggtgacgagcggtggcaatcctgatttcgtacatgggctcttcgctaacggtgccggtgcaaacacgttcagcgctgtgctgttcgcatattatttgaatgcatatctgaatgggcgtgaaccggtatggactgtcgcattcgtcgcggtgacttcaattatgattgccgcgatggctgaggagaaaaccttcttcctgtatttcatcgtgattttcgttctttccatattgatttcacggtggtctctcaagacattgtgcttcattgctgtggcatttatcgcaggaatcttcctggttcagtatattgccatagttatgccagacattcttgagtttctgactgattggaataccagcaaaacatatcttaccgctacatgggcggatagctacggtattccccgtctgggagcgttcactttcattgctaagaatttcttcaataatgattttgcgacttcgttgtttggctttggttttggaagtgctgagcactcccagtttgctttcttggattccccattctatttgagatatggcgagttgagttaccgctccttcacacatcaatggactttcatagaaaccggctatataggcttcggccttttcgtacttgtgttcataattgcattgatctgtttgtgtaagcagcgttggatatacagaaagtatgatgccgtcctgaatctgacaggcatctgcatgtgtgtggtctgcattatctctatgtggagtaatgcaacgttgaaacttgatgcgtcatatatcccatgctttggcgtggccataggctttttgacccgtaaaggctttggtgacgttcccaatgaaaagagtgaaacagtatgaagcaaggactgctttcggtaatcattcctgtttacaacgccgagccatacctcgcaaagtgcatagacagcgtgctgtcgcaagatgtgccgttggaggttttgctgattgatgatggctcaattgatggaagcgcgaacgtgtgcaagcgttatgccgagcgtgacacaaggattcgatactttcgcaaagagaatggcggcgtatcatcggcacgcaatgtcggcttggacaatatgctcggtgaattcgttacttttgtcgatagcgatgaccaagtcattagtggttcgtatcaaacaatgctcaacgaatttgccgactcagcgactgaccttgtttgctgcggcatcgtgcgccagaacgaacaggggcaaattgttgaccgctatggtattttgccgggacgggctgcaatgactccaatcgaggcgatggactcatgcttggcttcagatggtccggtggggttcacggtatatgccaagattttccggacttcactgttctcgggaacaaccccaattcgattccccgaaggtcaattgatggaagaagcctatattcttccgcatgtcttcgttagatgtcggaatattgttcacataggtgaagcaggttatatatatgcccttcggtctgacagttataccaccaaaccgttgagtaaagaatgctatgccatttacgatacagccgagagatatgaggcagaactgccgtcgctgtttcctcgattcgatatgcgctttctgttcagatggcgggtggaaagctgtaccaatatttataggacagcattgaagcaacaaaacgttattgatcccaaggttttcgaacgcatcagacgggaattcagtaggatttttcgtaaagggctgtttgcctcatcgatttcattgcgaacgaaattactgatggtggatacggtgagtcgtttcttcctattgaggcagaacacaaaacaacacgtacggcgaggaggcgcccgatgaaaaaacaatgtgtattgattcttccctattttggtaagttcaataattattttccactgttccttcgttcatgtgccgcgaatccgtcatatgattttctgatttttacggattccatggaatcataccagtacccctccaatgtgcatgtggtgccaatgactttggaggagtttaaggccaacgccaagaaaaaactagggtttgatgtgtgcatccctcagccatacaagctttgtgatttcaagccggcatatggtttcctctttgaagattacattcaagactacgaatattgggggcattgcgattgtgatcttgttttcggtgatttggagacgttgctgactccgattcttaaagaaggatacgataaggtttttgccgttggtcatttgacgatctaccgtaatacagttgaaaacaaccggcgcttcatgaaaccgttgcatgggcgtgatatttacaaagaggcattcactacaagcaagatatacgtgttcgatgagaatgtgcaatgttggatgaatccggatcgcttgaatgtccatcttctcttcagagaagatggagccaagttgtatgaaaaagacctgtctttcaatgtcgacacaaggagtgcgaagattaagcgcactgtatatgactcgaatatgcaaagctttcatgaaggcgagagctatgatttgacgcggtactactggtgtgataaaggcatcgtctctgtctcatgggacaaggatagtcgtacggcggtgattcggccttatctatatatgcatttgcagtcgcggaaaatgcatgatcctgtgccttcatcttcgatagtggaaatacggcctgacagattcgttgcggtaaatagtctgccgatatctagaaatgaacttgatggacgatggtttaatatattcaatctgttctggattgatatatatctcaagaagatacagaagaaaataagtaatttgatgaaagttaaacgatgattcgtaatttattaagacgtttcgttttaaaagaaagagctagttcgcaggattttattaatttctggaaaaaacaaggtgccagaattggtgaggggacatacttctttgacccaaggagcaattgtttaggtatcaataatccctgcaacttgactattgggcgtaatgtgcaggttacgcacggtgttgtgatcgccgatcatggatacgattggagtgttctgaaaggagcatacggtgaggtcctcggcaatactggtcagatttccattggtgacaatgtttttattggcatgaatgcgattattctcaagaatgttcacatcgggaataatgtcattattggtgcggggtcggtagtcacgcatgatataccagatgattctgtcgctgcagggaatccttgtcgagttcttatgtccctttccgtgtacagggaaaaaaggacgaatgctcagttagaagaagcagtcaatttgtttgacgcttatgttaaaacccatcctggtgaaattccagataaggaattttttagagaatatttttggctgtttgaacgacctgatgaagaaggtcgagtaagctgtgcggagttcgaccgcgtaatgcactttgtagatggaagttacgacctttccgctaaggttttcagtgaaagcaagcggttattcaatagctttgaagattttgttaagtattgtcaagcgaaaaaaactgaagaataatataaatttgttgtaagatattgaatgatgatctagtccgataaattctttttcgtttttaaggaaacaggacttcgtgaattggaattaatcaaatataaaggatgggacaatgtcaagacataaacgaaagtcgattaaagtaaattttataatgaacgcttttttgacatgttctaattttatttttcctttaatcactttcccgtatgtctctcgagtccttctagcagatggaaacggcaaaatcaattttgctaccgcgataatcaactattttgtgctgttcgcttctctaggaatgcctttgtatggagttcgtacgtgtgcgattgtacgggacgacaggaagaaattgtctcgcacagtcaaggaattgttcaccatcagcatggtggccacggctttgtcgttggtcgttttgcttgtgatgatcggaattgtaccgaaattccaagaatacagaggattgctgctggttctgtctagtaatatctggcttcaggcgcttgggatggactggctgtatcaggcgctggaagaatactcctacatcacagtgcgttcggttgcattcaaaattgttggaatcattctgatgttcatgttcgttcatgaacatggcgattatgtggtttatgcggttataacagttcttggcggaaatggctcaatggttttgaattatctccgatccttcaaacttgtggatcgagtgtctcttcgcgaatgtaatttgcgtcagcatgtgaagccgctctttggcttgttcctattatctgcggcatggtcattatatgcgaatatggatactgcaatgctgggtttcctgagcaatgacacgcagaatggatatttcggcgcgtccgtcaagataaagcagatgcttattgcctgcatctcggcattgggcacggttttgcttccacgcttggcgaattatttcggcaatgggagaaccagagagttttatgatctactcaggaaagatagttcatttattatggtcgctggattttatgtggtggtgttctgcatctttgatgcggatgagatcatccgcttcctgtcgggtgacacgtatgaacctgccgtaccggcgatgagagtgattatgctggcggttttcttcagcgcgctttatacgatgctcagcaataatgttttggttcctcaggggaaagaacgtattcctacattagctactgtaatcggactggcttcgttgacagctctggaaattgtacttatcccgccgctgggtgctgtaggcgcagctattggcacgacggtaggcgaggccgtgggcgctttggtattatgcttctacttgcggcatgatctttccaagatgtttagcggggagaacatcttgaaatgcatagctgcttctgttgttgcctcctgcgttttattaccggtgaggagtcttattcccgatggtggtcttttcgtccgattgctgttgcaggggtctgttttcactattgtgtacttcgctgctttgatgctgatgcgagaaaaattcactagttcggtcattctgagtagaattccatgggaaaaaaagtgtatgcgtgattaatatataacgctttaaataatattcaaagagtagattattagaggaatatgatggaatatacttttacggtttttacaccgacttttaatcgcgctgcttcgatacatagagtatacgagagtctacagtctcagacgttccgtgattttgagtggctaatcgttgatgatggttcggaagatgatactgctgatttggtcagaagatggattaaggaagcagattttccaattacgtatatgaagcagaatcatgccggaaagcacgttgcatggaaccatgcgttgcaaaaggccaggggtggatggttcgttattgccgacagtgatgacgcgtttgtcccgaatgctttggaaagactgctggaggtttataaaagtattccagagaaagatgccgcaaagtatagaggcgtgacgtgtcgatgcattacggatgaaggcgttgtggttggttccacggagattcccacgccatggttagacgctagcgaagcggatgcgaaatatattcataagctgcaatatgaaatgtggggcatgacccgcaccgaggtgctcaaacgataccttaatccgaatgttgcgggaatgagattttatcctgaatcaataatatgggataaaatgggtgaaaaatatctgacaagatatatcaatgattcattgagaattttatatagcgatcagtccaatgcgactactgtgaagaacgtcaataataggtataaagaaaactattatttatggcgtcatatattgaatgatttaaagaaatatgcctttaatgagcctttgatgtttgtgaaagcagcaatcggaattctgagagatggtcttctctcagaaaggcgttatggacagattcttcgcgatgtgaagtttctgtcctgtagggcgttggttatttttggatcgccgattgcatgggtgcttgcgaaaaaggcaaaaccaagtaactcgtaagtgtggggctggtgatgttctgttggactcgtcattgactccaccatcaccaatcatgccacaagacccagctgtatgtgatcaagataaaggtgttcggcgtcggcacttgtttctgtacaccgtgagcgttcaatttggacattgccggcggtgatgccggtgggatgagaacaccggcaccgtctggttccttgatggattcccgagtgcctgtcaaccaaactgatggttcccgggaggaaaggaaatgacggcaccggtgtgtgtccgacagcgtatcaggcagctcgaccgccaaggcctgagccacaaggagatatcacgaaggcttggcgtatcgcgcacgactgtggtcaggtacgccaaccatggggattattcgcccagaccatcgactaccgcccggctgggcggtagtcgatggtcgatgacgggtacgcggccatcgtggatggctggccggacgccgatgtgcgcatgccggtcaagcaacgccatatcgcgacccgcgtgtacgagcggctcgtggcggaatgcgggtattcgtcggtgcggcgttgggtcaagcgttggaggcaggagcatcgagcgcagtcggacggcttcgccgaattgaagtgggcgccgggaagcgcgcaggtcgatttcggccaggcccgggccgtggtcgcgggcgtggagcgggtcgtgcatttcctggcggtgtcgttcccgtactcgaacatgcgctgggtggcggcattgccgggcgagaccgcggaatgcgtgtgccagggactgctggaggtgttcgagaggacgggcatgacgcccggggtcgtggtgttcgacaacgccaccggcgtgggccaccgcaactccgatggcacggccgcccggccccgcctgttctccctgttctgcgcgcattacgggttcgaaccccggttccgcgacccgtattccggccatgagaagggcagcgtggagaacgcggtcggcttcgcggggcgcaatctgatggtgccgatgccgtcggccgagagcttccgggcaccggcccgcgtgtggctggacgcgtgcgaacgcatcgccggatcggaccattaccggcatggcgttccggtgcgggaactgttcgaagcggagagggaccacatgctgcccttgcccggcgtccggttcgacccgtgtgactggaggagcgtgaaggccgacaagaccggctccgtcgtcatcgacgcgaaccggtatctggccggcccgagatggcgttcgatgcgtttgcaggccggggtgcgcgtctcgagatcgagcttcgcgatcccgatggcgggcacatcgtcacgttggaacgcgtgtgggggaaatcggcggaaatccaggcggatccgacgagcctgctcgcgatcatcgcgcgcaagccgcgcatatggggcgaaagcccaatcaggaacgatttccccgataccgtgcggcccctgctcgaccgcatggacggacacgtgcgggccaacctgctcgacgacatccgcgtcgtggccgccgaatgcgggttcgccgccaccgtcaaagcggtggagaccgtcatcgacgccggacggaccatcgatcgggccgcaatcgccacatgcgcccgacgcgtcctcgagggcaagggctcctcgggcggccagaatctgaaacattacgacaaatacatggagggacgggcatgagcacacacgacggccatccgcgcaagcgcggcggcagagtggtcgccaaggccacacccggacaggtcatgaccttggcgcgcaacctgccgttgacgcacagcgtgctcgggaaagccatcgagaacgcgaccccgggccagctcggcttcctcgccaacctgttcgaggccgagaacgccagccgggccgaatccaaacggcggcggctgcccggacaggccggcttcccccagaacaagaccctggacggctacgaccgggggcatggcctcgttccccgccgactggggacgtgggcagctggaaagcctggagttcgtcgaacgggccgaggacctcgtgctttacggcgacgtgggctgcggcaagacccacctggccatcgcgatcggcgtgctcgcctgccggcgcatgatccccgtcaggttcttcaccgcctcgagcctggtcatgcggctgaggaaggccaaggacgagaaccgtctcgaccaagagcttaagacgatcggcagggccgggctggtcatcatcgacgagctcggctacctgcccatcgacatcgtgtgttgctgttcatctcattatggacaggttcgctcccgtgttgatcggcagttcccgtcacaatctggcttcgcaaggcaaggcaagggcatgatgggagaacatttgcggttggcatcatagttgcgatggaacgtcgctttgtcgttgtgatacctgtaagaagtcggcatctcgatttcgctttgcccgttaattgcattcatccgcaatggtggcgtcagtggtaacagatgatctgccgcactgacaccactagcaagctcagctaagcgttcgcccttcctgcagatgtttaatttgcctttcgactccgtcccacaccagttcgaaccagcggccacggttacagcttacggtcaccgcaaacagtccttgacgcatgaagtcaatcagagtgcagacactaaatagatcgtcaacaggatgccgaggatttgcagaatggcgaaaggctgctgataaaggttctccagcacgaacaggtgcttccaaagcaatgttctcgtggcgggataatcggtgatcaggtaaaccgcgaatgcggaccgggctatgcggttgatgatccggctgcggaaggaaagccggtcgaacagtagaaacatgtcgaagcccaccatgatgacgggcagcttgaacgatccggcgatgaagatgcccttatcgattccgaacaacgataacataacggaagcgcatgtgtacaagaggaagaatcccagtccggttccggtcatcagccaagtctgtttgagcgtgaacggcttcatgtaccacttgtgcgcggagatgaggatgaataggtagatgaagccgaacacgctatcgttcactccagaagttccgggaatgaagcttgtcagtccccagattgacagcactgttatggcaagtgcataatgcgtgtgtttgccaagcgcacgtagtcccttggagaggaatggcagcaaggcgaggaaggtggcgtatgcagtgacgtactaccataatcccatgatggtcggagcgacgctgcgggcaatcatttttataccgaagtcagcacggtcgaaaaccagaaagaatgccatgctcgcaaggctccagaacagcacttcgcgttccaaaatccatatgcgtttgaagttcgatttgatggtctgttccttgtcgaggaagaaccatgcggagatggtgaagaagatgacgacgcccactttgccgccaccctgcatgacgagctgaaagaaagtcctctcaggtcccagtgaaagattcttgacgtcatagccgttatggacgacgaaatggtgggcaagaatcatgaacattgcaacgatgcgcagcagttctatgctggaattacgcccccccccaatttgaaattcgggtcggcgggacggccttatgggaggccgtggtctttgagcctataatcatctttcccttcgttttctcttatcttttccaatacccccaattatacccgtccgaaaagaccaagttatgaagctggcctacggccatcgacaggcccgcaggccgcatcgacgacggatacgaacctcgatcttacaacagcaatctatggaaaaatcagagacgaaaataaccaagcaaacaccccacacatgtagacaacagctaacgtccagatcatacgggaaaaactctggtttgcttccgtatctcgcttgcatatggaccggcacggaagcaagaaaccacaacacgcaccaccaaaggtgggtagccattatggctatccaccttcttcttaaggagcgcaaacgatgcaatcgacgtcaaacatatcggcaagtaaaaggcatacagaatccaaagctcacaataagcatgacgcgtttctcagctcgtccgtgcgagttccatccattcgtgaagctcacgcgggaaatccaagcccatctcccggtaaacagagtcgacgtacgcaggtatgtcttcacctaaatgcatgagcaaagaattaaattgctggaggaattccagataacgttttttgtcgattacgaaacgtaaatccttaacaagctggaaaaccgtattgttggaatcatgcggatgcgcacaataaagacgttcatcgtgcgcgcaaatattacgaaaatctttcattctgcgatatatcttatcgatacgttgtgcatcgatttccgtcttatgcctgtgcgaatctccatacagaactgtgaaactcctagcaattgaaccgcgaatcaatatattttgagactgaaagaaccaatatatttgtcccaaagttagatcattggtcaaaacccacaacggcacctctccatcgtgctcattgaggcaatgaacgagatattcttttctgccttttctctcgcaatcactgttgtcagtaagtatcttttgcaatcgcggaatgagctgacttgccttttcatgagcttggccggtacgagcataattgtcgatattaaggtaggggttcttctcagccggatttgccttggtgaattcgtatgcgcagactgttttcagaatcgcctcagcaatcgtgatcattccgaaaaggagaaaacggagctgcctatcaaacaggtacagcttatacaagtcattgtatgaggatccttcgcgatatttgtcttcttcatcttttttcgcgcttgattatcgagaaacggttttttgtatccattgacagtcgcgtaatatccttcgcgctcaagaatccatgatgtcctagaatccgtttgaagtcctcgtgaattgagaagagcgatttgatcttcgatcgtggtaaaaggtttatgcatgaagactccaatcaaagcacaaaggtcgtctttccaagaagaaagacgacctttgcgaactggacaccgcccagctttatcacaaatggttaatttatacgaaaaatggctgtttttcgacttcggcgtgtttcacatagtaagcgtccaaacagttccgcactgcccaatctcactccacattgatgaaaaactctttgctccgtgcaatacatctcccatcgcacacagccgaaacactcataactagatcatcgtagggagcgctttcctgcggaacaatgtcaatgtcaagattcgaacgcgacttgtgcggccaaccatagtccgtccacacaagtcgcgttccatgtctgcacaacccgagaaaagggcggaaaatactagttgtgcagacgcggcgactgcagatggaccgttgcgtatgcgcagattgcggaagcgatcaccagcagcagcgagatgatggcgagcgcctggactgcggatccggagcgaggcatttccggcttctctggcttttctggatcaccgggtttgccaggttcttctggtttttctggctcggcgacggctttgatggttaccgtcacttgagtgcttatgccatcatggtcggaggtgcgcaactgtgggcccgctcccccactcgagtttgtatctataacatcatccgcaccattgcgcacggcggtgatggtgatgttctgactcacggcttcgaaggctttcttcttcccaaccgcttgcattgcgcgctcgatctgatcgttcaacgcctgcaactggtcactatccatcacaagacggtagtcggcgatgccgttcagttgcgttcctgtcaaggtcagtaggtcgtcagcactcagccgctgaaggccgctcgccggattcaattccaccaaagtctgcttgctggagatcgccagatcgccgacatggaacattccgtcacccataccatcaccgctagtgccgcctggaatcagcccaagcgagtcagccaagtacggcgcaagattcgacaagtcggagaacgagccgctcaacaaggcgagcgtgttcagtccagctggaatcatgccccggtattcgccaccgcgaacagtcacatagccaagatttttagcgtcatccagcaggttgaaaagcgtcggtgcggtgaatgttccgcccgaaaaactgccttgcgcggaagtttcatccgtttcggcaaaccgcatcaacgttgcatccgaggtgaacgtgccaccctccacgtgcaatgcgccacggcaatcgaccgcaggctgtgttccgcccgcaaccgttcccgggccgacaatggtgagctgcatgttcgcaggcacagtgatcacagcggatccatcggcttgcagcacatgcccgttcaagtcaaacgttacgtttcgcatgcctttcagaggcgtaatcgtaacgctttccgcaacgtcagtcagcaatgtgaccgtcgcgttcttcatcgacgtatggccgatcgcctcctgtacgctcgcgtaggttgcgttgcccacttgcgcgaccgcctgagattcggcggcatcggcaactgcatctgcagagaacagcagcgttccaaacagcgacgcgatcgcgaaaacagcggtcagcaccaccgaaaccaaatacttaccttgcgttcgcgggcacacattcacccgcttctcatgactacgcatgattatttccttttataggttctgttgcatatttcaatccgcaccgaagtgcgtgggaccaccctcagctgtgagggataacgttacagaaatcatggcgccatgctgcattaattatctcacaatgcgcaaaggaaagcaaattacctattttgaaaatccaaatctcatatgagatatatcaaaagacaatctttagttatagtggacctcatcacataagttaaaactgtttcacatgagtatcacaatattcctcacacgaataaacgtatcccaataactgcaaaaatatacatatgacgaataattgtttcccatcaagaaacaagcgagcccacaatcaaacaagcgaggtcgcaaccacacaaaaacacatttcccatctgcaccacgtgggaaagcaaaagagcgctccgggagggagcgctctgatttgcacgacgattcgtgcgaaaagtactgcggaatttagtaagatccggtgccgcggaagaccacgagcacggtttttgcgagaatcgcaagatcgcctgcaatagaccaattttcgatataggaaacgtccaaatattcgctctgctcctgcgaaagatccgaacggccggaaacttgccacggaccggtaataccaggcttaaccagcagtcgcgtggaataaagggaaccatagcgagcaacctcttccggcaaagccgggcgaggaccaaccaaagacatgtcgcccttcaaaacgttgaagaactgggggaattcatccaacgaagtcttacgaataaaacgaccgaccttcgtaattctcggatcatccttcattttgaagatgaaacgatcggtctgtccattttcttcggcaagtttcttcttcaattcttccgcattggtaaccatggaacggaatttatacatggtaaacggcttgccatgcaaaccgatacgctgctgcgagaagaaaatcggaccaccgtcatcaagcttgatggcaatcgccgtgcccagcatcagcggcgaggaaatcagcagcgcgaaagccgaaccgacgatatccagcaggcgtttaatcacgtacgtcgtattcgtatactgcggcaaacttgccagcaatacaggctgttcggccgtattacgcaagtacaggcggtggtggccgctcacgtcagccaaggaaacagccaacgcaagctccatgccaagcgactcgaccgcaagggaaatgccatgcagcatttcggaatcgcgggacagcacgtcggcaacatacacttcctgcgcacccaagctttcgcacgtacgcgggaaagcggcattgaacggaatcaccttcagcttgtcagcaccttcaatggaaggatcaggctcgaacgacgtgaccacataagcgtctttctcattgtcgtcagcttcgatcgggcacacggcaatcggcgaatacccccaattggagtagtcccgcatggtgcgcaacgcacaattgataccgtcggaagaaccaatcaccacggtcttatacttacaggcgcccttctgacggctgcgatgctgccactgacgcatctgccaacgggcgatgacttctaggaagaatgcaatgatcggggcgacgataagcgcggttctcggcaaggaaagattgaaaataaaagcaagcgagcagtaagtgatgatggtgagcagcgacgcgttgatgattttcgcatacagctcgtagccttccgccatcacatgacgatgatacgttccagcaaaagtgaggctcaacacccagatgaggctgaagcagatgaggaacagccagaacggcatggccccattgatggcattatatgcggcatcgttggcccaaagactgatggatagcgaaatcagcatgaccgcaagatcgaccatcaccaagcagacgacaaaagaataacgccatgcgggcacaacctgattccgcctgcccttgcgctttccatcttcaccaacggaaaatggcgtgttcgaaaacatcatcggctcaaactgagggctgttgtcttgagactgatgtcgctcctgcttctgatcctggtgacgagagttagaagagacgatatggatttcctgggttctcactacttgatccgaaccctgctcagagctgcggaaaccgccttgcatgactcctccctctactaactacccccacccgaaaagaagggggcttccctccatgaagagatagtatcataagccctgttaacagagtagatctccaactcgattttgcagttaaatgactattggaaacttgcttttgacgcgataccgcgaaacgcgcggcaagaacggatgaaaagttggcgtccgttccgtgaacgtgaggctacatgcgcatatacccacatattcccccatactcccctgttgcaagatggcttgtctagagccgcttgcttagctgcttaggttacctacggaactgtctagcggccttcaatcagcggggtctgacgaagggtgagcggctcatccgtatccggggcggactgcacatgcacggtgatctcataggattcgccgggctgcaaggtcacatcacccacgcccacggtcaggccattatgcaaagtcacacccttgtaatcgtcggcattctgaaatttccaatccaccaaacgaccgttcgcaggcgcgtaaatgaacaatgccgtcttgatctggcctttcggaacgatatttccggcaccggtcacatagtcagcttcggaagccgcttcctccgccgtcatggtgttctgcaacttgatatgcaccgtatactggttcgcgccgtttcgtgcgaccttctggaattcagtggtcacttcgcgatgcaaataccagtccattttcgactcggtttcgtcggaaatatacacgccgacctgcggtttcgcaccttccgtaatcaatttgccggaaatagcggaatcggcaatcagattctgctcatcctcatgcgcgctccacaccatcacgtgtccctgctcaacagacgtggaaagcgccttgacatacgatttgaaatcgcccgcattctgcatgatatggtcgaacgcggcctgcgcggcaaccgcgaaatactcgtccgtctcctgcggagccatgcgcgcatacacgtcatgcagcaacgtttgggcggtattagtgccatccaacgtcgaaccgtcaggcatggcaacgccaccggtcaccgccagcatgttctgcaggaacagcggatcaatggcgatcacaccatcaaccgcaacgccatactggcgattccacatggcgctcacaatctcgccggtgcgcggaaaatcaggcgtgaaattcacgtcgcgaatatccttgccaagcttgtcggtaaacagcaaacgttcctcggcggtcaaatccacaaccggctcatcggcattctgaatttccgaatcggaaacgaacggctgcaagttcacgtgaccaccctgcaccgtgaccaggccgagcgatcccgtaaggccaccggacgggcgcgcctccgcattcgtttgcgcaagaatcaaataattgcgcggagcatcattcgcatggctttccgtgcccaacatgctgggcagcacctgcacgatggaattcaaggaatgcaccatgctgtcaagtttttcgcaatacgtttccgcggttttcagggcgtccgcgatctgcgcgatatgcggggttttcacggttttcacttcccgcgtggccttgtcgatcgtatcgtccgcgatttggagcggctgctgagacgcttccaatccggaaatttcgatcgtgccgttttccacgtgaatactgttcagatcaacattttcggcgactttcaccagttgcggcaacgcctgcgacgaaatattctccatggcggccaccgtggtgcgtacggcggaaatgtcattgcccacatacggcacgaccgacgccacctgccacagcggcgaagaggtttgcttgtaggccttgcttacgtgatcggagaacgcggttgtctgcttctcaagcttggacgtgtccgcttcggagatggtctgctgcaagccttgagcactcgacaccgcctgctgcagctcgtttttcacgtgcagcgcagaccatacgaatgcgccggcgaaaacggcgagggctgcgactatcacgagtacgccgattaggatcttgcgacggcgacgtttgcgcttgatttggcgaatatgctcggcgctcatacggcggcgcacgcggcgggaatgcggggcgctggaagtggaatcttctggactggcggttgcgtcggaggttgcggttgcgtcggaggttgaatcggcattagactgcggctcctcctgacggccttgctcaggctggacgccgaattcttcaggctgatcagacgcgccgttcatattccgtttcgctccctaattgtttgcaagcacttcggattccccagtgtaatagtagggggagtcgatgaaacctacggagcaaaaacggggcaataacggcggtattactgctcaactgttgccggtaacgcaagaactgatgcaacctaaacgtgacctgcaaaccagtattgctacaactcaagcatgacccgcgacggcagcattactgaaattccaacgtcgccaataatgccttgtggtcggaaccttgaatccgcttggtttccaaatttctggcgtgcacgcccctgtcgtaaataatgtggtcgatttcagcgatcgggaataccgaaggatacgtcatatgcaatccctcgccggcactctcccccgcatccgtaaagcgatcgcccaacaaatatctgaagcttgcatgatcccacgtggaattaaaatcccccatcagcacatacgattccccattatcgtaatgctgtaattgcgctatggaatccaaacttttattccataatccctgattgcttggtcgtggagaaaacggatgaaccgatccaaatcgtacttttctgccattgaaatcaactgtcgcggcaggaatactactggattcaataggaatgagatcctgcgttgtttcctgcagaggatgcgcactgtacagtacgttcacaccgccattgtcgtgccaagtgagttgcgcggaaacggaatacggaagataatcctcaattccagcatcatgcaaccgatctaataatcctgatgaaacttcctgcattgcaagaatttcaacatgctcgctttggattgttcgcacgatttgctgcgcatcggcacaaccttgcttcgtattgaacgtcatgacacgcactgttgcagaaggttgtatggcacgatcattggtcggaacgacatacccccaatgccaaataatctggatgatcacgcacaatacgcttaacgcgactaaaagttttcgtttgccgacagtgcgaaaaactgttgcaataattgcgataatcacggaaagcaagccaagccaaggcatgagtgcgacaatcaaaggcacgtaccgtttaccatcgagactgttcggcagcatgcgcagaagcatcgcgaacacgatgacggcggatgcgaaccacagcaacgccgtaagcagtgaagcgcgcgtttcacgacgcgtctcacttcgttggacatcgccaagtcgagtcatgcgcactcctctcccattccatcttcccgtttcacttcctattccgcgcaatccgcaatcgtatgcaatcacatgttgcaaccgatagtcttacgcatcgtttttcacaacatctctcacaacatctcttctcgtgaacgctacccgcgttcatccccgcatatgtttcccgcatgcattgagggtgatgctttcacaaaagtgccactatatggacactttccggcatttggaatcgttctgatacgttcatccgataatctataggttgcaaaacggtgcttaacaaaagaggcaatcatgagcgaagaagcaatgcgagaagaagtggcgcaagctgtggaagtggccgcaaacaaggccgccgaagaggaaatcagcaagctggccgaattcgaaagcgccatcgacgaaacgctcgcctccggatatttggacgatacgctcaccgtcaccgacgcagacggcgtggcgcaagtgctgccagtgctcgattccgagccgatctcacacttggtggaaggcttggaagccgtaggcgggagcgccaatgtgttcgtgcacaccagcgcaggcgtggtggccctcagcgtagtggaatacaagcccaacgaagaggagtagccgtcgcagcatgcacggtcaggcggcacgcctacggttgagggcgcgttgcacggtttcatgcgtggaaccggcaccctggccgcgcacgccgaagaacaccatcagcaccatcacgaagcagattgctgcactgatacgaagcgcccactgaatgccgaacacgttggcagccgcatacacggcttttgtgccaccaagcgcagtccaacgaagagacgtgaacgtctccatcaaaatcaccaacaccggagcgccaatcgcgcccgcaatctgacgaaccgtattcgtcaccgcggatccggcgctcacctcttccggttccaaacaattcagtgaccatgtggtgatcggcatcaacacgaaacccatgccgatctggcgcacaaactgccaaatcgacacccaccaaatccacgaagtcatggaaatcaaactcatcatgaccgtgccgaaacacaaggtaatcgtgcctatcaacgccaccggacgtgcgccgaaacggtcaagcaccttaccaccgaaaaactgcgaaatgcactggcccaaagcacccggaagcatcaccaggccgctaatcgcagcagaatagccacggcaatcctgaatgtacaggggcatgatcaccataatcgaactgaacgcgaagaacgagagcgcggccgtgatcgtgccaacagtaaaactacgattcttcaacacgctcaaattcaacagtggcggctgcgcttcaggattttcaatctgcctgcgcgcgccatgaatctggcggagcacaaaccaaataattcccacaacgccaatcaccattggcagccaaaccataggatttacaaacgaatacgattcaatattcgtaaagccgaacattagcccgccgaaaccgaaaatagacagtccaacggaaaaaaagtcagccttcgcggttttatcgttctcaccgaaattatgcaatccaaaataggcaagaagcagcgaaatcacgccgataatggtcaacgtgaggaaaattgaacgccaaccgttcaagtccgtctgcacaccgccaagcgtcgggccgatcgccggagccacgctcatcgccatgccaaccgtacccattgcgaaaccacggcgagacagcggataaatcgaaaacaccgtgatctgcaacaccggccacatcacacccgtgccaaccgcctcaagcaaacgcccgatcagcaccatcaaaaaagttggaccaagccaagcgaacagtgaaccgatcgtgaacacaaccatggaaacaagcacgatttcgcgcgtcgaaaaacgtctcgtaaggtatgccgtaagcggcaccatcacgcccatgaccagctggaaaatcgacgtcagccactgaccggtcgtaacggaaataccaaaatcactgacgatcgtcggcaacgcggcgctcaactgcaattgcgtgaaattaccgacgaacgtaataaatgtaagaatcgcaatggaaataaacgccgtgcgcgttaaatgaccgtcctgatacgattcctctcgagtaagcgctcgggacatgctccgcttcgctgacatcaatcaccttctccacattcaaacgcacaaactatatgatagcccgtatgacagaggcatggatattcgcctgcggattcctgtttttgtcatttcggggtaacgctcccctatttagaggtatcatggcacacgaaagaggtaggcaagttttcgacgcaggcagcgtcgaaggggggggggtggaggataatgacagtcagggccatgttccacatctgcatggagttgtggggtattttcatatgcctgatttgcgcaggcggaattttcattgcaaccccacacaaaaccagacgaactcgcatcaaaatactcatgcagatcgcctgcatgcttcttcttggaaccgacgcgctcagctggtattttcgcgtagatgcagacgaaaccgcatactatatggttcgcataagcaatttctcagtattctgcatcaactatattttcatgagtttcttcgcaacctatgtttggttgacagtgagcaaacatcagcatcgcaaaccagccgcattgcgtgctgtctacgcattatccgtaattggaattctcttacttatcatcacacaattcactggtcttttctactatttcgatgaccacaatctttaccatcgcggtaatttctatcttctttcgcaggcaattgcggtcttgggaatcgcattatgcctcttcatgttgatctcatatcgcaagaatcttgatcgcattattttcctttccatgatgtcgttcttcgtgctaccagtattggcgaccatctaccaagcactggcatacagtttttcattgcaatgtttggcgatcgtgatttccacacagattatgttcgtcatggacaccgtggaaatgaacatgcgattccactcgcaacaggccgcctacgaaaaagcacggtacgaagccgaacatgacggcatgaccggtttgctgaacaaggaagcgggatggaaacacatgcgcaaatatttcgaccgcatggattcgcacgacgaagcgatgctgatgttcgtcgacatcgacgatttcaaaaccatcaacgacacatacggacacacggtcggcgatttctggatccgcgaggtcgcatcccaacttcggcacatctaccggcaagatgacattatctgccgatatggcggtgacgaattcttggcgcttattcgcaacaccgccagcgaacaggtgcttgaaaccacgctgggcatgttcttccaacagttggcacgcacctcggaacagcacgggcaagacgtgcattgcagcgtaggcgtgtgccgcattgcagccgctgacggtgccagccttggcacggggcgcgccgatggagacgcgatcggaagcgtggatttcgaccaatgcgtcgcacaggccgacttggcgctgtacgaaaccaaacgattcaacaaaggaacgttcaccgtctacaactacgaccgttcccagccagcacccgcaaatatccgcgcctaaatgagcagcttcagctttccggcaattcctgcgctgggcaaccgtgcaatacggaaagcatcgcccgcttttcctgcgaagtgacagtcagcccgtacttgtctttcacgccaatctgccgggccacgtaatcgcaacggtattcactgttcgtcggcagccagtatgcggccgaagcggaacccttctgctgattcgcgggcccatccacggccagcagattgtacatgtcgttgccgaattggtacagcttcgcatgatcccacgtgttcgcgcccgactgccacgcattttccaacgcgaccacatgatcgatctgcaccgccgaagacgttttcactccacgtacgaattggatggtctgaccggtatacggatcgtcaagcgtgcccgacgcaacctggcagctacggccgttcttatattgcacgtccgtcagatcgcgcgcgagcacgtcttcgcgcacgtcgcaaccgttgccatcgtcgtcggtttcgcggaatccgaacgcatcgcgatcatatccggccttgctgggattgtcgtcgacggtaagtttttccaacgtttccgcagctgtgccggttgccgtgtactcgccggtgatttcgcctacggtcggattgactttcggcagcagcatgccgatagtgacgccgattaccgcaacgactaccagcaaaataagaatacgttccagcggaccgtcggcgttgatccaactttttttgaaccgtttgccggcccgctggatatcacgcacgtcgcgttcaatattccgataattataagaattacgattattctttcgaggcataattattaaaaataatacgaaattacggaattacggagtatcaggcgtacgtgaacgtcatcggatcatgtccggcgcgcgtcggaccgtcaagcgcgtcgatcgcggcatgttcttcaggggtgagcacgaatccaaacaaatcgagattctgcttctgccgatccgcatgcaccgacttggggatgatgatcgtgccattttcgatatgccaacgcagaatcacctgcgcaggggtaaccccatgctccgctgcgatgcgctcaatcgcaccatttccggcgttcaaatcagcaccgcgagccatcggcgaatatgcttccacggcaatgccgtgcgccttgcaatagtccacgacctcgcgctgctgccaggtcggatgcagctcaatctggttgacggcaggatattcgccggtctcctcatgcaagcggtcgagatgctcgggcaggaaattgcacacacccagcgtgcgcacgcgcccctccgcgcggaattcctggaacgccttccacgtttcgctggaacgccagtcgaacggggtgggccaatgcagcatgtacatgtcgacataatcgagctgcagcaagccaagctggcggtcgaacgccttgcgtgcgctgtcatacccctgctcggaatcgcgcagtttcgtcgtaacccacaggtttttgcgctgctcaccttccgtgaatcccgcattgttcagcgcgcgacccacgccggcctcattgttgtaccccgccgcgccgtcgatatgacggtagccggcttccagcgcactctccactacggaggtaacgccctcatcgtcgatacgcagcacgcccaagccgatttgcggaatcagattgccgtcgttcaatgtgaccatgggggtatggaaagttgccatgcgttgtcctttcgaaggctgtgtttcaggcgattattctcaaccgttcttatgcttgttccagcttagccgcaggtcgccgcaattcggccatatttcgtggcacatgcctcgcattgcgtcttgaaacggttcggacgcgccgttgcatgagtcgcgcatatgccgacagatgatatgcgcgtacgtaacataaccgcgcagcctcgtgcgctataacattgctcggataagagggcgacgaacatgaacagtacagacgacgcgaacgatatggacggcatgggaggcatggtcaatgcgggtgcgacggatggcgtggaatgctgggaaacggcacgggcgaatcacgatttctcttcccgccacgggcacgcgcttgccggcatgcttggacctgcttttgtggcggccgtcgcctacgtggatcccggcaatgtggcggcgaatatcacatccggcgcgaggtacggatatctgctggtgtgggtgctggtactcgccaattgtatgagcgtgctcattcaatatcagtccgcaaaacttggtatcgtcaccggaaaaagtcttcccgaaatcctgggagaacgacttggcgacggcggtcgattcatgtttttcatgcaagcggaagtcattgcaatagcgactgatcttgcggaagtaattggcggcgcaatcgcactgaaattattatttggacttccgctttttattggtgggtgcataatcggcattatttctacggtcttgcttatttttcaaaagagtgccacgcatcatatttttgaaaagctgattattgcattgctgctggtgattacttttggatttattgcaggcctttttattgatccaccaaatcctgcgcaagttttgcaaggtcttgttccgcatttcaaaggaaccgaaacggtattgatggcaacttccatgctgggcgccacggtgatgccgcacgcgatttacctgcattccacgctggtgaacgaccattacgtgccaggagagcccaaaccgagcgtaaagaccctgctacacggaagcaaaatagacgtgttctgggcattattacttgctggatcggtgaatcttgcactattgattcttgcggcgaattcattgcatggcatgaccggcacggatacgatcgagggtgcgcaacaggccattcagcatgtgctaggtccggtgatcggcacgattttctcggtcggattgctggcttccagcctgagttccacgtcagtcggcacatatgcaggcgccgaaatcatgcatggactgttgcggatcaaaacgccgatgtgggcatgccgcgtggtgacgctcgtaccggcgttggtggtgttgtggtttgctaagaatccgacggaagcgctgatcatagggcaagttgtgctgtcgatcggcattccatttgcgattattccgttaatgaaatacacgcacgaccgttctttaatgggcgattatgtggatggtccggtgaaattcgcgatcaatatggtagttgtttcgctgattgtcacacttaacgtgattcttgtaattctcacgctctccggtcgttcctgatgtgggtcccatttcggtgtccgcacggtcgaccggcgcagccgcgtccgcacagccgcctcgcgcagttgtccgccagtcgaccggtgcagctgcccgcgcaggaattgccggagcaccgaggttgattcgggtctgcacaaacatcgcgagctgcgtcgcgaagccaacgatacgaaatcaacggcacaaagggcgatagcgcgaaatcaacggtacgaaagccgacggcacgaaaccaacggcgagctacacgcgcgtggtggcgcgggcgatcacgtgcgactgggtggtgatgtaactcggctccagcacacgcgtgccgtcgatccggtcgagaatgcggctgaccgcagtcggcgcaatccagtcgagacaagaatccatggtggtcagcggaggctggaaatatgcggcttcttcaatattgtcgaagccgatcacctgcatctggtcgggaacggaaatgccgttcgcagctaaagtgaacagcgctcccaacgcaagctggtcattgaatgccacaatcccgtcgaaaggaattccggaatcgatgagctgttgcgtaatgcgagcgccggagccgatcgtccaatcctggcccgtgttcatcaccaatcgcgaatcgaattcgatacctcgcgcggcgcatgcttcgagcacgccgcggagtcgcagttgcgcattgccttcaatggcgtctcgtacggaatcaatgtgttccggttcggttcgagagcccaccaccgcgagtcgagttgctccatgatcgaacaggtattcggcggcaaggcgggcttcctgaatatcgtcgggggtaacgtggtcggctttgccgtgtgtggaacgcgcgcccacgcatacgagcggatagtccacgtccaagtccgccgcttcaaggttttcgacttcggagatcgacaggatcatgccgtccgagacggtggtgttgaagttgcgcaggagtgattgcgctccttgtgcggatccttcggcgtaggtggtgacgtatacggagtagccgtagccgcgggccgcgtcgattacgcggttggcgagctccgacaggtatggggcggtcaatgttggtacggcgagtgtgatgaaaccggttttgccgcggttgagattgcgcgcggacacgttcacgcggtatccgagtcggtcgatgacttcctggactttttctcgcgtggagtcggtcatacggccggaatggttgatcacgttggatgcggttttgagtgaaacgcctgcctcttcggccacgtctcgtagggtgacgcgttttttgtccggcttcggctccggctttgactcgcccatgttcgtctccgtgattgttgaatatgccggtaaaaagtttaccagttatggcaagcccgccattcttgagtttcagaatggcgggctcaggttgtgtgagattgttgtgttacgcaatcaattgcgcgaaattatgcggaattatgcgcgctttacgacgagtacgccgttgcgatgcacggtgtagctgcccgtctgttcctctgcttccgcttggaacaggtagattggttcgccttcgatgccctgcaatgcgatttctttcttgccgcgcggcagatagaaatcgaaggttgcgtcggcggacttgcgcacggtgtgcagtacgtcggaatcggtcggattggcgacatttgcggaatcttccacgatattctcgcgcacgaattccgtaagatcggcgacgttgagatcgcagccgacgaagtatgtttcgccggaaccgtacggattgcgggtgattgcggcggtgccgccgagttcccattcgtcggcttcttcaccttcgtaggtggctaatacctgcgcgcgttcgccgtcgacgttcacatcgttctgccacaggcgggtgaccgcaccggagctcaaacgaatttcggacggttcgccttcggcttccgcgccgagaatgttgaattcctcgccgcgaatacccagcatttcgcgcagcaggccgtctccggctcccgggtatccgccgagccaggtgtggaagttttcgtcgattagtccggttgcgtaaccgatgaccacacggccgccggcagctgcgaaatcggccaaacgctgcgtatcttcggcgctgagcatgatcacggtcggcagtacgacggtcttgtatgcgctccaatcgtatttcaacggcacaatgtcggcacgggtgccggcgttgaggaacgcacggtaccagtcgcgcacgtcatgccaatggttgagcttcatgctcggcagggtttcggagcgtgtggcccattcggattccgcgctgaacaggatcgccgtatcggactgttccagttcggcaccctgcacgccagcgtcgccgagggttttcagcgctgcgcccagttcgcacacttgacggaacagtttggtgtcttcgcccgcgtggggcacgagtgcggagtggaaggattcggctccgaatgcggaggcacgccactggaagaagttgatggcgtcggcacccatggccacatgcgcaatggagtcacgcacggtttcacccttgcgcttgcgtgcgttgagcggcttccactgcacggccgaagtggaatgttccatcacataccacggcttgccgagcgcgagggaatccatcaaagcgtcggagcagaacagttcgtcgatatgcgattcgccctcatggaagtaatggtcgttcgacacgaaatcgacttcctcggcccagtcggcgtagtccatgcagcactggtcggtggagaccatgaagttcgtggtgaacggcttgtcggggcagatttcggcgatggcgtcgcgttcggccttatagaagtcgagcagcatatcgttgccgaaacgctcgaaatcaagcttttgaccggggttcaccatggagtcggcgcccatgaaacgcgggatgagcacttcgtggaaaccgttcatttcctgaccccagaaggtggtgccccacgccttgttgaggttttcgatggtaccgtatttgcgttcgcaccacaggcggaaggcattgagcgcgttgtcggagtaatcgtaacggttgttccagccgtattcgttgcccatatgccatgcggtgacgtacgggttggtgccgtagcgttcggccagtttgcggcacagggtgagcgcgtattccttgaacaccgggcttgtcgggctccaggattggcgcgatcccgcgttgacgggatggccgaatttgtcttgcggcagcacttccgggtgcttttcgtacagccacagcggcgcggtggcggttgcggaggccagatcgaccgcgatgccggctttgccgagcttgtcgatgatgcggtcaagccagccgaaatcccaacggttttcttccggctgaatgcgatcccagctgaaaatggccacggccacggtattgacaccggcctgtttcatgaggcggacgtcttcgtcccacacgtcttccgaccactggtcgggattgtaatcaccgccgtatgcgatgcctttgccgttgtcggtcagcagttccggccatttgaacgtgcgatgcatggattactcctttgtgtgcgtatggcatccgctataacgccgaggatgccagctcgacagcttcccttcgaaagctctcgtaaaatctttttataaaatctagtatatatatttactaagatatttgagatggtcccggggatgtccacgatgacacccccgaggtcttatttttgttcttttcggacgattgccgaaaaatcggtatgcgctttaccgaaatttcagcatgcgaccgttgcgatcattccttgacggcgcctgcggcaaggccggactgccagtacttctgcaggcacgtcttctgatccaagtaggtatcaccctcctgcgtcttctgagcaagataggcgttaccttcctgagtcttctgatccaagtaagcattaccttcctgagtgcgctgcgccagatagtcatcgccttcctgagcacgcttggtcagataggcatcgccttcctgagtcttctggttcaagtagccatcagccttggcacgagtgtcagccgaatactgatcggcttcggaacgggtgccttcggagtagttgtcggcttcggtgcgagtgcggttggagtaatcgttggcattgccgatgagctcatcgtacctacgctgggactcgtcggtgatttccttagccttggctttgcccttgtcgacgtactggtcgtgcagctgcatagccagggtcagcatggcggtggcacgctccggctccgtgttggcgctggctgcggctcctgcaatcttctgcaggcttccggtttcggtactcggttcgaccttggcgacctgctcgcgcagctgggcttcacgctgctgcgattcctgcagctgctgtgcaagctgctgaatctgcgcggcctgctgctgggcacgctcatcctgctgctgggactgtgccgcatgctgctgcgtgagctgctgagcttgggcgacctgctcctgagcctcttcaagccttgcattgagctgctggatctcagccgcctgctgctgggccaccacaacctgctgctgtgcggaagccagctgacgggacaggtcttcggtctgtgcacggaatgcgtcgcgctcatgctgcatggaggtcagctgttcgcccagatccgcctggcctgcagcttcagccgcctgtgcggtgagctggtcgacctgtgcggacaggcgatccacctgacccttgagctgttcgttctgagccgacagagcacggttgctttcctcagcctcggtgagcttggctgctgcgacctgtgcggcctgagctgcctgatcaccagcgccagctgcctgctcggaggcggacttcaatgtcgcgttctcctgctgcagggactgaacctgggcgctgagctcggaaatcttggagttgagccccgcaacatccgggccgagggactgagtagcctggccgctggcaaccgcctgcttgccaagggcctccaccgtctcggttacctgatcgagaaaatcgtcgacttcatcgacgtcatacccctccttgaacctcacggtctggaaggtatgctctctgatatctttcggcgtcaacagagccataaatcttacacctcgctttgggcttgatgccttgctgttgttgctttcattgttcgactctagcacgggaccaccgattttttgcgaaaaatcggcatttgacatacattaaatgaggaaatcaatagcaatgagaatgaaataaagaacgatgaatgccacatcgaagtagatgggacccaatggaatagggcggatatattggcgtagccagcgcagtgggggctccgtcaactggtaaaccgcgtcgatcaacgacgacaccaacccccgtggacgccatgccgatgccaacacagcaacccaatcgagaatcatgcgaatgaacagcaccagaatgtaggcattcaccaaaaagtggacgatgctaccgatcaaagacaaaatcatggggcaccaccttagcaacagaacataacaaagcccccatcacgggtgacggaggcttcatgcagtctgctttcgcaacggctttcgtctatatcagtcggcgaacaaatcgtgcgacgagttattcgcctgcggttcctcaaccttgatgttcacctgagctgggctcagcaggaacacgcgcggagtgacacgttcgatggagccacgcacgccaaaaaccacacccgcggaaaagtccacaatgcgatatgccacggcctcggccacaccggtcaggttcagcaccaccggaacgccgtcgcgaatggcacgtccgaccagctgagcgtcctcataggatttcgggtgaatcgtggtgatacggctcacccttccgccttggaacgggttggctttggtctgctcgcgcggtgcggacgtcgcggcaggagtcgaagccatcggggtcacggaatggtcggaatcgaacgaggtttcgctgctctcagcctcttcgttgaaatcctcgtcaccttcggcaacgtcggtcatgcccaaataggacatcgcgcttttcataaaacctgccatgaacgatcctttcgcgtcttcgcgttgcttttagcgcaggaaatccggaatatccaaatcgccggcgtcgttcgaagacaccacttcatgctcggtggtctggtcgaatgacggaacgacgggttccggagtggacggaatataagtggacagcggctgcaccttcggggcttccggagtctgaataagctgaggctggggctgctgcggaaccgccgctgccctcggggctgcggacaacgccgacagcggcaccgtgctttccgcaggctctgcctgcttctgggcttcagcctgagccgccttcttggagttggcatcaaagcctgcggcgataacggtgacacgcacttcgtcgccgtaagcgtcgtcgagggaaagaccccagatgatctgtgcttccggatggatggccttgcccaccagctgggtggcggcggccgcttcctgcaacttcagatcggacgggccggcgatattgatcagcgcgccgtgggcaccctcgatgctttcttccagcagcggcgagctgatggcgatttcagctgcctgggtggcgcgatcctcgcctcgtgcggaaccgatgccgaacagtgcggtgcccgcgccacgcagaatagcgttgacatcgttgaagtcgacgtgaatgtacgagttcgaagaaatcaggtcggtgatgccctgcacgccggccagcaaggcggtgtcggcggtcttgaacgcatcgacgatgccgatggtgcgatcggaaagctcaagcagtcgatcgttcggaatcacgatcagcgcatcgacttccttgcgcagattctcaatgccaagtgctgcggaagccgcacgctggggaccttcaaagctgaacgggcgggtaaccaccgcaatggtcagggcaccctgctgatgcgcggcgcgagccacgatcgggcttgcaccggtaccggtgccaccaccctcaccgcaggtcacgaacaccatatcggcgcccttgagcgattcctcgatatcggactgatgatcctgagcggccttggcacccttctccgggtcggcacctgcgccaagcccgcggctggtggcatcgttcaaggagatcttgacatcggcgtcggaacgcatcaggtccttcgcgtcagtattgatcgcaatgaattcaacactttgaagaccctcggcaatcatgcgattgacggcattaccgccagctccaccaacaccgacaaccttgatattcgttttgtcgttgaaattgtcagtctgggcaatctcgctcaccatagtctcctgtcactcgcgtttacgcacaactttatcgcagacacgctgcagtacgcgcacttttcgccgtgtgtaacggcgttttttcacttttttattgctaacgtgttcatttcgcctgcgatttaccctctttcggtgcccccacgacgatttaaccacatcagcatgtcatattcaatagctggcgtccataggatcatccccaaacaacgcctgacgttcatcatgcgttgtttcccgtgattccaaccatccgtaaggcagatgcactttctttgcgaagcgcacgcgcccccttggcttgtcgaccactcgctcgggaaaacggatgttgggatccagcttgcctatttcggctctgacatcctcaagattttcacattccatgaacgcgcgacgggtggagcctccaacggggaatcccttgagataccacgcgatatgcttacgcagatcatgcacggccatctgctcatcgccatcatagaattcggtcaacagttccgcatggcgttcaaccacacggcacacatctcctaacgtggggtcaacacgcttgtcgctgccagcgaacgcattcttgatatcggcgaacagccatggcctgccttggcagccgcggccaatcgcaacgccggcgcaaccggtttcggcaaccatggcaagcgcatcgttcgcaccccaaatatcgccgttgccgaacactggaatgtcaagcgcttcgaccagctcgccaatccggctccagtcggaatgcccgccgtaatattcggcggtggtacgcgcgtgcaaggtcaccgccttgcagccttcctcctgcgcgatatggcccgcttccaagaacgtttcatgctcatggtcgatgccgacgcggattttagccgtcaccggcacgttggcagcatcgcagaccttgaccacacgctggatgatctcgcgaaacagatccgtcttccacggcaaagccgatccgccgccgcgtcgggtcactttcggcacggggcatccgaagttcagatcgacatggtcggccatgttttcgtcgatgacgattttcgcggcctgttccacgatcgccgggttcacaccgtacagttgcagcgaacggattttctcgctcggcgcgaaatggcacaaccgcaacgctttgggattgcgtgcgaccaacgcgcgcgcggtgatcatttcggccacgtatagaccgtccggtccgtagctttcgcaaatcacgcggaacggccagttggtaacgcccgccataggcgaaagcaccaccggggtttcaacgtgtaccggccctaaatcaacaggcttcataaccggaggaaccgacggcctcaccgcgtcggtacgcgggtcgagcacgtcggattcctcgtaagcagtcacaatgctatctggcataagaacgctatggtaaccagtatccagctttaatacaagccaccggcttcggcgatcttgacggactcaggccaagcctcgccgcccatctcaaccggcacctgcgggtaacgtacatgcttctcgccaatacgtgcggccacataatcagccaccttgtcgagtgcgacgcgctcctgctgcatggtatcacgttcgcgaatggtgacggcctgatcgtcaagcgtgtcgaagtcgacggtgatgcacagcggggtgccgatttcgtcttcacggcgatagcgacgaccgatcgcaccggcctcgtcatagtcgatcatccagtcatgctgacgcaaatcggcggccagatcgtgtgccacggtctgcaattccggcttcttgctcaacggcagtacagcggccttgaccggagccaggcgcggatcaaggcgaagcacggtgcgcttatcgacgccgcccttggtattcggggcctcgtcaacgtcgtaggcgtcaacaaggaaggccatgagggaacgggtcaggccggcggccggttcgatgacgtacggcacgtatttttcgccggtggcctggttgaagtagctcagatcctcgccggaatgcttggcatgcgcggaaagatcgaagtcggtacggttggcgacgccttcaagctcgccccaatcggaaccctggaagccgaacttgtattcgatgtcgacggtacgcttcgaatagtgggccagcttctccttcggatgctcataatgacgcaggttctccggcttcacaccaaggtcgatgtaccactgggtacgcgcgtcgatccagtactggtgccattcctcatcggtgcccggagccacgaagaattccatttccatctgctcgaactcgcgggtgcggaagatgaagttgcccggagtgatctcgttacggaaggacttgcccatgttggcgatgccgaacggcggcttggaacgcgaagaagtcatcacgttcttgaagtccacgaaaatgccctgtgcggtttccggacgcaggtagtgcagcgagttctcgtcttcgaccggtccgaggtgggtgcgcagcatcatgttaaagtcgcgcggttcggtccagttgccacgggtgccgcaatccgggcacacaatgtctttcaggccgttttccggcagcttgtcgccatgcttttcggcataggattcctcaagtttgtcggcgcggtgacgcttgtggcagttgaggcattcgatcagcggatcgttgaacacggacacgtgaccggaagccacccacacggccggcggaagaataatggacgtgtcaacgcccaccacgtcgccacgggtgacgaccatggaacgccaccattcgcgcttgatattgtctttcagcgcaacgccgagcggaccgtaatcccacgcggaacgggttccaccatagatttcaccggcggggaaaacaaagccacgacgcttggcgagggatacgacttcatcgagtttggatacagccacaatgcaccttctggtttgaacggtttggggtctttacaagcgcaaagcctacctttacgcggtgacagaacgccacccgcgttactgtttcgtggcgttctcgtcttcaaccgtgtcgttgtcgagcaatagcgaccagatcttgcaatcgatcaccacggcatttttcgtttcgtcaccgtttctgtcaagtgtgtaggtcacattttccggcacggcgatacggttgatgttctgcacggatgccacgaaattacgcatggcatcatagcttcccgtggcggtgatacttaccgacacctgcaccagctgaccggcttgaatggtaccttgcatttcagctggaatgtcggcgtcgaccgcatcatcgaaattcaccgatttgatggcgacgccggttcccgcagctgacgcatccaacgaattgatgaattcctgctggttatagccgtctggaatctgccgctgcaactggcgcaaacggtctttctgcaggccgatcgtttcgctggcgatgcgtaatgtttcgatttcgtcgcgtgtttccttattgttctcatcgatttgcgcagtttgcgcgtcggatgatttgatatggctgatttgcggggaaacgccgaccagccatgtcagcatgatgacgaagacaatacctgcggccaatgcgatccatgcgattttatgcttgttcatgattgctcccgatcattcattggatgtttcgtcagttgcggtcgcgctgtcggtagtatcagtcgactcccctgccgcggctttgttcaggctgtcgcgtagctgctgctgcaatgctcggttggcttcgtcagcaccggccgcgttgtcgcttcgtgacgtggtattggtatccatcttcaacgacaccgttcccgtgtatgtataggtggtgccgttttcatcgctgttttcggtaatggaactcacatagcctgttttataggtaggaattgcagcaaaattaccgataaaatcttttgcagatatgaaatctggagaaagaacggtaaaatcaacggaaatcacaccattcccagaccatactgaagatgtagcgctatgcgaagaagcgtcagacccgccaatctggaagctgctcaacgacaggttcgtgtactggcctccggctggcagcgcgccattgagcgaatccaccaccttcatccaatccatttcgtcgtagagcgcggcgatacgtgacctttgcgaatcggacagcgagttcaacgtgtcttccacgtctttgaattccgccttttccttctgcaacgacagggttttcgcctgtgcctcctccacgcgatggtcggcccagctcacgcgcaccgccatgcccgcgctgatggcaatggccgcaaccaccaccacgataagcacgtatgacagcaagtatttgatggcacgatcacggttgagcgtcacgatggaacgtggcagcaggttggcgcgcacattccattcggcgggcagatcagcctttttggaggttttcgaactgctcgcacgcagcgctttgccgatgtcggaaatattcatcgacaaaatcgaggttttctcgccatcactggtttcaggattcggattatccttgattttgccgcgtcgaccgcggtgggagctgccgatctgcttcatgcttccgttgttttttctgctcatcgtccgttcacctcggcttctttccgattaccagtccaagcactgcgcccaaatcgatcgcgtgcgccatgatgttctgccgttccacttctttggaaagccggaaacggatgaaggggtcgccgatccgcaccactttgttgatggaactggccaataccggcggcagtccgatcagccgtgcgccggttccggtaagcaccacgccgctgatggtgccgcccgcatggtccacgtcgtacaggttgagcgtattgcggatgccgacgatcagctgcgccgtggtttcgcggatgacttcctcggctttttcgagtcgttcgtcgccggtcacgttttgcaggccgatctggtttttgatgcgttcggcgtcttcgaatgagatactgagcgcgttggcgatggcgtcagtcacgtcatccgcgccggatggcacgacgcgcatgtaggcgggctgcccgttttcgagcacgatcacgtcggtgccgttgccgctgatgttgaccaccgcttcggtctgctgctggttggtgtcggcgaacagtctggcaagcgcgaacgggcccgcatcgatcgatgtgatcacaaatcccgcgtcttcggctgtgcgcgcggttttttccaatccgttacgcaatgtcgccacgagtatgccgtgcaactgtttgccttgttcgctgtcgatgacgttcaatggcacgaagtcgagctcggattcctcaataggcagcggaatcatgcctttggcttggaaaggcaaggtggatttcagatcgttcagcgacatgtagggaaagtccgtctcgcgaaacaccatgcgtcggctggagtagacgagagccgtgtcctcgcgggggaatttgaatcgcttcaccagtgtgttcagcagtccggccaccacatcatggtcgaccacttcgccatccactacggctccgttcggcaacgggatcgcctggaaatgcttgatggtgggcagatccgaatacgggtctgctatgaccgccgcacggatggcgtcgttcgcgatcgacagcgccgttattgatctcatgctctctccttatatataacgtgttgcaggttggctggggattggttcaggcgagtcccgtcacttgcaagtacagtgtggcgatcggagccccgacgaatatgccaagccatatgccgagcagcatggacggtccgaacggtatgcctccatgcatatcgacttttttgccgataatcagcacaagacttaagaatcctccaataaagaaggctgcgaacgccccgatgatgaattgcgaccatccgagccagcccgtaatcaagccaagtatgaacgcaagtttgatatcgccatcgcccatgccacctttccatatgatggaaagcaataggtagaacgcgccgagcactatcgcacatatcacagcgcgaccgagcctgttccactcattcgtaccgagtgatgccaaagccagcagtgccagtgttgcaatcagcgttggcaatagcacaacattgaggatcagatgatggtcgagatcaatgtatgcgatcacgatcgaaaccgctgcgaatacgtagagttccggcaatatccatggcgaatacgcgccgaatagcgcccccaaggtgacggcgaggaacgacagtccgcccaacgcttccacaatcgggtagcgtacggcgatcggctctttgcaatgccggcatttcgcgccgagcaccagccaagaaatgatgggaatattgtcataccatgcgatcggggcttcgcagttcgggcagaaactgcgtttcggatttaccaagctgatgtggttgggcacgcgccaaatcaccacgttcagaaacgatccgaaaatgcagccgattaccagcgatgccacgagtagcagcaccacagttggcgtatcgttcacaatgctcatgttcacatccatctcgcgcagcgctcaccatgcgatagtggacgggttcagttctttggatgtcacgtagcctttggtggaggatggctccaatgtggtagaactaccaccgccataaatcacgccgccgcctgagccgcctgttccgaggttaaccgaggcattccacacctgcgatttgatttctcggttcaaaaagtctcgtgacgatccgcatttggccataatcacgtcggcatgcccgtcgatacgtccggagtatgagggattgccgtcgattttgtctcccggatacacttccgtcaggcattgaccgttgagttggaacgtacctttactgtgctcgtcagacgctttttcgttgtatcgggtgaatgttggcgcagccgagcattccataagttggaatttgcccgaaccgccgaacccatagcaacgcttcgacccgttcaccatcgtccaaatctgcgtgttcacgccactgccgtcactcgacgtgtcttcaacatattcggcctgatcggttttacgcttggtggaatcggacaccccgcagtagtcgatctgatgcagatcggaagatgattgcgccggattgccattgatggtgttgtggtagcagtatgggttgaaatcaccgccacccactcggcaggttgacgtgtatgcgtcgaatccgtcttgcgatgacgaaatgcagaatccggacgtttcattgacgatctgcttcgtggcatagccggcttctcccgcctgtccgaacgatgcggtggcgtcttcgaaatcaccgttcacgtcgaaccaggatttcacgtcggtgagcgaataatcccacttcgacaccatcaggaaatgcggagtcaaatcgacagcatcatcgacgttggacgcccagtgaccgccgctcagatattgaatagtggcgcccacattcgccttgttggaaacttccagcacttggaagcgcgtcttcttctgcatttgcacaccgccgacggcatagccttgcgattccggtagagacgcatcatacttgttcgcctcatcgcgcacgctatctagctcgttgtagtagcccgcattgatgaaaccgttatagaacgcccacttctggtatttgttgagcaggcttgacggatcgttcttttcgtcttgctgcgctttcttgtcaggatcggtgtaatagtcgctttggtagttggggccgtacgactcgccgcatttctgcaatgtggcggctcctgcagtgcctccgccaacatgcgtaatgtcagctccggtaacgcacaatgtcagattggatgcagggcgaatggaatcatccttccaatacacccatgtgttcaggtctttgtaggcgccgttggctttgcactgttccgtgtaatacaggtcgtcgctgctggagtctttcttatgcgcttgcataagaatcaccaacgccgatccttccaccggcttgccgttcgggtcaagcatggcgtcaagcgtttcgaccttgtctacaggcttggtggtggcaagcatgcaagtttggtttgccggattcatagtgatggtattgctcatagcgtcggccgcattcttggacccaggcttgttgacatagttcaccatgccggtcggatcaccgttctcatcgacatcatatgaggcgatttccttccaggtcggctggttggtacggcgctcgttgtttggcgctgccgcgtagaagcccataccgagacgtccacccttggtggaaatcacgtagctgtcatcaccgctcgttgtctcgaattggtagatggcgctcatggctcggcgcgcgctggtttccgtacccgcgcttcgcccattcggatacctgttgatatacccgtaggaacgcacccacgcatatttcgcgttcttcagctcgctttcggatgtgagtcgtttggccggcgatgagcttggatcgtcgtcataatatccgatttgcactcggtacgagatatcgtctggagtgaacgagctcacgcccgttgccgacacgtcgttgctgacttccgcattgttgagcagcaccgacccgtccgatgctgtagtgaaggtctcatccaagctggcattgccagtgtttgatgcggtcgacggtagcagtttcttatagtccttgcttgcttccgcttcgcgcaggaaactcaatgccacttcgagtccagattcggcggcatacccgacttgcgcgttctccttattattcctgtacggcaatgcttgcgaaagcagtatggtcattaccagtgccgacgtggtgagcaccaccattacgaacagtaccgcgagcatcatggccgcgccccgctcccccatgcgttggcataatctggcacgatacctgcggttgaatccggcccacaatccgttcttcatgttcaaccttcccgctttcgcttacgcttgcccgttgatggcgtcgaacatggagaacatcggcatgtacaatgccaccaccatgaagccgaccacgctaccgagcaccagaatcatcaacggttccagcaacgaagtgagctgtttggccatggattgcgcttcttcgtcatacgctttgcccgcgctggcgagcatctggtcgatggcgccggaatcctcaccgatcgccaccatctgcaccatcatgttcgggaacactttttcggtacccatactgtccgccagcctatagccgcgttccacgagtcgagacactcgtttggacgcttcgtcgattacataattgccggatgtggatccgacaatgtcaagcgcctgcagaatgggcacgcccgaagcgagcatggatgtgaaattgttgcagaatcgcgccaatgccacattggtggtcagtttgccgaacacgggtgccttcaacgtgaacggatcccaccaggtacgaatgatgtctttgttgcgattgcgcttccaaaacatgacgaacgccaccgcgcacacaatgatcacgggaatgccaaccggtgcggccttgcccatatcaaccatgatctgcgtgacccatggcagttccgcgcccatcgacgcatacatgctgtcgaacatgggcacgatggtcagcagcatcacgcccaccagcagcacagcaatgccgagcaccaccaccgggtaagccagtgcgcctttgatctgaccttgcaaacgcacgtccgcttcaaagctgtcggccacggtaatcagggatttgtcaaggaagccgccggtttcgccggcccgcaccatgttggtcataatgggcgggaacagatggtcgggattattgtccattgcttcggaaaacgatgatcccgcctcaacctgctgcatgcagtcacgtaccgcattgcgcagtttcacatttccgatttgttcagtaacgatattcagtgcgcgaatcagggagacgcctgccgccaccatggtggcaagctgacgtgacataaccgcgaagtcttttttgcttggatatttttcgaacgctttgatttcaatattggtattgagaccggtgcctgcgttcacgtcaacaagttccgttggaatcagaccgagtttattcacgcgatcgatggcctgatctcgcgtctgcgcttcgataacgcccttctgcttggtgcggccgtcagcggaaacacccttgtaacgccacttcttggtgccggtttgaaatgccacttgcgcctgttccctggccattactcccccatggaatgattgacgaacaatggaacgaatatggatacggaacaaggtatcggagcgatacctcatacgctccgatacctttagtcccacgcgaattattcgctatgccttttattatttagtaccagtcttagagacgacaccgttggccgagtcatacaggaaaatcgctgtaccagagttctcgttctcgccctcgatagtgtaggagttatctgctttaccggtaatcttcagggtaacaccctcagttacggtaatcgtattgcctccaagcgtgcagcccgtattctggctcttactgcacgtggccgttgcaccattaatctcagacggaagcttgccattgttggcagtggacgcagtttcaaccacgaggctggcgttcttgacgtcggactcggtctgggagttccaggccgacttgcgctggttcaggtagatcggaacggagatggcggcgaggatgccgatgatgatgaccaccacgagcagctcgacaagggtaaagcccttttcgcccttggcacggcggttgagtgcgttgcgcacgctcttcataattgaatccttctttccttcgggaaaggtcgccgctcgcatcccacgatggagcttcgcggcgttcttctatcgatcgtccccttgtgggggctgctggctcacataaccaacagtcctaactttatccgcattgacatcgtttgcagaaccattattccggcgtcaatcgttttacgagcgtttcattttcgattcattttcccctcatccttcatccgtacaaaagcgtttcagcttaccccacaacccccttcacaaccatcagcaaatcacactttttcaagcggccacaaaaggtacaacacaaaaccaaaatcgtgcaacaaaaaatacaacaccacaaatagcttgtttttcagtacaatcgctcagcaaatctttgcagtcacgtttttttgaaaaaactggaataaccacccttttcgggcgtgtcgcagggtgctgacggggcgacaaaaaaacggctggccccataaggaaccagccgtctgccgcaagatctagcggaacactcagacacacggagtgaaatcgattgcagttccacccgatttcacattgcgtgcggtgaacgacgtggacgtattcgacgtgaccggcttgccgctcacatacgaccccgtcaccggcgaataacgcaccacccgattggtgccatccaccgtgaataatcgcgaggcgaacatcgaatcatcagacgtgcctcccgactcgttgttcattaccgaccccaacaccgcgcgcgtgctccatgacgtgacggacgcatcatacggcttcgtttttaccttcacgctaccgtaatcgcttaccgtaccgttcttccacgtggcgtcctggtacgtgatcaccacgcactgcttcgcaccagaatcccccggagtgaccatggtgatcgtatggttcgtggcgtcatactcaacaccctccgcgtatcgcacataccggtcgaggctttgcaccgacgtggctatttccgtggaagacctgcttcgtatcgcatccgcgctggtggaatgcaggtattgcacgatcgccgtggtgaacatggtggagacgatggcgaagatgaacagcgacaccatcatctccaccaaggtgacgccgctttcaccgcgcgccatacgttgcgcgacggcgcgaatacgcagttttccgcttgttgttccgctcattgcaacccctcactagatgatgagcttgttgtcgacgccaatatccagcagttccgacgtggtgtacaggcaggttttgccctgatgcatgttgtcgtcccaggtgacgcccaccaccacgcggatcatgggcatatacgtgtgcgcaccgaacgtgaacgcgcccgataccgttttgcccggatccaggatgtcggccgtggcgcttgttgaggtattggccgtatagctcgttgcggaactacgggaaatgcccagctgagatgcggtcttgcacgagatctcgccgctggcacggaaacagcgctccaccaccgtgttcaccgtgtattcggtatgcttggcgtccttgcccgcagtggcacgaaccggctgaatatacttgctcttgtctggatcaggcgaactggtatagctcagatccgccaattgcgacgtgacggcgccaacgtcggaaagattcttttgcgcggcggtgacggacgtttcccccatgcctttgatgagttcatcgagatattggttggcgtctacattggcgatctgcgcacgcattctttccatgccgtcgtcgcccagcgacacggcggtggaccgctgctgctgcgcatatgacgtgcgaatggccgtgatggcgaactgtgcggcggcaagtcccgtgatgctcaacaccacgatcgccaccagcacttccaccaacgtgaagccggactcgccacgttttggcaatcgattgacgcgactcgccgcaacccctgaatcgggggcgtctcccgctgtgcgcaagctgtactccatgagcagctccttcacaagatgccaccccatcattggaagcggcaggaattcggcacgcaaccaaacgcggtgccataaacatgagttactgtatcacgatattctgccaacgttttcacagcaacatatttctcaaaaaactttgccccgattagcttttacctgtttttgcggctacaatgctgatttagcagtacacaatactgcaatcgttgtagctcacatgacttcgaacaactgaacatcagccaccccacaaatgctgccgtttgcttggggtttcatgttatgccgtatgacaggcgcataagcgcgcatgcggtgcaggaggtcattatgagcgacgccggttcgggaggccgtttccccttcctcaggcgaaacaaaaacagcgacacgccgaacgctttcccgcaaagtatggatccgatcgcgccgacaaccggcgagatccatcaggtgttcacgccgagcacaccacgccatgcggcaatgacaagcgacgtcaccggagattttcccgccatgccaacgtccaccgaaggcatggacgaacagaccgaacgccaatatgccatggcgttggcgcaaggcatgagcctgccgttcgtggacctcaacgaataccagatcgacaaagaagtcatcagcatggttcccgacgatctgtgccgacgcaaccagcttctgccgctttccatcgtcaacgggcgcatcgccgtagccatggcgaatccgaaaaacttcgccgcggtagacgatgtttccgcaacaaccggcatgcccgtcatcgccatggtcgccataccatcgcaggtacgcgactgcatcaaccggttcctgcgcgccaatgcggagttgaccgaactatcgcacgagatcgccgcgaccgcgaaaaaagaagtcgaccttgaacaagacgacagcgaagatgcctcccccgtggcacgcttcgtaagtctgctcatcaaccaggccatcgacgaccactgctccgatatccatatcgaaccgcaggaagacggtctgctcgtacgctaccgcatcgacggcgtgttgcatatcttccaaaaagcgccacgcgccatgacccaaggtgtgatcagccgcattaaggtcatggccgaaatggatatcggcgagcgccgcaagccgcaggatggccgtattaccgtacgtcacaacggtcagaaggttgatcttcgcgtggcggcattgcctacggtgtggggcgagaaaatcgtcatgcgtattttgagcacgccttcgggcaatctcaaagtagaggatctgaatttcagcgaacgcaatttcgatgtgttttccaaagcgtacaaccgcccgtacggcatggtgttggtgactggtccgaccggttcgggtaagtcgaccacgttgtatgcgacgttgggcgatgtggcccgcccggaaatcaacatcatcacggttgaagaccctgtggaattccgcatggagggcatcaatcaggtgcaggtgaacaataaggcgggtatgacctttgccgccgcgttgcgttcgattcttcgtgccgatcctgatgtggtgctgatcggtgagattcgagacgaggagacggcgaccattgcgatcgaggcttcgctgacgggccatttggtgctgtccacgttgcacaccaatgatgctccgagtgcggtgacgcgtttgacggaaatgggcgtggaaccgtttttggtgagctcgtcgctggctgcggtgatggcgcagcgtctggcgaggcgcctgtgcaagaaatgccggaaggccgatacggccactcccatggagttgaagatgatgggtgtgccatatacgcccggctctccgttgccgaccgtgtaccgtgcgatgggttgccgtgaatgttccaacaccggatatcacgggcgtgtggccattcagcaggtaatgggcgtggacacgcagatggaggatttgatcgcgcgtggcgccacgtcgctggaaatcgagcaggcggccaagtcgaaaggcatgacgtcgcttcgtgaggatggctggcagaaggttctgcaaggcattacttccgtggatgaagtgcttcgcgtgaccgtgtagttgtgtaatcgtgtgaccgcgttttcaacatatgtaaaggacaatgatgaccgatattgaacagcaacccgagctgaaaaccgaaatgaacaccgcgacggatcccgatgcgcagccgacttgggatgcgaacaccgatttgtctggtttgaaaggtgtgaccattcccagtaccgctccttcattcaacgaggatccgcgtaggggacgccattggtcgcccgacaatgcgattcaggctgacgatgacagtttgcgcaatattttcgcgtcgcttgacgccatgcccgcgttgcggcatggttccggtaccgttcccgaccccatgcctaaggccgcggtcgagcaacagccggcggccgagcctcaacagagcgcacagcggcagcctatgcaacagtcagctgccccgcaagccgttgcatcacaatctgtagcggaaccgcagcccgctccgacacggcctgcggaaacaccgctcattgcagaacaacaggaactctcctacgacaccgcttttccggaaaccccggaaaacgaagccgtggatcagcagaatctgcaattcgacgatgacgtgacggaagtcacccctgcattcgagtatcatggaccgatccagcaaatcgacggcgatccgccatcattcattccaggcggcacgccgttcgcgcaacagccggacgactatgcggcgtacgaggagaacacgcagaccatgcagccttccgccatcaaccatattgcgcagcctgcgcccgctgccagaccgcaacccaatatgaacaacaggctaatcgtggatttcatagtgcccgaaaccaatgattccgacgaggacgctgttcccggacaacgcagaatcaaagcgcaacaggtcaaagaaacattgcatgccgaacatcccgatgcggatccggaattcgtggctgccatatgccagctggtggaattgaacgcgtccgatcttcatctggtggtcaacgatccgccaatgctgcgcgtggatggcaagctgcgccccgccaaagggctgagcgtgtggaacaaggaccgcacgtatgaagccatcaaagtgatgaccaacgagctggagatggaacggttcaaagacgatttggaacttgatatttcattctccatcggcgatctgctgcgattccgcgtcaacgtataccgcgaccgtttgggcgtgtgcgcggcattacgaaccattcccacggaaatcaaaaccgcgcaggagcttggtctcgacccgcatatcgccgatctggcgttactgccgcgtggactcgtgctcgtatgcggtccgaccggctccggcaaatccaccacgctcgccgcgattgtcgacagagcgaatgccgaacgcgccgaccatatcatcaccattgaagacccgatcgaattcgtgcatcaacacaagcgttgcgtgatgagccagcgtgaagtgggcaccgacaccaaaagtttcgcggaagcgcttaaacgcgcgcttcgtgaagatcccgacattatcgaagtgggcgagcttcgagacctcgaaaccatttccaccgcgttgaccgccgtggaaaccggccacttggtgttcgccaccctgcacacgcaggacgccggttcgaccgtggaccgtctgatcgacgtgtacccggaaaatcagcagcagcagattcgcgtgcaggtggcctccactctgcgcgcggtggtcgtgcaaaccctgatttcacgtgccagcgggcatggccgcgctcctgccaccgaagtgatgatcaacactccggccgtggccgcgttgattcgcggaggcaaggcgcatcagattcgtaccgtgctgcaatccggcgaaaaggaaggcatgcatacgcttgaccaagatctggcgagactcgtcaacaagggcgtcatcaccttcgaagacgctcttgccaaggtgcaggtcctcgaggaattcgaaaaactctgcggcgcccgctcctccttctaacctcgccgtacccatacaccatctttacacctatcatgagcaacacagcagaaacaccaaccatcatccagcccgacatttcggcgaaccgcgcgacgaaccttcgaaaaagactcttcacctggttcgccgaacaacggctgcactgcattgtcttcatcgcctacgtgacagtgaccgtcaccgtgtcgtgttttcacgaaccatggtttgatgaggcgcaagcctggctgatcgcacgtgattgctcatggaaggaactgcttaccgtacgcacccattacgaaggacacccacctctttggtggatgctgcttgccattcccgccaaacttggcatgccttacgaaataggattgaaatccctcaatcttatgtgcgccgcgctgatgatctggcttttggaattcaaaacgaaactaccagaattactaaaggtaatactgccattttcctattttctttgctaccagtatggcgtaacttccagaccatatgcgcttatgatcgccgcaatgctgctcatagccatcaattggaacaaccgcaacaccaagccatggccagtcatactcagcatgatgctgctatgcgccacgagctcttacggattggcaatcgccggcatgcttgccttgaattggacgattcaatttctctgcggcgaacgctcgcttataaaaaacaagcagcgtttcgcgggacttgttctgctactggtattcgccatcatactgctcctcaacgtactccccgcacccggcacataccacggtgactttgacatacatggcactgcaacaacatcacccgcatgggtttccgtattcaacacctggctggtaatgccttccgagacgttgttcacttcaaccctgtcggatggcaatatgcagttcatcgctctcacgccaagcgagctgtttatgccgagcgtaatgtcatgcctgatgtggtgttttcttattcagatttgcctacgccggaaaaccgcatcattgctgctcaccacatacttgggtataagcgttgcgttcaccgcgcatctttccatgcatcatgcgggaatcatcttgggattcttcatcgccattctcgccatcgattgcgatatcgaaaaaatcaattccaacgattggcctcagtggatccgtaatctcaacaaccgtgttatgactcttcttggaccgaagaaaacggaacggtatctccgtttcttcaaaatcctcggtcttatcttcatgcttgtcagcgtgtattggacggcaagcgccagtatttgcgatattcggtacgactattcgtcttcccgggcggtagcgtcttttatcaaaaccaaccatttggagcaataccgttggatggcaggctggacacgcgtcagcaagaacgacaccgcttccaatccagaaatcaacaaaatcatcgacaaaggcggatattgcggcggcaccgactgcatcgactacacttcttggtacggcagcacccttatcgattcagccccttacttcgaccatacgcttcttgccaatgcatacaagggacgaagctattcgtcgtgggaatggtgcgttgacccctatgcgggaaagaaagacatcgaaacatggaaatcgtggggcgaacccgaattctacgacactctgtatcagccatttttcttctccgaccttggttacgacagaaaccattacacgaaaatcaaaatcgccgaaaccaagacaccttggaaaagcacatggtcggaaggcgcctgcgaaatttacgtgcgcaacgacatttacgagaacgtattgcattcgcccgatcctggaatcgactggcccgacggcgcaacgcgcagataacaagtggaccggcatccaactggaacgtgtcgattgttcgtttatgcaaaacgtgccactgtcagcacctttgtataggttagatatgttatgtacatgcaggggggcttccggcgaaagcggaagctgagataggcaaatgcctgaccctttgaacctgttggttaggaccaacgtagggagcagacaatgggcgatgactcatatgcagctgcattgcgtgaacagattgcgcaggcagtaaacgacgtacgcgaaaccacacctttggcacagtcgttcaccaatttcgtaacgatgaatcttgtggccaacgcgcagctggccgccggcggcaccgcagccatgagcttcctgcctgacgacgtgatcgacaccgcggaaatcgccggatcgaactacatcaatgtgggcacactcctgccgttcttcaaggacgcgctaccggaaatcgcctacaaactgcacaagaacggcaagacgtgggtacttgatccggtcgccgcgggcatcggcaaaacccgtaccgccattctcgaatcgttccgcacatacccgccgaccattgtgcgcggcaatgcgagcgaaatcatcgcgctcgatgcgatgtggggtttggcacagcatgattccaccgttcccggcactcgcccggcaggcgcggaagccgtcgacgaagtcgattccgccgttgacgcggccaaacgagtggctcgtcatcttgcgaaatactcccctgttggagccggcgcggtggccgtttccggagcagtcgatctggtgactgacggcgagcgcgtgttccgtttgcccggcggcagcgcgatgatgacgaagatcaccggcgccggctgttcgctcggcggcgttaccgcaacgtatctggccgtggccgaaccgcttgtcgccgcgatttcggcatcattgctgtataacagggcttccgaaatcgccgaagcgaaatcgtccggtcccggatctttccaagtggcgctgcttgacgcgctttggaacgtcaccgccgaggaagtcgccgcttccgaaatcatcatcgactaggctttgccgaaccctgcatggtattcggcatatcatgcggggttcggcaattgcgtatatggaaaatatggacgattgccggttcacattgtaggttttctgaatcacttaccgagaagggttgattatatgaacaattattcatatgcatcgatgcgcgatacattcgatatgagcgcctactttgtggtcggcccgcaggattgcaagagccgtactattaccggtgtgattgaggatgcgttgcgcgggggtgcaacgttcatccagctgcgagccaagaacaccgacgcgaaagacatcaccagcatggcacgcgatatcgcgcaggttatcgagaacaacggcaaatccgattccgtggcgtttgtgatcgacgatcgcgtggatgtagtttggcaggcacgtcacaagggcatcaaagttgacggcgtgcatattgggcaaaccgacttggaaccgcaggaagcccgcgcgttgcttggggaagatgccattgtgggcttgtctgccgaaacggaaagcctggtgaagctgatcaacgagctgcctgccggctgcatcgactacatcggggccggcccgttgcacgtgtccaccaccaagccggaagcttccgttggtggcaacgatggttccgggcatacgctcgacgaggcgcagatcaatgcgatctgcgatgcgagtgattttccggttgtggtcggcggtggagtgaccgccgacgatatggagatgctcgcacattcgaaggcggccggctggtttgtggtgtcggccattgccggcgcaagcgatccggaagaggcgacccgcaatatggtttcgcgatggaaggcagtgcgcggtgatgcaaagcatgggcacgtactgcgcaaatagcaatcacggatcacgaatatttcagaacttcgcatcataagcaagcaaaagcaagtaaggagtcattcatgaccagcactttggcaccggtattgagcatcgcgggatcggattcctccggtggtgccggcattcaggcggatttgaaaaccatgcttgccaatggcgtgttcggtatgaccgccatcgcggcgctgaccgcgcagaacaccacaggcgtgaccatggtcacgaacactcctccggaaatgctcgccgcgcaaatcgacgcagtatttgaagatattccgccggtcgcggtgaagatcggcatggtgtcgagcgtggagctcatcaacgtgatcgccgaccgtctgattgcgcatgatgccacgaatattgtgcttgatccgataatggtggcaacgtccggtgcgaagcttatcgaaggcgacgcgattgcggcactgacttccaagctgttcccgctggccaccgtcatcacgccgaatatgccggagacccaggcgctgtgcgagctggccgtcgaacagggtgccgacgcgatcgactacgagaatggcgaaagcatctccagtgagaacgacatggtgacggcaggccatatgctcgccggccatttcggctgcgcggtgctcgtcaaaggcggtcatggcacgcaggatgccagcgatgtgctcgttgaaccgagcggcaaagtcacttggttccgcgcgcgtcgtatcaataatccgaacacgcatggcaccggatgcacgctgtcttcggcgatcgcatcgcatctggcgcttggcgagacattgccggaagccgtcgatagtgcaaaactgtatctgacgggcgccttggaggcgcagcttgacctcggtcacggatccggaccgatggatcacgcttggaaatggcgctgacagccaaatccgcaccagccaatccaagtcgtatcaggccgataggaacgcaacgaaaggaacgaacatgacccttgatcgcaatgcggaaaagcaggaagtgccgatcaacccggaaaccggcaaaccgtatatcaacacgcttgccgcagtcgccatctcccccgccggcgcaagccctgaaaagtccacgtacgtggcgcaggcggtcgacgtgatccgtcaatccggattgccgagtgaaaccaacgccatgttcaccaacatcgaaggcgacatcgacgacgtgctcaaggtgattcgcgacgccaccatgaagctggctggccagggctatcgcaccgacgtggtgatccgtctcgacattcgcccgggtttcgaaggtcagatccacgccaagcaggcacttgtggacgaaatcctgtcggaataaatcaggcaataaactgttagatcgtcagaaaaatcgaaaagcgcgctatttataaggaatggcgcgcttttcttattgatttgggtatagtgtagcgaatatgactacgatgaaggaaattgccgaagcgacaggggtgtccatttccactgtttccctggtgcttaacggcagggatgaaggacgtgtgaaagcccctttggccgcgctcgtacgcgagaaggcagacgaactcggctacacggtcaatcctctggcgcgcagcctgcgcacttgccgcacgcgaattctcggcttcatcagcgaggaagttgccaccacgccgtacgcaggcggcatcattctgggcgcgcaagacgcggcaagcacctacgggtacatgatcatcacggtcagcaccgatggcagggcgagcgaagagaacgaaatcgccacgctgaaacggtatggcgtggacggtttcttctattcgaagatgtcgaatcgcattgcgagcgtgccagcctcgctcggcgattatccggtggtgatggtggatgccaccgatgccgacaaccagattcccagcatcgagccggacgaattccaaatcgcctatgatgccacgaaacggctgattcaggccgattgcaagcgtatcgcctacatcggatgctcggaaaacatgattgcgcaggatggccgttttgccgggtatcaggcggcattgcaggattccggtttcgcctatgatccttcgctggtatgcaatgtgctcaataatggtcctgcgttgcgtgccgtcgacaaactgtttgacgaacgcaatcccgacggtttcttttgcttcaatgatgcgcgtgcatggtatgtgtacgaatgtgcggcacgccgcggactgaccgtcggcaaggacgtttccatcgtcggcgtcgacaaccaccgcgtgttcgccgaaacgctggaaccgcagctgaccacggtggaactgccccactatgagatgggttattgggccgcatgcaagcttatttcgatgatcgaacgcaagcccgtcgacagttcgtcttggccgaataccaccgctcccatgccgccgttggattcgccgattcctgcgaagatccattgcgcgctgatagaaaagggatcggttcgcagctaagtttcgcgatctaagaccacatgaaaggcctgttgacgtgtccgttacgacacgccgagaggccttcttttttcatcccccatttcggcttaattccaacacttccgaaaagcgttggaattacttacgtcaatcgattgacgtcaatcgttttacgcactattatttaaccatgttcatccacttggcacggcagctgggtgaatgacggcataacacaacatcggcacacaaccgaggtgccgcgcggcagcggcacaaacaaagagaaacagagaaacaacaacatggcaagtacaactcgatctgcatggaagaatccttcctacctgcagagctccttcggcatcttcatgttcttctgctcgtggggcatctggtggtccttcttctcccgctggcttaccgacccggcccacggtctgggcatgacctccgccgagcagggccagatctactccatcaactccctggcaaccctggtcatcatgttcgcctacggcgccatccaggaccaactgggcatcaagcgtaagctcgtgatcttcgtctccgccatcgcagcgctcgtcggcccgttcgtgcagttcgtgtatgccccgatgctgacagccggcggcaccacccgtttcatcggcgtgctcatcggctccatcgtgctgtccgcaggtttcatggccggctgctccctgttcgaggcactcaccgaacgctactcccgcaagttcggcttcgaatacggccagtcccgagcttggggctcattcggctacgccatcgtggcgctgtgtgcaggcttcctgttcaatatcaacccgctgctgaacttctgggtcggctccatctgcggcctcggcatgctgtgcatctacgctttctgggttccggccgagcagaaggaagagctcaagaaggaagctgatccgaacgcggctccgaccaacccgtccttcaaggaaatgatttccgttctgaagatgccgaccctgtgggtgctcatcgttttcatgctgttcaccaacaccttctataccgtgttcgatcagcagatgttcccgaactactacgcttccctcttctccaccactgaaatcggcaacgccacctacggcaccctgaactccttccaggtgttcctcgagtccgccatgatgggtgttgttccgatcatcatgaagaagatcggcgtgcgcaactccctgctgctcggtgcaaccgtgatgttcctgcgcatcggcctgtgcggcgtgttccacgatccggtcagcgtctccatcgtcaagctgttccactccatcgaggttccgctgttctgcctgccggcattccgctacttcactctgcacttcgacaccaagctgtcggcaaccctgtacatggtgggcttccagatcgcttcccagatcggccaggtgatcttctccaccccgatgggcgccctgcatgacgccatgggcgatcgcccgaccttcttcaccatctccggcatcgtgctggcagccctgatctacggcttcttcgtgatcaagaaggacgaccaggaagtcggcggtgatccgttctacaccgacaagcagctcaaggcccaggccgctgcagaagcgaatgcctgaacgcaatcgcaagtccagccaagaacataactgaatcgtgctgctcgaagcgtttcccctttttccgcttcgggcagcattcttacaacttttactcaaaactcaataagcagcaattcaacaatcacaagaaaggctattcaacgatgactggcttcaccccggacgcacccgtccttcacgaaatcaagaaccacagcgaagccctggcacaggcggaagcaggcgttgcagccatggccgccgaacgcaacaaccgttggtatccgaagttccacatcgcatccaacggcggctggatcaacgatccgaacggcctgtgcttctacaagggccgttggcacgtgttctaccagctgcacccgtacggcacccagtggggtccgatgcactggggtcacgtctcctccaacgacatgctcaactggaagcgtgagccgatcatgttcgccccgactctcgaagaggaaaaggacggcgtgttctccggttccgcagtgatcggcgatgacggcgagctcaagttctactacaccggccaccgctgggccaacggcatcgacaacaccggcggcgactggcaggtgcagatgatcgccgaaccagacaacgacgagctgaccagcgccaccaagcgcggcatgatcatcgattgcccgctcgataaggtcgaccaccactaccgtgacccgaaggtgtggaagaccggagacaagtggtacatgaccttcggtgtctcctccgcagaaaagcgcggccagatgtggctgttctcctccgatgacatggttcgttggacctacgagcgtgtgctgttcgaacacccggatccgaacgtcttcatgcttgaatgcccggacttcttcccgatcaaggacgccgagggcaatgagaagtgggtcatcggcttctccgccatgggcgcaaaggcctccggtttcatgaaccgcaacgtttccaacgccggctacatgatcggcacgtggaccccgggcgaggcgttccagccggaaaccgagttccgtctgtgggattgcggccacaactattacgctccgcagtccttcaacgatggcgagcgccagatcgtatacggctggatgagcccgttcgttgagccgattccgatgcaggatgacggctggtgcggcaacctgacccttccgcgtgagatcaccctgggcgccgacggcgatctgcacaccgctccggttgtcgaaatggagggcttgcgcgaaaacaccaccgatttcggtgcgatctcgctggacgtcaatggcgagcagaccattgctgacgatgccgaagccgtggaaatcgaaatgaccatcgatctcaacgcctccactgcggaacgtgctggtctgaagattcatgcgaccgaagatggcgcttacacgtatgtggcgttcgacgatcagatcggtcgtgtggtgatcgaccgtcaggccgcagcccagggtgatcgtggctaccgtaccgcgccgctttccgccgaggaactggcttccggcgagctcaagctgcgcgtgttcgtggatcgcggctgcgtggaagtgtatgtgaacgacggccgtcaggccatgagctccttcagctacgcttccgaaggcccacgagccatcaaacttgttgccgaatccggcacgcttgaggtcaagtccttgaagctccacaccatgaagtccatcggactggagtgaagctgatccagggcagtagcaaggggtaaagagtaaggcgggtttcgtgtcgaatgagatacgaaacccgcctttcgttttggtttggaacgtggtttagggagtgctttatactaacaccccggtaatgaacttttctgaccggaacgcgggcaggctcctcaccttactgatttctcgccaccggtcacgtgcgcgcccactatggcgcagaaagcaaggtgaacgatggcggtttcgcacgttcaacgcagggattcggcaacaggatccataccctcaaacacgagttcgcacatgggttcaggcatggctgcgaacacgaattcaaaagacggcattgtcgcaaaacttctcgaagctttgtccgcctttgctcacgtttgcaaacgccgtattcccacggttattgcagtagtgctgttgctggcggtatgggaggcgtgggtccgcatcggcaatgtgcccagcaccatgatcgccgcgccaagcgaaatcgcacaggccaccgtcgaaacatggtcgacgttatggcctgccacgcaagtcactttgcttgaaggtaccgtcggattcctgttcgccgtactgttcggcattctcatcggcatactgctgtactgctcatgcattgcgaacgccgcattgctcccgttgctttcagctgcgcagaccatgccgttgatttccatcgctcccctatttttgatctggttcggttttgaaatttccggaaaaatcgtgattgtaacggtattcggcttattcccgattgcagtgcagacgattcgcggtcttgaagcagtcccccagttttattcggatgttgcgctgacttgtggcgccacgaaatcgtggacactgtggcatgtgaagctgcgtgtggccgctcgtcagatttatggcggcatccgcgtttccgccgcatacattttcgccactgccgccaccgcagaatatttgggtgcacgcaagggtcttggcatttggctacaggcagcatacaactcgttccgcacaccgctgatcttctcggccacgctggtcatcatcgccatcaccggcgttctgatgtgcctggtgaacctcagcgaacgcgtcctgctcggcccagctgatgccgacgccgatcccgatgcagaccagtaagtcaaacacgccaaacatcatcggccttctgcaaacgcagcattcgcagcattcgccactccgcattgcatgtcggtcacgctgcctacgtataataaaatccgctgttaagccaatgtgtggcaaaccggcaatattccacgcctttcactaggcaccgtaaggaatgtcgggggcattggacgagcgggggcctgaggcccttcgtatcgttttctgcccgaactccgctcgcagcatatccctagaaaacgatagagaatacagattcaagggaaatcgctttatgagcatcttcagcaggcatgacgccaccgcacgtactcacatcgcaagcacaataatcgcactcttcagcgcaatcgccatgttgttcagcgttaccgcatgcggacaaagcaacgattccgtaacaagcacagcatctggcagcagcgatctgaccaaagtgaccttcatgctgtcctgggcgcccgacaccaatcatatcggcgtatatgtggcgaaaaacaagggttatttcaaagaggcaggtcttgacgttgatatcgtggccgtggcacaggccggtgccgaacaggccgtgaacaacggcgtggccgacttcgcattgtcgaacctcaccaacgtaagcacgtacgctgttaagggcgcaaccatcaagcaggtgctgcaggtacagcagaagccaagcgccatctggtgttcgctcgcttccaacactgaaatcaaatccccgaaggatttcgacggcaagactttcgccacgttcggatccaacgaatccgatgcggtgatccgtcgcatgattcagtcggacggaggtaagggcgaattcgacaaggtgaccgtcggcacgtccacgttccaaacgctgtccagcaacaaggctgatttcggtggtttctatgccacttgggagggtgtgcaggccgacatgtacggtccgaagctcaactgctttaccgaaccggattacggcgttcccggcaatgccgacactattggcgtgatcaccagcgacaagacgatttccaacaatcccgaactggtgaagaagttcgtacaagccaccaagaagggctacgagtacgcatattcgaatcctgacgatgcggcgaagatccttgtgaaggaagctcccgacgcgaatctcaagcttgatttcgtcaagaaaagcatgaaaaccattgtggacggccagtattggggcgatcccgccaagatcaaggatggttcgttcacgttcggtacgaacgacgttgaaggcgcccagcagtatttcgacttcctcgctcaggaagacgcctacaccgattcgcatgacaaggtggtgcacgacgctccgcaggccaaggatctcgccaccgacgagttcctgaaataatcgggtttgaacgagtaggtttgtaactcgtttatgtgcgaataatcgaaatattggaatacggcatcctgcatttttatttcatgcccaacactgcttgctcagttcgggttgaacatggtttgtgggatgccgcaccattatgcgttgcatttggcttcattgcacgagtttgattaaataaaaatatgacacgactgattcttgatgtggacaccggtatcgacgatgcactggcgttggcataccttgcgacgttcgacactgttgacgtgcttggcgtgatcggcacgtacggcaatgtttccgtcgacactgcggttcgcaatacttcgtatgtgctggaacggttggggcttcggcacattccggtgatacgtggatcgtcgcatccttcatgggctcggtgtttcattccggatgcaggttgtgcgcagtttcacggcacggacggattgggaggattcggcccggcttgcgatagttcgtcttcggatactgctttttcagatattttttcggataattccggttctgatactgttttttctcgtgattatcgtagtctgatttccgttggcggatatgcgttggatgatgttcatgcgaatcctgcggttgattcgtttgaattgtcgcttactacggattcggcttcttttattcatgctgacgattcttccgccgactcggtttccgaaggcgtgcagttcattattgatcaggttcgcgcttatggtttcgacgtcactgtggttgcgaccggtccgctgaccgatattgatgctgcgatcacggccgcaccggatattgccggcaaactcaaactggtgatgatgggcggcacgttgacgcaggaaggcaactgttgggatctgactgcggaaacgaacatcattcaggatccggaagccgcagatcgcgtgttccattccgatgccgacatcaccatggtcggcttggacgtaacgcatcaatgcctgatgggttccgatgcgacccgtgcttggcgcgaagcggcgaatgctgacacacttaccagctcgaccgcatcccaagtcgctgattcacttgatggttcagctggtagttcaaatgcagcttcagctcgaacctcgagtgtggctgcaagcccatctgcttccgatgtgcgcgtattcctcgccgacatggctgatttttccattgccgcaaatctcaaggccgacgcgcgactgttttcacagggcatgccattgcatgatccgctggccgccgccgttgccgtggatccgtcgctggtgacctgtatcgacctaccaatgaaagtcgaactcgaaaccggcgatttccacggcacccgaggccgaaccatcggcgatcccgccggactgatcaactccaacgcaccccgcatccacgtagccttccaagtcgactcctcccgtttcgtccccaccttcaccacccgaatcagcacgttgtagcaaacaaaacggggagaacattatgttctccccgcagttaacctaatcaactcagcaaaaactactttttgacgccgccgaaacgacggtcgcggtgaatgtagtggtcgatcgaacgccatagcacgtctcgaccgcaatcggggaacagttccggcacgaaatcaagttcggcatatgccgcttcccacggcaggaagttcgacgtgcgctgttcgccggaagtacgaatcaccaaatcgcaatcaggaatatcaggattgtacaggtgttcggaaatcattttttccgttacgcgatcgccggagatcttgccgtcacgcacttcctttgcgattgccgcgcaagcatccgcgatttcggcacgtccgccgtaattcaggcagaacaccacgtcgatggtcgtgttgtttttggtacgttcctgtgctttttccaattcgtcgataacggatttccatagtttcggacgtcggccggaccagcgcacgcgcacgccccacgcgttcatctgctccacacgacggtggatgatgtcacgcgagaagcccatcaggaagcgcacttcctgcggggaacgcttccagttctccgtggagaacgtatacagcgacaggtaacgcacaccggcttcgatggcacctgcgatggtgtcgaacaccaccggttcggcagcctgatgcccgtcggtgcgaatcagcccacgctgctgcgcccaacgaccattaccgtccatgatcacgccgatatggcgcggaaccttgttcttcggaaaatcaggaataatcgacgggtcagaaaatggtgccgccggaatgtcaagggacttgtaatccacgttctcaaaagccatacccgctaatctagcaagcgcatggaacgaatcggacgttccaaatagtattcaccccatttttccaccatttgtcgggtttccggaagcaacgccgtgccgtccagctctccccaatcgccgtctacaagcgcctgcaactggcagatcgcattccacgaaacatcaaacgattcacgaatatgatcggtcaaacacatcaggccacccgcagaaatcgaaaagaaccatggacgatcagcagaaatcggctccccgcacaccacgcaggcacgcaaacgcggcgtccagccagcgatcgcaagagcacgcatcacgtaggaatcgccaatcgcagcagcctcatgcgcatgcttggaaagggcattcaacgctcccagcaccagccgatactgtgccacggaacgctcctgctccgtcaccaccagcttgtcagcggtttcgcaaatcacattcgctgcggtatacgccttgaaatcggtgcagatgcctctcgcatacgccgacaccgactcggcttgggaaatcacatcaagcgaacgcccttccgcaataagcaacgagacgcgcatgaaaggctccaaacgacctccgaaacgcgatttggttcgacgcacacctttggcgacggcgcggattttgccatggtcacgtgtcagcaaagtgacgatacgatcagcttcgccaagtttgacggtacgcaagaccacgccctcgtcctgatacaacggcattcacacacctccttcgcctcgactcgttttcttaactgaactatctatactttccgcacgttctcgcgccagccgcactctcccgcgatatcagtaaataaacaatccccagaacgcgaacaccaacagcacatacagcatggtgaccgccgtgatccaaaacatcacacggccgaacctcgtcgacgcgagcaccggctggcggccactcacaatcgcgcctatagcccccttacgcggtggccattgtgcaagaccacgattcgtcgcctcctcgataagacgcacgaacacgcgggaccacgcccacaccacaacaacacacaccatttgaataaccggccaactccaatacatcatgcccggatcctcggcgggagcgccaccccacgctagcttgaccacgcccataaccacttcgcccaatcctgcaccaaacagcacaaaagtggccatggtggcaacggcaagcgtaatcaacgcatttttgaacacaggtctcagccccaacacatatcggcgtcgatgcgcatgcgcccaaatcttacgtacgagcacaatcagccacagcacggcgatcaccagcagcaacagcaccatgctggcatgcagcaccacgagataaatggtcagcccgctgttcgcctgcaattccaacggcaccgcaatcgactgatacaagttggtaccggccacacgctcgctggtctgctgcagtccccgcgtgatgccgacagcccaactgattacatcatccacgtaggcgtcggcgaacggagtgccgctgttggattcgtcgccgagtcggagcacatggttggcgatggggtatgtgcgcacggtcacgtcccaattgcccgccttatgcgccatgtcgatgattttctccgtaccttccacctgcgcggtcatcacgtctttggtgccgtatgccacaagcgtgggaatggaataggcttggggattcaacgtgtcgaggtcgagattggtcaggccgaacaattccgcatcgatgttgaacgcgcggcgcacaatggactggtatccatcatgcgctccgaccagcgcgaaatcctgtgcggcaaggaatcccaacgaatgtcgtggcgaatacaccattgggctcagcaacacctggaatgccacgtcggggtcttgatcaagcagatatgaggaaatccaagtgctttcggaagtcgcgtaaatgccgacattcgaagcgtcaacgttgtcgagatcacgcaacatggtgatgacctgatcgtaaatggccgcggagcccgggtaatcacgggtcgcatcgttggtggaccataccggcttgtcgagcacggccgtcacgaagcctgcggatgagagatcggtggccatgtctccaaatgagttgtcacaggtaccatatccggcaccatgcatgaacaccacgccgggccgattgtttcccgcgtctttcggctctcgaatcaacactttgacctgttgtatttcaccggttgacggctgtttcgcctcaatggtgacatatcgttgcgtcacttcgtaatcgcctcgtttggcaagggttttgccggaaggattatcgaaggtcactgccgtgtcggatgataacgtttcgatggtttgaccggttggctcgtacttccatgacgatgccgtcaaattggataccgacaccagaatgcccagcaggatgatgaagataggcagactgaccatcagccgtctgcccctcgtccactgactggattggctctccgcgctggacatgactgactgacgttcctgatctgacacgccgttcattgtaccgactccagctgaaatggcaatcgacaaccagcaaaaccagcgggcggccgatcacaatctgcaatcgaccgcccgcggtcagcgaaatcaacaattaccttgcgccaccggcaccaccaccggtcctgtggcgttgacggacacctgtccgtccgcttccatctgcgcggcgatctcctgcgctttgaccagcagcgtttccacaatctggtcttccggcacggtttgaatgactttgcccttgatgaaaatctgtcccttgccgttgccggatgccacacccaaatcggcttcacgggcctcgcccggaccgttgacgatgcagcccataacagccacgcgaatcggcgcggtcacatcctttaaaccttcggtcaccgcattggccaactgaatcacatcaacttgggaacgaccgcagctcgggcaggagataatgtcgaacttgcgcggacgcaatcccatgtattccagcagcttgcacccgactttcacttcttcgacgggcggtgccgacagcgaaacgcgaatcgtgtctccaatgccttcagccagcagcgcaccgaatgccaaacagcttttgatggtgccctgccatgccggtccagcttcggtgacaccaagatgcaacggccaatcacccttggaagcgagcagacgatacgtttccaccatggtgatcacatcatgatgcttgacggaaatcttgaaatcatggaagccgacgtcttcgaacatgcgcgcttccttcatggcggacgcaaccagtgcctccggcgtcggaccgccatatttcgcatacagttccttatcgagcgagcccgcgttcacgccgatgcgcaacgaaatgcccgcgtccgtggcggctttgcaaatggaagggccaacctcgtcgaatttgcggatgttgccggggttcacacgcaccgcagcgcagcccgcgtcaatggcctggaacacgtatttgctttggaaatgaatatcggcgatgaccggaatcggtgatttccttacgatttccggcaatgcgtcggcatcatcctggcttggtacggccacgcgcacgatatcgcagccggctgcggtcagttccgcgatctgctgcaatgtcgcgggaacattggctgtcagcgtattggtcatggattgcaccgagattggcgctcccccgccgactggaacgggaccgaccataatacggtgcgatttgcggcgcggatgcagcgggctttcgctaatggctgcctcaccggttttacggaacggcttttcgatttctggcatacgtcaaatccttgcaataacaaggctcccgacttagggagccttgcgtcacttacgtttcgtctgtttgttttgtttcgttttccgttacttgtttatcaggtcgtcggctcgacgacgggcttccagctcgagttggctcatttcctccacggaagcgaatagcggattgccgcgcagttccgcatccatttcgtccaacacttccttgacggtatcgacgatgccgagatatggcaagcgatgttcgaggaaggcgtgaacggcctgttcgttggcagcattcagcacggccgtatgcttttcggaagcttccaagcaatgtcgagccaagctcactgcggggaatgcctcatcgtcaagcggttcgaacgtccacatggcggctttcgtccaatcacaggccgctgcgatgttgccaagtcgttcgggagccgataggccaagcgcgatcggcagacgcatatcaggcggtgaagcctgtgcgatggtggcgccatcgcggaattccaccatggaatgcacgatggattgcgggtgcacggtcacgtcgatacggctcggaggcacgtcgaacagacggctcgcttcgatgacttcaagccccttgttcatcaacgtggacgagttgatggtcaccaccggacccatattccaagtagggtggttcaacgcctgttcaggcgtgatgtcggtcatctgctcgcgtttccaaccgcggaacggacctccggaagcggtgaccacgagtttcgacacttcaccgtgcgtgcccgaacgcaacgattgccagatggcggaatgttcggaatcaaccggattgatctgctgcgcacgaacctgtgcgtcgaacagcagatgaccgccggccacaacggattccttgttggcgagcgccagctgcgatcctgcctgcagtgccgcaatcgaaggttcaaggccgatggatccggtaatgccgttcaacaccacgtcggcaccggatccggccatggcgattaccgcttccggcccggccatgatttccacatggcttgcgccggcttggtttagcgcatcttggagcgcatggaccgcgtttgtgttgaagatggcgactttcgaaacgtgaaattggaccgcctgttgggccagaagttccacgtgggagccgcctgccgcaagtccgaccacgttgaaacggtcgagatggcgggagatgacgtcaagtccttgggtgccgatggatccggtggatcccagaatgactacggttgaggtttgcatgggttatgcgtgtgctccgtatttgttttggattattcgtgtgaacgcgaaaacaggctgacggtcacgtcagcctgttcagtgcgattgcctattcaaaagaggggaacgacaggtcgggaatatcgacatccagattgctgttggatgcttcgaacatcggattggttgccggcttggtttcgttcttcttctcttcctctgccggtttcgccggttcaacgggagttgccgttgtcgagtgatctgcggaggttgctggttccagcgtgaaggagggtgggacggtcggcaaggttccgagattaatcgagtcggtattgacctgcggaaggttcggcgtcgacaggcttggcatgcgcggggtgaacgtgtcttcgaccggatcgggagcgtcgatgttctgggccatctgcgccaaggcagccaacgaagaatcgggagcgatggtgatgccgtgagattcttccggctgatgtgcgaccgaagtgtctggaatcacaggagccgcaggcgcggccggagcgtcatagctcggcgcgccatcatcagaaagcggattgaacgcttcggtttccgttcctgcggaagatggctcctcgtcaaccgcattggacgctttgaacaggtgtgccaacgactgttccggagccgctggagcaaccggagcggcctgaggttccggcgttacaggagctgccggagttaccggagccgacggggtgctgatggttggctggaacacaggcggaaccacgggagcatacgtcggcgcagcggtttgagtggccggaatgctcaccggggacgttgcaggcgtggtgaaaatctcacgttccgccttattcaaagcgtcgaaggagtcagtgctgttttgaacctgagcgggctgcgcaataggttctgcggaaacggctggaacggcgaataacggcgagaccacctgcgtctcttgggatgccagactggttgcgggcggattggctgcggtcatcgcgctttcggagggctcgcccacgaagtcggccacacgagcataggattcgagtctggtcagcagctgcacgcattcgttcaggtaataatccacctgacgctcgtcatagccacgcttgcccttgcgctgggtgaagatcacattcgccacggtctgggagttcagatcgacaagtttcttggcatcgtcttccgacacttcctcaacgccgagctcgccagcggccttcgtcaggcactgatcgacgatgcgatccacttgcttgcggtcatagctcggttccttgccttctcctggcttgaaacgttcgccgtgctcacgtttggaatgggcgtcaagctggcggaacagactttcggtctgcgctttccacgccacacgaccgtgctgcgaaatctcccatgtggtctgcttgtccaccacggcgcgctccaaacgagcaagggccgcgtccacttgggcgatcacatagccgcctttgaccaaatcgaaagaaacattctgaatatcatgctgggtgagttgcgctccctcaccttcgtacagcatgtgcgcacgctcaagaaaagcgtccacctgttcggaatcatacccccacttgcgctttgaagtacgagcgatccccgatgcgttcctctcggattcaggttcctgcgccattggctatcgacctcctactgcactactcaacgtccttactctacgtgattgattcgacgcttttggctttcttgtggaaaattcagcgaatcgacactcaaatcacaccatttttcacgcatttactatggaaggaacccctattgggcagcgcgacacacgttgaagctgtcgcaggcaacgaatactgtacagtagagttttgcgggcgattagctcagttggttagagcgccacctttacacggtggatgtcgggggttcgagtccctcatcgcccaccttttgtttccgcagaaaataagccgttccgactcttctgatattcccaactatctcgtgtgcgtgtcagcaaagtcatgacttttgtcaatatagacaatttcatggaaacatcttcttcgactgcttccgcaagcaaaaaaggctcggaatcgtgtgattccaagcctttatatgagcgcccgaccttggccatgcgtgtcgaggcgggtaaaacgaatacgatcagcggcctttgccgaatgcgcgcagacggatgccgttccagtcaccgctgacggtcagcggcgtggctgcattcatgccggcggtcttcgcggcggactgcacggtgcttgaacttgccgcgcccgggcgccccggcttcggggtgagcacccacaatggaccatcgtcgccgaggaccgcatacgcatcgacgatggtgtcagacagttcgtcttcgtcatcgccgtcgcgccaccagataatcacgccatcaacggcggaatcatagtcctcgtcgaccagctcttcaccggtcagctcctcgatcttggcgcggatcgagtcgtccacatcatcgtcccacagccattcctgtaccaggtcgccggcgtggaaaccgaattcttcagcgttatcagatgccgtttgattcacgttcgtcaatataccaacactgctcgaacatatacgttacgaaccgtggaattgctcactttgcgagattgttttttcttatatctcggaatgcgtcactctcccgcggagcattgcggcagggatgcacccttgccgtctcggacggcaaccagcgcatcgtacgcctcctgcaaagtggacaccttcaccacgttcaaaccttccggaatatgatccacaacgctggaacaattggattccggggcaaggaaccaagttgctccgtcgcgtttcgctccgagcatcttcaaacggatgcctccgatttcaccgacttcacctttgtcgttcatagtgcccgttcccgcgatgatcttacccccagaaagtttttcaccggtcaccttgtcgatcagaccaagcgtgtacatcatgcccgccgacggcccgccgatgtcgtccacatgcatggacaccttcatgccggacacgtcataaccatgctcttccaggaactttttcgccgctgcggtggcggaatcctgcgatgacgtcatctccttgtcgctggactgcttgtattcctctgcggtctgcccaacaggaaccaccgcttcctgaggcatcaccgtggatttcgaatcggcccacgccaccaatgcctgcgcgttcgacaccgggtaccctggcacgcctgaagcattgaccgtgaccaacagcagttggcctgaatccttatacgttttcgcaccggaaacggcgatgacctgcttgccggaaacctccccgagcacattctgtgtcgggccgggcacctgcaccacatacgcgctgggcataatcaacaccaatacgcacagtaccgccaccaacggtcctgcaagataacgccatgaacgcgcggacagccaaccttccgcgcctatcagccatcgtttgacacgtcccggagctccgctacgtgtgtttttgccgtgaattcgtcgtgtttccttcatcttgggcatacctcccataacatagtatggaaccaaccaaacttgaaaaaacgcttaggaaaaggcagggccggcatggacgagaacgcgatccgccaatggtttatcgattgtttcggaccaattcaaggcgagatggcatggaaccagttttccaacatgccggaagagttgcgcgaccagttgatgagtcaggatgtgagcaagcttcccaagccggccgaggtcaggtcgatgatgcaggcgttcactgcgggcgggctcaacactttcggagacatccagcacatcaccgaggaaggtccaatcaacgtcaaactggcgaaatcattggcattgcagcaggccaatggcgaaggatcggaaaccagtgtgagcgcggagtacggcgagatggcccggcgagccatcagcgaggcgaatctgtggcttgacaccgcttgcgaattcaaccccgcgcaaggcgaaacgcaggtgcttacccgcgcaggctgggtggaaggatgcatcgattcctgggcgcagtttgcatccccgattgccgagtcgatgagcgacgctctggcttcgattttgtcacagcgtttcggcgattccgaattccatacggaaatttccggcattttcgccggtccggtgcagattccgattcccgatgatatgaaagatccggcaaaactcatgcgtttcgtcggcaatacgtcgttcgccatgcagctgggacgtgccgccggcgatttgtcgcatgaggtgcgcggcagtttcgaccaaagcatttcgttgctgaagaatccggctggaggcctgatcgtgcagaatgtcgtcgaatatgcgaaatccttggaaatcgacgtgaacgaagtaatgagctatcttgcactgcaagagctcgcccattcgcgtctgtacgcttccgtgccgtggctgatgccacgcttcgaggcgctgttgggcaagtatgcccgtggcaccagcatcgatttggacgccatggaggagcagatccgcgatgcgcagtccgtcgacccggattccatggccgacgcggtgaacatcaccaaggtggcgttccctgacacgcctgaacaacagcaggccatgaaatcgctggagaatctgctcgccttggtagagggttgggtagacaccgtagtgtggcgcgccggcatggctcatattccgcatatcgaacagcttcgtgagatgctccgccgcgagcgcgccatcggaggtcctgcggaacgcaccttcgaaagcctgatcggcttgcaattacgcccgaagcgcatgcgtgaagcggccgcattgtgggataacatctgcgctacggaaggcgcgcaggcacgagacgcgaaatggtcacatcccgatctactgccgcaactgccgaatgatgacgatgacaacacctcacagtcgcagaacaacggatcgtcggaaaacacggaaaatacgacgttcgccgcttccaatgccaccgatatggcgtcgcagccccttggcgacgccgatggcatgaccatcgattgggatgccgaactcagcaagctgcttgacgaggaagagcacaagggcggcgaatccgataccaatggcagcgattctgacgattccgcagaatccggcagcaacaacgataccgacgccgagtaatcgcgctattccgttagcagtatcagcggaaaaagcgcgacacccgtcgtgccctttcaccctcattgccttcacgggtacgcgcatatgagacgtcaagcgtgtcttcggcgcgcgtcacggccacatacatgagccggcgttcctcctcaagcacgtcgtcatcctgcggcaacccatacggtatgagtccttccgagcagccgataaggaacacgtgcttgaattccaaacctttggacgcgtggatagtggaaatggtcacgccgctcagatccgcgccgacgcccaatgcctccaacatggccagtctggtctgcgtgtcgtcggaaagtgcggaattctgccatccgctatccctgcgcacgcgatatctcaaatgctgttcggccaatgccttgcacaggattttctgctgcgcgttgactctggtgagaatcgcgcaatcggccggcgactcccccgcatccaccagtttgcggatgcgcgccgccacaccttgcgcttcctcccaatcgctgccatatatggtttccacgaccctccgtcctttgttcctttcagagctgagcttcagataatcggcccgctgcggcgatgccgcaagcacacgattggcatagttgacgatctgcggcgtggaacggtagtcgttgttcagattgatgtcagcggtgagcggaccgaattccgaatcgaagttgagcagactgtagctacttgcgcccgcgaacgagtagatggtctgcgccggatcgcccaccacgcaaatattgcggtttgagccgagccatcgggtgagcagacggtgctgcaatggcgaaacgtcctggtactcgtcgacggtaagccatctgatgttggagcggatagctgaggccacttcctcgtcgctttccatcagatgacaaacgatcagcagaatatcgtcgaaatcgatttcgttgcggttggttttttctgcctcatacgctttgtatacgtctacgaattggcttggttcgaggcctgatggcggctgtcgatgcgttgccgcgcaaacccgcgcgtaatcttccggtgcgatcagtgagattttgcaccagttgatttccgcttgcaagttacgtatggtgtcgtcatccacttggaaggtggtgacgcggcgcagcgagcgctccaccagttcacgtggatttctggaaatgaacggcatcggcccctcgcatacgtccggccacacttggcgtagctgatggagggccgcggagtggaaggtggctgctttgacgtcggctgcgacatcgagtttcgataggcggctacgcatttccgccgccgctttgacggagaatgtgactgcgatcgtgcttcgtggattccacgctttggtggcgcacgcataggcgattctgcgggcaacggttcgcgtcttgcccgcgcccgcgcccgcgatgatgcgcactggaccgtccacggccgttgcggccgccctttgcgcctcatccaatccgtcaagaatctcttccgctgttgcactcatacgttccattgtggcagattgccgtcgccatgtgacgatttgcccgcggttcacctgcagttttactggcaagtcggcaacgcttcgcccctattgtgtattaaggttggaattgtgaccgaacgaagcaaatttatgatagctgccctgacgagtgcggcgatgccgaacgccgccattgcgggcgcgcgtgccagcgaacagaccaacccgaccgacgaggggtacggcgtcgaccatgccgtggttcaggatgcagcgggcaagctgtatgacgtgttcgcatccaacacgcctgaaggccgtaagcgtcttgccggtcgcgtgcgcgctgcgcagacgctctcgcaagcccgcgaattaggcggattgggttttgccgtcgatagcatagtagctttttcaaacggcgatttgaagcattccgccactggagatacgtccgtgctggtggccacccaccatgtgggtcaggcgcggccgttggagctgctgactttggatgattgttccagcgtaggcaccgctttgggcgcgattcatcgccttcgtcccgacttcctgcaggaagcgggctatccgacgtttgtcaccggccagattcgcgctcagctgaccgcttggatcaagcgcctgcgtcaggctggtcatgttccgcaggagatcaccactagttgggcgaatattcttgaaaccgacggcctatggtcgttctccacttgcccggtgcatggcgggttgcgtgacggcgatgtgcttttttccggttcgtccatcaccgcggtcacgaattggcaggatatgcaggtcaacgatcctgcccgcgatttggcttggattttcgccaagcttgacgagaaccaccgcaatgccttgctttccgcatacggtcgcatgttgggcaatcgtttggatgatctgattatgctgcgggccaatctgtggctgcagatggagcaggtcggcgattttatttccgctttgaacaaggcagacaatgccaagattatgcaattcaaggcgcaggtggaacgcctggcccaccagctgggtgtcgccacagcgaagaatcgcgtgcaaactgaaacgaagcaggagtccaaggatcgcccccagcgcccgccgagcacaatcaccgtaggcacgttgctgaacgaatcggagcgtcgccgtaacgcggccgcacagcagaatgattccgacacgaccggcgaacgtcatgttgacgctgtggatatggatgattccactggcgatttcgacgcgaccggcgatttcgacgtgaccggctcccagccggtccgcaagacgaaggaaatcgtcaacgacgcgacggaagcgttcgtaccggccggagcccagccatcacaagcaccgtccggcaatacgaatgaacatgaggcgacctcggtcagcactttcattccggaacattccgcaaaagaacggcacgaatccatgccgtcaagttccaccatggtaatcagcaggctggaaacggccgacgacaacgacgatacgaacgaggaatcgattcccgcatcgcacagcgaggccgcgacagtactcattccactgttggagcgagatgaggcgaccatgcagaaagcgcaggcgcagatcaatcagtgggaggcggaagacgccaccgatgagaagctacgcgtagaataggcgcacataacccgtacatacacgtgcgcatgcattgcgcattatcacgaaggagcatccatggatattgaactcggcattcagaatgtggcccgcaccgtcaccttcagcaccgaacagagcgccgatgaggtcaacgcggccatcgccgacgccgtggagaacggcaagaccatcaatctgacggacgacaagggtcgtcgcatcgtggtgccggcaggctcgctcggctacgccatcatcggttccgaaaccaagcacgccgtcggtttcggcaacctctgacccgttcgcatcaccagatttcagcttcgaactgaaacacacgttttcgacgtaacaagaaaagccagacgttcgcgcctggcttttccattttgggcgatcaactcgtttctggtttcatatctcaattacgcgtcgatgattgcgtttcggttttttattttcgccttcgacgattctttgctcaagcggacgcctcgattgatgatttcctgaactgtttcgtcgctggtgaggttctcccccagcgcgttcggcttgcctttaccatgccaatcggatccgccagtcaccagcaggtcgtgccggcgcgcaatggtgagcagacgttcacgctgttctgatggattgccgcgatgccacacttccaaaccgtccaagccttcggtgatgagagattcgatttgccggtcggtcagtaatgtccgattgcgccgggggtctccggcgtgggcgataaccaccaccccgcccgcacccttgaccgcggccaccacgtcgtgcgtggtcggtgatggcgtgggaatgtaatatttcgacgttgcgctcaccgcatcggcgaaagcgtcggatcgtgtttcatatacgccggcagccaccaatgcgtcggcgatatgcggccggcctatcgtggtgcgtttgccttcacgcacctgcgcgagcacatcatcccacgtaatcggaaaatcctgcgccatcagttcgaccatgcgcttggttctacgcagtcgcgcctcgcgggtggacgcgaacatctcgctgatatcggcgttcagcggatcatattggaatgcgagcatgtgcacggatacgctctcatcgacggcagtgatttccgtaccgcgtaacaacggcaatctgacctcccgcgaagcagccaacgcatcctgccaaccggaggtcgtgtcatgatcggcaatcgcaacaccatgcaatcgcaatgctctcgcttcctgcaacaacgcacgcggcgtttccgtaccgtcggaaaaaacggtatggcagtgaatgtcccaaccttcagcgggcggtgccgcagtgcctacgcgaatcatgtatccatcgtaagctgtttttggcgcgactcggcacaataccgcgtaaactaggcgatgacaacgtttgtattttgattcaaggatgcacgatgagcgatttttccggcgaacaggttgccgaagccactctcgacgatgattatacgaagccgcgcggttggcggcataccgcgacatggacgtatctagtcatgctgatcgcctcggcggtagcgctggtcgtatcgttcgtgctttccgccgagacactgaaattggcgcgcaatcccggtcagaagctcagctgtgatgtgaatgccgtgatgtcgtgttccgcggttgcggaatcgtggcaggctgaggttgtgaagttcgccggtttgagtttcccgaatgcgttcttcggcatcgccgcggaatcagtgttcgtaacgatcgcggtgatcggtttgacgaaggtcgccgtgccccgctggtttgcgttgtgcacatggctgggtggattggccgcgctggcttattcgtattggctgacctcgcagtcgttgtttgtgatcaacgcgctatgcccgtggtgtctgtgcctgatgttctccaccaccgtgcagttcatggcgttgtctcatgccacggcggtggttcaggagattccggccaagcgcgagggcgtacgcacctactaccgtcttaattacgatctgatggtcgatgccttatggatcgtgacattgattgtgatcattctcgtcgaagacggccccctgctgttcagttgacgtcaagtaacgtccaatcagcagtagggattcactcgcctacaagagaagccgactggaaacagccggcttctttcttttgcgtatccgcaaatttcagtgttatgcgcaaaaccttacagcagttcgattttgccgacgatggtggccgatccggtgagtttcacgtcgttatcggtcacgtcgacgcgcagggtgccgccacgcacggtgatcgtccaatggtcgatgccggttttggcacgcaacgtgatggcggtggcgcacaggccggttccgcacgacagggtttcgccgcagccgcgttcgttgacgcgcatggtggcgttgccctcgttgtcgccgtcgctttgctcgtcgatgcgcacgaactcaacattctggtcgctttcgattcggggcgcgaccaccggcttggtcaccaaatcaagctgttccaccgtcggcaggctggagaacgcgtcttcgatgacggccaccacatgcggattgcccatgtccacgaacgtgccgcgtgcggaaccggccgtgccgggaatcgtcacttcgtatccatcaagatcgccacgcttccatgaacccatctcaacctggaacacgtccttgccaagagtcggcacatcgccaagtgaagtcagaaccttcacaccggcacgggtgccaagacggaacggttcaccgcccggctgaccggcaataccctgccgttgcgcgaacagagtgatcgcacgcgtgccgttgccgcacatctcagccaacgaaccatccgcgttgcggtagtccatgaaccaatccgcattgtcggcagcacaaacggcaatctgcttgtcgttcaaatcggacaccgcctgcggatgagtaaggcggatcaagccatcgccaccgataccgaaatgacggtcgcacaggaatcgcacttcatcggcggtaggctcgtacgtgccttcggcgtccagatacaccacgaaatcgttgccggtggcgtgtgctttgtaaacaatgcttggaatgctcataccgattcactctacacgcggtaggctattgaagaagttggacgcaacacgtgtgcattatgttgcagtatgtttgcgtgcggaacaagggaggacgtatgacttcaacggcaccaatcggcgttttcgattccggtttgggcgggatttccgtggcgcgcgaaatccgccgcgatatgccgaacgaacgcgtgctgtattttggcgattccgcgaacgctccgtacggaaccaaatcacctgaacaggtacgcaagctgtccgacgccattgtgaaacgtttcgtggaacagggagtgaaagcggttgtcatcgcttgcaataccgccacttccgccgcagccaacgagttgcgcgacaaatacgacattccgatcattggcatggaaccagcgctgaaggtggcgtgcgatcgaggccatggcaatcgtcagcgtgtcatcgtcgcagctactcccctgacgttgcgggaacgcaagttcgccgtgctgatggatcgtttcaaaacagaccatacgatctttccggaaccctgccccggtttggtggagatcgttgagcacggccaactcgacgatcacgatgttgtgatgcacacgctgcaccagtatttcgaccagtatgatttgtcgacgatcgattcggtagtgcttggctgcacgcatttcgtgttttaccgtgactatttccgcgaactgctgcccgacacagcggcaatcatcgacggcaacgaaggtaccgtgcgccatcttggcgtagtgctcgaatcgttgggcaaactctctccggaagacgcggacggtggtatcgagctggccaattccgacacttccacacaaatcgcgcaattagcgcaatcgctgcttgatcgctgagcgcgaatgttccgatagaccgcgtaaagtcgattgaaacccgcaaaaactgctcaaccgttatcagacgtacaacgacgaagtggcgctggccaaggaatacgagcaggacggccgcggtgacctccgccgtgacagggcggcgctctaaccaactgagctacggggccattgtttcagtcttgcgactggcaacagatgtatatactacggcaaagtcgccattgtgcaaattgcggcgtgtcatcggcgaatatttgcatggatcggcgaaagaaaatgtttgtggaatcggaaatagcgagaaaacaaagcaacggccggtcgtgtatgaggggaaaacttctcatatacgaccggccgttacatttgcggtgccgtgttgtcgctcacgacactacgtcttgttgaaatcagtcggtctgcttccaggtctcgacgtcgatgtggtgttccggattggcctgccatgcttcccaagcggacttcacgatgtcttctacgttgtactgtgcgtgccagcccatctcttcgttgatgcgcttcggggagccgatcaggtgcggcggatcgcctgcgcggcgggccatgacggtctcttcgaacggcaggccggtgacctttttgacctcatcgacgatctggcgcacggaggtgccttcgccggtgccgacgttgaaggcatcgtacttgcgctcgtcgcggtccagatacttcagggcggcgatgtgggcgtcggccagatcggagacgtggatgtagtcgcgcacgcaggtgccgtccggagtcgggtagtcgtcgccgaagattgccggagccttgcccttcttcagtcggtcgaacagcatcgggatgaggttcaggattgccggatcctcgagctcgaccgggccgcagccagccacgttgaagtagcgcagaccgcagaagcgaatgccatacggctcttcgcaggcgcgagccatccactcgccgaacagcttggtctggccgtacgggttgatcggcagcatcggaacgacgtcttccggcaccacgtcgaccggcggaacgccgtaggtggctgcggaagaggagaagacgagcttcttggcgccggagtcgcgcatgccggtgagcacgttgagcatgccgttgatgttctgctggtagtaccacagcggcttctcaacggattcgccgacctgcttgcgggcggcgaagtgaatgacggagtcgacaccttcggccttcatgatttcggcgagacgttcgccggcacccggagcggcgatgtccatgccgtacaggcgggagccttcgatgcgggttggcttgccgtagctcagatcgtcaacgacgacgacctgttcgccggcctgatgaagagcgtggacgacgtgggcgccgatgtagccgcacccaccagtgacgagaactgtcatgttctggcctttcctccaaatgagcgataaagcgttttggttcgaaaaacgaacgttcaacgaacgttgttcacttttgctctagtttgttaccttttgaacaatttgagtataacacatgaacatgaacgcacataatcgatccgttcctgcgtttcctctataaattagggtatgcaagaagatgtgaacacgccgaatgagaatcaagtaaacggcgaaagcgaacaaagcatgtcaaaaacgcaagatgaacaacgggctgatgctggccagcgtcctgccttgtatgggcgcaaggtgttgtccttcgtgcgtcgttccgccaggctcgacgcacgcttgcagcgtgcatgggatgcctatgcagatacgtatctgctgaaaatcaacgcgggcgaggggtcgcttgatgtgcgaggcgatctggtgttcgatcgggcgtatatcgcggatgtgtggggcaatgtcaatcctctgattgtggaaatcggtaccggccagggggaaaacgttgttgcggccgctgctgaacaccccgatatgaacttcctggcgcttgaggtctatgatccgggcgtggcgcataccatgctgctcgcaggcaagcagggcctgaccaatctgcgcatcgcgcaggtcaacgctcctgagctcttcaaagccgcggcggatggatcgatcgctgaagtatggaccttcttccctgatccgtggcccaagatgcgccaccacaagcgtcgtatcgtgcagccggagcttgccggcgagattcatcgcacgttgcgggatgggggagtgtggcgtatcgccaccgacatcgaagactatgcattgcatgtgcatgaggtgatggatggtcttgaaggattccataatgacggcatgcttacggtgagtttgccggtcgagcatgttggcaagggaaatgccgacgaagcggccggtctgcgacacgccgatttcaccgaatccgagcgtttttccggacgaattctcacgaattttgagaaaaaaggacttgctgccggtcgtgtgattcatgacctcacctatcgctgcgtatagtgccggttggtctgttgttgaagtgctgaaatggcttgatttcaacgattttcagcactttggcaacgggttgatggcgattttgcgacgctgcgacacgccgagatttgcatgttctgaggattcgcgtatagttaagcgagttgtcacgcggaaacgctgaaagcgcccccttcgtctaacggttaggacaccagactttcaatctgacaacgagagttcgactctctcagggggtacttaccttggtaacaaggtggcaatggccccgtagctcagttggttagagcgccgccctgtcacggcggaggtcaccagtgaccgtccgattaacagtcggatgctctgccaactgagctacgcaggaatgcgctgtgcacaagacaaaaatactacaccaaaacttgtggatttcaaatcttcagcgtgtcacatgtgtgtttcgacttgcaaaacgtttccatacgatgctttcggcctaatcttacatggagatcttcgtcaacggcatggccgaatcgatggcgaaatccgggtttgacggagccactcccgcttcgaccaggttgacgcccagcatggccaccatggcaccgttgtcggtgcacagtttgagctgcggcacacgcacctctaccccatgctcggccccgacttccaacagtttggcacgaagctgcgaattcgcggagaagccacctcctacaatcaacgtcttcgaatcgtactgctcgcagccgcgcatcgccttcttggcgagtacagtcgccacggaatccgccagcgacgcgcacacgtcatcgacgggaatctcattgccttgcgcctgctgttcctcgatccaacgcgcgacggccgttttcacgccggaaaagctgaaatcgtacggatgctgctggcccgctttgccttgggtgagtccctgcggcactttgatggcatgcgggtcgcccaactgcgcatgacgatcgatatgcggtccgcccggataggggaaaccgagcaggcgagcgaccttgtcgaagcattcgccggccgcatcatcaagcgtggtgccgaccacgtcgatatgacgtgcgacatcctcaacatgcagcaaggacgtgtgtccgccggacacgatcaaggcgagcgtgtcttcggggaacgggccgaactgcaactgtgtgaccgcaatatgcccgatcacatggttgatgccgtaaatcggcttattcgccgcccaggcaagcgatttcgcgccggacacgccaacggcgaggcagccagcaagtccaggacctgcggacacggcgatcgcgtcgacgtcagacaacgtcatgttcgcatcggccaacgccttggaaacgcatggcacgaacgcttcggcgtgggcgcgtgacgcaatttctggaatcacacccccgtaacgcgcgtgctcatccatggaggatgcgacgacgttggaaatcagggtgcgcccctgcactaccgaggccgcggtctcgtcgcaggtggattcgatgccgagtacgattggtccgctcattgctgctccgttcgctgctttgcttgctgttccgtttggttgttctgtttattgttccgctgctgcgaagccgacgatcctcggctcaaggtcaaggctcatggtgtacgcgtcgatgccttcgggctggtagtagcgtttgcgcaatcccattttggcaaaaccgaaccgtttgtacaatgccaaggccggagtattgtcgactcgcacttcaagcaacatgcgcttggccccctgctcacgtgcccgcgcaatcaacgcctccatcaacgaagccgcgattccctgccgttggaaccgtctgccgacgccgatcgtcatgatttccgcatcgtcgccgtcataccagaaaccggcatagccgcgcacaacgggctgttgtctagcagaatcgcctgcaaccgatccagcaaccggctcatccacggcaacgcaacccgcaatcccgcaatccgcggtcttgccgtcatcatcaatatcgaacagatacgtgcgtgctggcgcttggaattcctggcgaatcgactgttcgctccacgctcccctgccgaacaggtccgcttccaaagcggccatctgcggcactgcgatctgttcatcgatgcttgtatggtcaacgatcatgccgtatcgtcactccgtgcgttccgcgccggcatggttgagtacatgcttcaacgggttcggcaccgacacgtccggcctgcgcaaatacaacggttcgaccggctccggattcaccaaagactgttgcgaagtggcgaaggccgcgaatcgttccaatccggacgcgccctcgtcgagcagcgcctgatcgcgcacttcgccgccttcgggaaggcttgcccacgattgcgcgtatttcgccgctccatggccgacgacgtcgaccacatattccacgttcggatcggcctggcgaagccgttccagcacctcgttgacacggttcgcaatcgattcgggatagtcgatatccatgtcgatcagggtttccacacagccgtcttcaacgtttgcgtcatggtcttcgcctgcgctgccaccggcctcatagccgctgccatccaacaatgtgaaatacagctgcttgcgtcgcgcatcgttcacggcgagcgtcagatgatggcggccgtcatgctccgcgttgcgcacaagcacctgcggggaaagcacattctgcccgataagctgtgcaccggtggcgaaggcgagcgctttggctgcaacgattcctgcgcgtagtccggtgaagggtgcaggtccgatgcctacgatgatgcggtcgatgttttccggtttgaggccggcttgttccacggttgtggcgatgttcacctgtagtttttcgacgtgggtgcgtgagtcggtttcgacgatggggtcgtgtccgaccatgccgacggttgagccgtatgaggtgtcgatcaccagtgtctgcattttgtggaaactccttatgccaagctgggaactactgtacaaccgatgctggaatcgtgcttgctgctggtgttttagcggttgttgcgtgtgatgtcgaaggtttgccaggatgcgccgacgggaatgaaggttacggtgcgggtgccgttgctggtgagttcgttgtcggctctgcttgtttcgtctgtgctaacggtgttgagtggccggtcgatgtggatttcgaggcgttccggtgcgagcgcggctgccatctgttctccccattccatgaggatgatggtgttgtcgctggggtcttcgagttcttcgtcgagtccgagggattcgagttcatcgagtagtcgttcgatggcattttggcctggggcgtaggcgttgccgccgagtcggtaggcgtcgacgtgtatgaggtgggcggagttaccgctggggaattggcctttgagttcgcgtgcgatggtgaaggttggcgagacgatgggttcgctgatgttgagtcctgcgccgaagccttgcgcgaaggtggtttttcctgcgccgagtggccctgagaggagtatgacgtctccgccgtgggtgaggtgtgcgacttgtttgccgagttcgcgcatggcttcgccggttgtcgcttcgacggtgacggttttggcagtgccttcgctggtgttttcgttggcgtcagtaatggttgcctcgctcatgttagttggttcgtcctttgctgctgatcagttcgatggatcgttctagcgcgtagacagggtccgatccgttagttttgctttgttcgtcggcccatgcgagcatttggatgcatcgtctcatgccgtcggaggtccatccggagagctgtctggtggcgtttttcagcacccatgaattggttttcgcttccgcttcgctgatggtgccggagcgtacggctgaggctttggccatggtgcgtagtttcatggcgagcgctccgatgagtgcgattggcgcggtgccttgttctattgaggcgcgcatggcgatgatggcgtcggcggcacgtccggagagtgcgaggtcggcgacacggaagccgtctacttggggatttgctgtgaggtattggttgacgcgttccaatgttatgggattgtcgtcgaagtcgaagcagagttgtcctgccatggctgcgagttcgccggttttgtcgccgagtacggccacgagttgttgtgcggccatgggttcgatgcgtcggttgcgtcgttcgaagcattgtatggtgaagttgagtttcgcttcggcttttttgaggtcggctacggtttctttgacggctccggctttggtgagttggtcgatgagtcgtttgcctttgatgccgccttcgtgttggcagatgacgatgctggcttcggctggattgttgacggcttgcttgcagtaggcaaccatggtttcgccgagtttgtcgtcggcgttttgcaggttggatacgatgacgattgatcgttcggagagcagtgatgggcttaccgcttcgtcgaaggcgtaatgatcggcgttggttgcgtcgagttcgatggtttccgcgtcggggtgtttgcgttgcgcttggtggcgcaggtcgcgtacggtctgctcgttgaggtacgggtcgcctccgtagatgaggtggaagggcgttgttgcggatggtttcggcatagtattcaatctcgctgtatcggtggacaagattcattcgttccatttcatggttttgagcgcgttgtaggttcgttcgccccatgctttcgcccgttcgatcggattgtgtatgaggcgtcggcccggcaggtttggttccgttgtggtgatgcgggcgaagagtgttccggcgaatcgtgcggtcgtgtatccgatgatttcgacgaggatgatcagtagcgcgccgcctgcgtctccggtccatggaatggtggcgtggtctcctgatccgaggttgagggccatgaattccatgatggcggtgccccatgaggcgaggctggcgaatatgaacccgaggcttggcagtatccatgagatggcgagactggcgagtccggcaagtgtggagaatcccacgaagggtgcgacgaccagattggctggaatggagtagaccggcaattctggttcgataagcacttggatcggcagggtgaagagttgcgcggcgatggtcatggccatggtttgcgcgatgaatgccggcatgatcggtgtgagccatgcgcctaacggtcctgcgaacagtacgatgccaagtacggcggcgcatgacaatgcgaatccgaaactgcgtgacatgtgcggattgaccatgagcatgcccaacgtggtccagctgagggttgacagggcttgcgttcttcggccgaggaacaggaagcccgctcccgccaaacccatgagcagggcgcgcgacaccgaatcggatgggaacacgcacatcgccagcatgatgtacgacgcgccgatggcgatggccgtgacgcgtttgggcagcagcaggaacgagcagacggcgcgcaccagggtggcgacgaccgcaagatgcccgccgctgaccgccatcagatgcagtatgcccgaacgttggaaggcgttttcaagcagattggcgtatgtggaatcaatacccgtgcccgtctggccattgccactatctggaggaacgtaatcctgcccaagaatacctaaggtcaggccgggaacgagcactttcccttggtcggaaagccgtgacgtctgttcgaagaacgcctgctgcatcatgccgatcgtgcgcaatgcgaggttcggtccccgtatgcgttccacggaggcgatgtccgtcagccatagcggcatggcaccgtattgcgatatggcgagcgtgccccgcatccggtattcgccgccttgtttgagcgtgccgcagtccggccggtccgcatagacgcgcacccgcatcatgcttggctgcgtgacttggcttgccgtgatcgttgagatcgtcgcatcaatctggcaatcgtttgcacgtctgttcgaattcactgcgggagatgtcgtacgtaccagcgtgacaacgtcgctttcgccgtttctggccgcgtacgaggccgcatccctccattgcaatacgtcgtaggtcaacgcggaagacgcgcatgccatcgccgcgaccacgcatacgataatgctgaaatgccatgccgagaccgcccgccgcacgccaaccggcactcgcagcataggcgatcgcaggaacggcaatcccaataatcccaataatgccagcaacggtaccgccaatgccacaacgagcggcagcatgccgaaccgaccatcccgttcgacgcaatagtcgaatcccatatgcgtggccaagctcgccgcccacccgcatagggcggccggcagcagacgccaatccctgctcccctgctccccatcccgccattcgaacgtgtttcctctcatcgtgcgcacacttggtctcggaatttcgccagcgttttctcgccgatgcctttgacttccaacagttggtcgacattgtcgaaacgtccgatctgattgcgataatcgatgatgcgttgcgcggtcacggggccgacgcctttcaaggtctgcagttcgtcggatcctgcggtgttgatgttcagcagaccgtcagccggatcggcgggctccgctggtccggatgttggttcgctctggctgtcgggttccgtggatggctgctggcttggtgttgtttgcgtggacgccgtcttgtctttctcggttccgttcgccttcgattgttcggattgggtgatctgcgattgttggagcgcactgtagtggacggcctgttggatgagcatggtcaggcttgcgcagagcgcgcacgacagggtgagtatggcgatgaccgcgtggattggttggaagacgagtcgtggacggtcgcgtttgggccggtcctgttcagtcggtttgtcggaaggcttgacgccggccagatcccgcaatgtgggttttgcgggttcaggcgattgttcagttgtcgcgattgcagtggacgtttcagccgctgcggaaatctcggatattgaggttgtttcggatatcgcgggaacagcatgttcgttgcgaacgttctgcccgcgcgcgttctttccacgtgtttcgggcatgccaagtccgcgcagccgttgcgcggactgcgatgcggtttcggcttgcctgttgcgcctgcccggcggggtaacgataatgcccatgcatccaaagtggaggatgcatgggcatgttgtccagtcgaaacggcccctgtggtcgaaggatgggagttatccacatgttcggcgtgtcgccttatgcggaaacggttcccaccctgttggaagcctcgtcaaaggtctcgccagaagccgttggatccgtttttcgaaatatcattccgcaggaacgatggacacgatcttcggagccttgacgatgaccttgcgcggttccttgccgcccagacgatcggcgacggcttccaacgccatcttctcaagttccttaggatcgatgtcgggcgagacctcgagcttggcgcgcaccttgcccttgatctgcacgaccgcggtgacggcgtcctggccgacatagcgttcgtcggccttcggccattcggcgtgggccaacgattcgccgtgtccgagcttgttccacagttcctcgcagatgtgcggagcgatcggggaaagcatcagaatcaacggttcgacggccgcgcgcggcacttcgttgaggctggtcagatggttgttgagcacgatgagcttggcgatggccgtgttaggacgcatcgcttccatttccacggtcacgtcggcgatcgtgttgttcagcagcttcagcgtcttcgtgtcgagcttaccatcggtgacgcgcacttcgccggtgttctcgtcgacgacgttgcgccacaggcgctgcaggaagcgcatggatccgaccacgttgcgcgtgttccacggacgggattcggccagcgggcccatgcccatctcatacaggcggaaggtgtccgcgccgtagttcgcatacatgtcgtccggcgtgatgatgttcttcaggctcttgcccatcttgccaaactcgcggttggcgtgctctccgttccaggtgaaggtcggctctccgttggcgtcggccgggccttccaccacttcggcggccggcacgtactggccacggtcgtcggtgtaggcgtatgcctggatcatgccctggttgaacagcttgtggaacggttccgcggaatccacgaagccgaggtcgaagagcaccttgtgccagaagcgggagtacagcaagtgcagcacggcgtgctccacgccaccgatgtacaggtccacgccgccggacttgccagtggtctcgttgtggttcgggcccatccagtagtcgaactcgctcttctccaccatgtgttcggtgtcggtcgggtcgaggtagcgcatgtagtaccagcaggatccggcccagttcggcatggtgttggtgtcgcggtagtaggtcttcctgccgtcgcccaagtcgagttcgaccttcacccaatcctcgttgcggctcagcggcgcttcaggattggattcggcgtcttccggatcgaaagtcttcgggctgtagtccggcacgtccggcaggttgatcggcagctggtcgtccggcaacagatgcggggtgccatcttcgccgtagacgatcgggaacggctcgccccagtaacgctggcggctgaacagccagtcgcgcagacggtagctgaccgtgcccttgccgacaccagcttcttccagccatgcgttcaccttgtcgatggcttcgtccacgcgcagtccattgaggctcaacgcgtcgcccttggcacgggtggcgtccacagcggagttgatgacgatgccgtcgtgggagacgaacggagccttgccctcatagttggccagatcgtcgccggattccggcagcggctgcacggtgtaggtgaccggcagaccgaacttgaccgcgaaatcgtaatcacgctggtcgccacccggcacggccatgatggcgccggtgccgtaatccataagcacatagtctgcggtgaacagcggcagcttggctccggtgatcgggttgatggcgtacaggccggtgaacaggccggtcttctcgcccgcctcgtccacacggtccttggcggtcttggattccgcggccatacggtaggccttcacagcctcgaccggagtggcgtagccgcccttccagtcttccggagtctcggacggccattcggcgggaacatcctcgagcagatgatgctccggggagaccacggcgaacgtggtgccgaacagggtatcgggacgggtggtgtagatctccatgtccttgacgccgttcggggtttcgacgtcgaaatgcacggaagcgccgtgggattcgccgatccagttgcgctgcatgagcttgaccttttccggccagtcgatgccgtcaagatcttcgatcagacggtggccgtatgcggtgatgcgcatggaccactggcgcagctcacgctggaacaccgggaagttaccgcgttcggacttgccttcggcggtgacctcctcgttggcgagcaccgtgcccaggcccgggcaccagttcaccggagacttggagatgtatgccaggcggaagtcgttgagcacgtcggcctgctcggcttcggtcagatcattccactgcttgcctgcgaatcccggaatctcacgctcgccggattcgaactgctccaccagcgtgctgatcgggcgtgcgcagcccttggagccagacgggttggtggcatcctcgtcgtaccaggaatcgtagatgcgggagaagatccactgggtccaacgcacatagcccgggtcaatggtggcgaaggagcggcggttgtcgaagctcaggcccatacgatgcagctggcggcgcatgttggcgatgttctgctcggtggtgatgcgcggatgctggccggtctggactgcatattgctcagccggcagaccgaaggcgtcgtagcccatggcgtgcaacacgttctcgcccttcatgcggtggtagcggctgaccacatcggtggcgaggtagccgagcggatggcccacatgcaggcccttgcccgacgggtacgggaacatatccatggcgaagtacgacgggcgtccttcggcgttgcgacccttgccgtccttcagatcgccattgacgttggcggcccagaaggtgccttcgtcatcccaaatcttctgccatttttcctcaatgccctgagccaaatccgcgttgtaacggaacgacggttcggctggttcgttcgactgcgtctgcgcgcttttctcaatgtcactcataatgcatgaaactagccgcgcaactggacacttcgcaaggcgtcaatcattatgcaagaagcgttttgcaaagcgtcacgcaaggcgggggccgtcagccttccgacgctgccgagagcgttatcgcgggagggttgagcgacatgtcgggaacgtagccgatcgactgtttcatcttgtctatggcctgcttccacgagccgtcgtccatcatggactgcaatgcggcgtcgatctgtttggccagcgtggattggccggatttgaccgcgatcgcgtacgaacgttcgccgaacgtttcgcctacgaccttgagatatccgcctcccctgttggatgcgaggcccgccgctatggcgtcatctgccgcgatggcgtccgcctgcccgatcatcaatgccgtttcgcattgcggatacgtgtcgcgttcgctcacggtcacatcttccgcaagatttcgcacgctgtaggagggtattcctcctttggccacgcataccgtccttccggcaagatcatcggttccggtgatggttcccgcactgtcggaacgtaccaacaatgccgcatgcacagtcagatacggtcctgcaagctcaacctcaccatcctgaacgtcatcagcggcgaaagcatcgaccaccatgtccacggtgccgtcttcaagtgacgaaacgcgcgtcgacggcagcacctgtttgaacacgatctgttttttcgcgaatcccagcgtgttcgccacatattgcgccacggaaatatcgaaacccgaatactctcccccatgcagaaaacccaaaccaggctggtccgcggccacgccaatcgcaatggtcggcccctgcgcgagaccattggtcactacggaaatggaagtgccgcacgcgctcgtgcccaatacggtcgaagcggcgcataccagcgccgcgatatttcgtgacagacgtgacagacgtagcatacgcgcgattctacgcgattctacttgaacatgcgcgaacgcgtcaggaaccaggtgacaatggccgaaacgaccagcgagattccgatgatcacggcgaagccccacggcttgtccgtcaacggcatgcctagcatgccctcctggaagttcatgccgtacattgagaagatcaatgtcggaatcgacagcgtgatggagatgatcgtgaagatgcgcatcacgttgttcagattgttcgacacgatcgacgcgaacgcgtcggtcatgttggcaagaacgccgctgtagatgttggccatctcgattgcctgcttgttttcggtgatgacgtcgtcgagcagatcctcgtcttccggatactgcttgatgcgcggcagcgtggtcagcttttccatcacgatttcgttcgatttgagcgacgtggtgaagtagaccaacgttttgctcagttcgagcagcatgagaatctcacgattctgcatggaatggcgcagtttgagttcgagcttgtcgctttcgcggtcgatgatacgcagataccgcagatacatggtggcgttgcggtacaggatctgcaggatgaaacgcgttttcatatacgtgttgaaaccgcggatcgtaccttccatgaacgggtgcaacaccggagtgtcctgcatgcagacggtgatgatggccgactgcgtgatgatgatcgacaacgggatggtctcgtaccagtctcgcccgccgcgctcttcgacggttggaatgtcgacgatgatcatcgtgtaatcgtcttccacgtccacgcgggagcgttcttcgtcatcaagcggggcgcgcaggtcggcgagatcaacgccggtttccatggaaacgttggcgagttccacatccgtcggatccgaaaggcataaccaagatccgttttcgggtttttggatctgctccacctggccgttaatcgttctgaacattctcaacatgtctctcacccgcctttcgcgctttccgacgttctatcgctgtacggcagcccgaatccaacatctccggcgatcggtctcttgcgatcgatctggaacattcgggcaaacaaccttatttaggatagtcccaccttgagagttggccggccgcgtgcctgagatttcatcgagaattcatgttcgacgcatgcgtccgcggcaggcgacagtcactgcagatcgttgcggttactgcggatcactgcacgatgggcttccacaatggcatgttggggcctcgcaattccttcggcccattctcccaatcggtaagcgcggcgatggcgggaccttggttgaaggcgtcgagcttccactgccatgtgtcgggatccgcaggaccgttggaaccgcctgtgttgacgctcatgctcgtccagaaggcgttgcgcatggctccgagattgttgaggtcgtccggatccatgtcgagcagcacggcgacggtggccacgatccacgatccatggccgactgcgagcagcgtggtggccgtcggatcatcggcatgttcggcgatgatgcttcgtatggcttgggagccacgctggccggtatgcctgcggctttcgacgccatgcttggtttcgcctccggtgtgggcacgccatgaatggtagtcgtcggcgtactgttcgaggatttcctcgcgggtcatgccttcccattcgccgaagctgcgttcacgcaggcgtgggtcgagggctacgtcaagtccgagaaggtcggcgatggcgtgagcggtctgttgggcgcggaaaaggtcggatgatacgacgaccatgcgtcggctcgcggccggtgcatcgttgatttcgttaagatcggcgagatacgcgccctcgtacgcgggttgggcgagttcatcattatggtcggcgatgtgcgcgactttcgcccaatagtatgttttggcgagttcataagcgctttggtcggcctgccacctgccgacgatgtcgaggggaatgtcgatttggccttgcagtcgtcttgcgagattgtatgcggtgcgtccgtggcgcaggaagagtacttcgtcgatcatgcatttcattgtaactatgccgtgcgagtgtggtgagggtcgcccagatggctgtgagcgcgaatgccgtggtggagagggttccgtcggtgaggcatcctgtttctggcgggcattcgtcgtggttggggacgcgcgttcctgtgatgagaagccggtgggtgttgatgccgtatggggtgcaggtcataagggtggcctgatcggcgctggcgtcgtgtttgtttatccaggtgaaatcgtcgggggtgatggtgcggattgtttgcacttgataggtgagggtttcgccgagggtggtgatggtgaattcgtcaccttctcgggcttggtcgagtttggtgaacatgagtttgtcggcgaggccccggtgtgcggtgatgacggtatgggttcccgctcccccgattggcagggatgtgccttcccaatgccctgcgccgatggcgagcgtctgttcgcttgttccgtggcgtatgggtaggctgatgccgagtttcgggtagttgatggttgccatgacgtcgctgggtgggatgacgagttgccgattgtattcgtcgggattttgcgttgcgggttcgtcgtctgtttggttgctggtttggtttgcgaggcgcgcgttgtagagtttcgcctgccgtttgctttcttggattgccttgtttgcggtgttggtgatggtggctgcgtacgctttgacgttggctgcttgttggatgttgtcttcggcgcgcatgatcagggggatgctgatgatgagtgccgttgcggtgagcatggcggttcccacgcaccatcggatgatgctgcgtttgttgggcgcttttttgtgccgtggtttgctatgcgggggaatcgccatgtgttgcctattgtcggatgttggctagtcgttgcttgatcggcacatgcgcagcatgacgatgcctcctatgaagaggagtgccgcgatgctgaagagcatggtgaggcctgccgcaccagtcaacggtatttcggtgatggtacggatgttggtgacgaccacggtgtggctgtcgccttttttgatgaggttgttggggtcggatttgacgtcgaggctccacgtcatgttggtgtcgtcaacgttgacggtgacgactgcgctgggcagcatgagcgacgagtagtcctggggcgcttgtgtttcggtgatggtgtattcgcctttgagtccttggattttggtttcgccggcttcgaatgtggtggttgtggtggtatcgccgctggtggcgaggcggtaggtgccgttgccgagggccacgagtttcaaaggcgttttgtcgctggcgccttgggcgatggcgaatttcgcgccggtgagcttttggcttttggcgtcgaccttgcgtaatgcgatttcaccggtgcagactttaacctcgttgccgggctggttgttgtggtcctgccatgcgttgggattgtgggagtattccaagtcgatggagttgacgttgcaggggcttccgatgaccgcattgccgttgagtctggccttgtaggtgactgtgatcgtcgcgccgaccggcagggccgcctttgatgcgtccgaggcgagaatgtctccgttgacgccgaacagccagctgatggttttgccgttgacgttttccttgtagaacgtgctcgccaatgctttgccgccgacggtgatcgaggtgagcgaaccatagtcgagacccgcgccaagcgtatcgttcaacgcaagatagtagtgctcgtagcctgtccagttggggattttctgcgtcacacggtaggtcaggtccttgcctatcgcttcggatgcgctgtctttccaggcactgccgacgttgacttttttgtctggcgattccacgttggataccttgtagatcacttgcccgagggtcagggtcgtgccgccggccgtacgtagttggttgacgccgttgaccgcggtgccgttcatcatcatgatggacgcggttgttttgatggcggtgccgctgcttagtgtggttgtcgccggtgtacggtccacgatggcgtagattcccggtacgagtacgttgccggtcgacatggtggctttgtcttggctgagtgtggaaaccgccgttccatcctgcttggcgaagttggtttgtttggcgaggctgttgcagaagttgcgtagctttccgctccatggatcgctgcgcgagtcggtcaggttcttcaccacccacaccatcggatcgtttttgccgttgacggtaaggttcgtatcggtggctccggccgctttggctgccgcggtgatgtcggatgccaatgccgtgttcgtggtcagatcgtagccgacgatcgtgttgccgtccacgcttgcggcggtatatgtggcaagctggatggcgcggaggtccttgccttcgaggctttccccgttgcttgccttcacgctcatggactgcttgacgcctaaatcgccgagttgcggcgtggcttgggccgtgcccggcatggcaagagccgcgatcatgcccagcgcaagcatggaggtccatcggcggcgtatggtgtgttgtgtcatggttcaccttctttggttgttggttgtcgcataggcgtcttcgcttatgcgtgcagaccagcatggcagaaaccaatattcgcccgccacctctttaagaaaatctgtggataagtggatgagcgaacacttatccacacttatccacaacccatgcatgcaactgccgtataggaatccatggtcgaaccgccgcgaacgatatgctgcagattcgcgatcttccgttccgatatcagtgaccgtccgattaacagtcggatgctctgccaactgagctacgcaggaatgtgcttcctgtacggaattgcttccgtgcacaagtcacatatattacacaaatcctttgtcttcgcaaatcgagtgtcgcacagcgtgtcgcgacatcaccattcgagttccgcgatgtccatcggatgctcgttgacgtcgacggcggtgaccttgccatcatgcatgcggatcacacggtccgcgatcggcgcgatcgcggaattatgggtcacgatcaccacggtggcgcctttcttacggctcatgtcctgcagaatctgcaggacctgcttgccggtgttgtagtccaacgcgccggtcggctcgtcgcacagcaggatcttcggattcttcgccacagctcgggcgatggccacacgctgctgttcaccgccggaaagctgcgcgggaaaattgtcgacacgatcgccgagaccgacgtcttccaacactttgacggcatcctgagcatcggaaacgatctgcgaggcgagctcgacgttttccttcgcggtcaaattcgccacaagattgtagaactggaacacgaaaccgatgtccgtcctgcgataagccgtcagctgtttcggggaatagttggaaatgtcgcgtccgtcgatgaccacgctgccttctgaattcgtgtccatgccacccaaaatgttgagcaccgtcgacttgcccgcgcccgacgcgcccagaatgatggccagttcgcctttttcgatgccgaagctcacatcatcgttcgcggtgatggtggtggaacccatttggtaacgcttgtaactatgctgcatttcgatatatgccattttggtctccattccacgccgaaaaatccttgactcccaatattacgactacagtagggattgttgctcatagacgacgaggaagggaacgttatggacatcgccgacgacgccgaccgtttgcaaacactgctgtacagcgcttacgattccgataccgtgcgcgagatggaacgtccgctgcttgacgacggcgtgccgctgatgcgcatggccgcctcggctgcggcccatgtgaccatgacactgctcgatgatgaggacctcgccgtcgaggacgcgcgggtagccctccttgtaggggcgggagataatggcggcgacggtctatacgccggcgcggaactggcgaacgaaggcgcgcatgtcaccgcgatcgccgtgggacgttccctgcacgaggaggcgttcggcgcgttcgtgcatgccggaggccgtgttctcgtacttgatcccgccgccgaaatcccaggatgcaccacgggtttttccgcgggagaggccggagaacgactgcaggccgccgttgaatacgttcagggctcccatgtgatcatcgacgcgatgaccggaatcggcgtaagcggcgcattgcgtggcatcgcaggcgccatcgcttcctccttgggattcgatggcgaacttcccgacaggcccgccctgccgaacaacgagccttcctccgccctgccgctcgtcgtggcgatcgacacgccgtccggcgttggcgtaaatgacggttcgcttccaggaccgtacattcctgctgatgttacggtaacattcggcgcgatgaagccgtgcgcgatggtgccacccgcctcatacgcatgcggccgcctcactttggtcgatttcggtttcgacattgatgattgcgtccccgcggccgaaatgacggacggcgatttcgtaacggattcgattcgccttccgcaactttcggacggcaagtattcgcgtggagtggtcggattggtgaccggctccgcccgttaccccggtgcagccgtattgtcggccacggcggcggcgcgcgccaacactggcatggtgcgctatctcggcccgcaacgagcgcaggacatggtgctttcctcgttgcccgaggcggtgatcggcaagggccgcgtccaatcatgggtggttggttccggcgttcccacgggtgacgacgaagccgccgacaccgacattcaacgcgaaaccataaccgcgttgttgaagcattacgcactgcaggaaaaaaccggctccaatgacgacgccaggaatgaaagcgccctgggcatgccgccgatcgtggtagacgccggagctttggacctgctgccaggcaaagtgccggctcaagtggttgtcaccccgcacgtcggggagctggcccgcatgttgactcggctagacggaaacgaagccagcgtcgacaaagtgcgctcgcagccgctcgcctgcgcccgcagggtccatgagctgaccggcgcgaccgtattgttgaagggcgcggtgaccatggtggtcggcacggacggcgaaggcaacgagcgggtgattctttccggacgcgcgccggcgtggatgtccaccgcaggatcgggcgatgtgcttgccggcatgttgggcgccctgctcgcgcaacaggacgacatgcttgccgaggatccggcattagttcccgaagtcgtggcggccggagcctacatacatggtcttgcgggctcgatcgcatcgcgatccgaacagcgtggatggcatcgtccgcagatctatgggcattccaaaaagcagcatttcggggaaatcggccatccgatcatcgcgagcgatattatcggcggcattcagccggcatttttgcaattactttaattgcaaaacaaatttaccgaacaccagccccaacatcggtgactttgcgctacactagcgttgccaatccgtattttgcaggaaggattttcatgacctcccccagtgccaacgtcaccgatgtggtctttgatttttgcggcgtgcttatcgactggcagacgcgcgcatgccttgaaggcaggtacccccaagtggttgtagaccgtatttgcgcggataatgatccgtgcggcttctacgattatgaggatcgcatggaccatggcgaggatttcgaagccatttatcccgacgtggtacgtgaacagggcgaagagatcgccgagattttccgcgattacatcgaacgttacggcgatgcgctcccccgcatgattccggatatggaacagctgcttcgtgatttgaaggctgcaggctacggcgtgtgggggttgacgaattggtcgcatgagacgttccatttcgcattcgaacgtttcccgcagctcggcgacctgctgcagggcacggtggtgtccggcgtagagaagatgcacaagccgaatgccgacatctacgaactggcgctgagccgtttcaatctcaggccggaatccagcgtgttcttcgacgacaccgcgaagaacgtcactggcgcacaggccgtgggcatgcacgcgttccgcttcactaacgccggtcaggctcgccgcgatctgaaatctttgggcatggatttctgactttttcaaaacgaacacttgaattaacaaagggtgcggatcgcacgcatgtgaaccgcaccccgattgttggactgaagaaattcagattcgattccttcactgtttgcaattggttctcctgagtccgttcattaaactttcccagattgccaacggcgtttgtcaacgttgatttgtgttctgtgtcaaggcgacggtatctagcgtcgctatgacgttacttcagttttgccgcgaaccgcgactgcggcggaacaacaggtagctgtatacataaggaacgagcgctgcaccaaccgctatcgtcacaataattgcgaccatgagcatgtcgcccacaggcacaacagagctgacaacacccgccacaatcaacagcactcccaacaccatgaaagagatgccacccacacgctgcgtacgcttccaattgttctcgtcgaccagagcccaaggcgttctgatgccgaaagtgtaattctggcgcatgcgcggaaggtaattgcctaagccgacgaacagcgcgcccaataccacgctaacaataagcccaacgggaccgccggtagctgggattacaccgaatgcggtggcttcagtgaaccatgtgacaccgcacatgatgagtgtgaacgcgatgacgaatccacgatacagtccgctggccttcatgtagttttctcccttggggtccatcttcgggatgacgaggaaaagtcccaagcacagcaacggcaatacatcaagaatcaacgttacggcacgcgggccataaccattgaccgaaccatcggcaccccaatgaatcggcacgttttcgggaagccgactatagcaggcaagatgtgcgatgatgttgactacacacagtgcaacaagcgcaatgcacagattgcgtccgatcggagcgatcttctcccccgaatcagtcttgttcttgtcttcggcattgttgatgttgttttttaaatcgttcaagttgttcccgcgcataagaccctcctttatttattgtctgtttgatcattcgcttgattgacgtttccatcgccgtccatgaatcccatgaaccatccgatcagatcctgcatcaccgtggtgttgagactgtagatgatgttctgcccgtgccgttcgtcggttaccagtcccgcggttttcaacgtggtcagatggtggctgatcgacggtttgctcatgttgaattgttccgcaagttcaccagccgtcatgtcacgttcgcgcagcaattccaaaatgcgccgtcgcgtgggatcggagagcgctttgaatccctcccctgccatacattcctccttcgcttcgcaatgttcacacattttcttatttagataattatctaaacatctaccgcggacatgcgtgcgttacgtttcgcacgttatggtgggaagcatgattgattggagcaaccaggactgagttttcaaagaaggcgcaccttgcccgtgtggtggagcaatggtgcgcccggtatttcgcttgacagtcgcaaattatgggatcgtggatctgtcataacgactagtccacgatgattcgacctgtttgaacggttggtcgatagtgatttgttttactgcttctggtcatagggtgggttgatcatgcggtcacgccaatagtagacgtcatcatgttcaccgatttcgcgatacaccttgcatggctgtccgaatgcgaccatattggcgggaatatctttggtaaccagcgagcatgcgccaatcaccgaattgtcgccaatggtgacgccgggaagcacggtaacgttggcgcccaaccacacattacggccgatggtgaccggcagagaatactgtgtgaccttctcgcgcaggtcaggacgaatcggatggccggtggtaatgatagtgcagttcgggccgatcatggtatgttcgccgatatgcacttcaccatcatcaactaacgtaaggttgaaattggcgtaagcgtgcgcactgaaatacgtgttgcatccccaattggcatgtaacggcggttcgatataagcgtcctcgccgaattcgccaagcagttggcgtgcgatttcgttgcgttgcgtcatttgactggggcgggttgcattgaagtcgtatagcagttccatctgttccttctgtgctttgatcatctcttcgtcatcgcaggtgtagatcagtccggaattcatggtgtcaagcactcgttgcggcacagtcatggcagcctccttgcagtcgttcatgtccgttgcgattatatacgaacacaacgccactcatgtcgtgattccgcatgcctttcgcgattctttgcacaatcatcggccgcgcgtctgccaatatcggaacgccatgcagtgtcatttacccccatttattccagcattgaaaactctgcggatggacggaagtacgttgtcaaccaggcggatggaatacgtcgtgtttgtgggtggtgggatagcatattgttggttttgtcgttgtgattgttaattgcaagtcaatagtcgaaggagaatcatgacatattccaagaatgcgccgttccgcgccgatgtggtcggttcttatctgcgtccggacgaactcaagcaggctcgtgcagattatgctgcaggtattattgatgccgctgaattgaaagctgtcgaagacaggctgatcactgatctggttgccaagcagaaggccgccggcctgcatgtcatcaccgatggtgaattccgtcgcggctggtggcatttcgatttcatgtggggcttcaacggcgtggaccatgtcgcagccgcccatcgcgttgccttccatgacgaggtcactcccgccgacactgccacggtgaccggcaagctcgacggacacgatcatccgttcgtggagcatttcaagttcgtcaggcagtttgaagatgacaataccgttgctcgccagaccatgccttccccagcgcagacccgtttcgtgcttaccggcaacaagaacgcctacccgtacgacgagttctacaaagatgacgacgagctgaccgcggatatcgtggccgcataccgtcaggtcattgccgacctgtatgccgccggctgccgtaacgtgcagttcgatgactgcacttggactcgcctgtgcgacaagagcgtgcgtgagcgtctcggctggagcgatgaggatgcggcccgcctgcagcaggagaatcttgacgtgatcaacgcagtgatcgcagaccagcctgatgatttggtgatcaacacccatatctgccgtggtaatttccattccacgtggctgtcgtccggcggttatgctccggtcgcagccaagctgttcggcgaagagaacgtggacgcctactatctggagttcgacgacgaccgttccggtgacttcgcgccactggctgaggtttccggcgataaacaggttgtgcttggcctcgtcacctccaagagaccggaacttgaagatccggaagtgattaaggctcgcatctccgaagcggcccagtatgtgccgctcgaccgcttgtgcctgtccacccagtgcggttttgcctccactgaggaaggcaacaagctcactgaggagcagcagtgggccaagatcgcactcgtaaggtccatcgccgaagaagtctggggcgaataatccaagccaatgcccggtacgaccagcttatgacatggtcgtaccgggcattgtgttattcgatgatgtgaacgcggagcattgggcgaaacgtataatacgggacagcaatcgtgaaatcataacatcgcagacagggaaagctatgagaaaagtggcttttatttgcatgcataattcatgccgcagccagattgccgaagcgttgggaaagcatctacgcggaaccgattgtgatttttattccgcaggtgtggaaaccaagccgcagatcaatcaggatgccgtacgactcatgaaagagctttacggcatcgacatggagaaaacgcaatactccaagctgatttcggatattccaaaacctgacaccgcgatctccatgggctgcgacgtgggatgtccctatatcggcaaggctttcgacgataattggaatctgccagatccaaccgggcacaacgatgaagctttcattgacgtcatccgtcgcatcgaggaaaacatcatgaagctctaaagggtcttgaccagcatccgttcgaagcccaccaaaacccttccaaagcattctaggttagcttctagcacaatcagcaggcagctaaattttgccagcgtgatttggtaagaacattcacgtgcccgacacgcacctcgtgcataagaggcaccggtacctcatcacacgtgtgatgatagacaaaaccaaccttctcctgcacccgcttcgacttcagattgccgtcataatagccgcaccaaatcgcactcataccaagatcaacaaaaccatgacggataacctccttggctgcctccggcatataacccctcccccagaaaggcttgcccagccagtaacccaactcacactcatcatcacgatccgtcatatccgtatgaccattaagctttaactcaatcgaaccaatggggttattgctgccgcgctcgcaaatcgcgtagcattccttgccattgagcacatgacgaatcgtattgagactttcttctttcgatcggtgtgcgggccagcccgcgataggcccgatatccggatctttcgcataggagtacaagctttccgcatctgtttccgcccaagccctcaatgtcagccgttccgtttccaacatgtagtcgacctctttcacacgcaatgcattgaactgaagtatagattagcctgcaaggagagtttgctgtgagttgcgcggcggaggcgtgacgcggatggaggcgatacatgcgaaagtgacggctggcctaactctcctgtgggcttcgatgaaagttacgtccagtgcagggcgtagattcatagccaacacgtaaagcaggggggctccccaacggagctgagataggcgaatgcctgaccctttgaacctgttggttagcaccaacgtagggagcgaagaatgagtgtcgtagcgcacacgcattgccagcgtcaattggcatccgtaaaagtctgcgcagcagatgcgtcgaccaaacagtctgcatcgcgcaatcatcaatcgtaattccattttctatcccgtataaccgagcatacgggcgcgtcagcatacccattgcctgcgaaatcaagttttcccaacccaaaacagcataatcaagggggaatcatgagcaattatccatatgcgtcgatgcgagacagcttcgacctgagcgcctattttgtggtaggaccacaggattgcaaaggccgaccgatcaccgacgtcatcgatgacgcattgcgcgggggcgcaagcttcatccaactgcgcgtcaaagacgctgacgcgaaggatctcaccgacatggcgcgtgatatcgcgcaaatcatcgaagacaacaataagtcggattccgtggcattcgtgatcgacgaccgtgtggacgtggtctggcaggcccgcagcaaaggcatcaaggttgacggcgtgcacatcggacagaccgatatggaaccgcgcgaagcccgtgcactgcttggcgaagatgccatcgtgggcttgtccgccgaaacggaaagcctggtcaaactcatcaacgaattgcccgacggctgcatcgactatatcggtgcggcaccactgcatgtttccgtcaccaagccggaagcgtccgtaggcggcaatgacggttccggtcgcacgcttgacgaagagcagatcaacaccatttgttcagccagtggttttccggtagtggtaggcggtggcgtgaccgcagatgatatggagatgctggcgcattcaaaggcggcaggctggttcgtggtgtccgcgattgcaggagccgatgatccggaagctgcaacccgcaatatggtagcgcgctggaaagccgtacgtggcgacacgaagcacgggtacgcgccgcgcgtgaaagcccagaaaacagcggaaatcaacactgacaacacagccgacggcgcatccggcgaaaagaagttcaccaatgcgaaggaagccaaggccgcctccaagcttgccaagcaacagcgcgtcgacattgccgcacgcgattccaagcagcgagacaaagcacatattcgcaaaaccacgccggtgcatttcgaaaacgaattcggttcctacgatctgcaagtgccgtacactgaaatcaaactgtctgacactcctggcgtcggaccgaacgcaccattcaaggattacaacaccgaaggtccgaaatgcgatccgaaggagggtctcgctcccctacgtttggactggattcttgaccgtggagacgtcgaagaatatgaaggacgtcgccgcaatttggaagatgacggcaaacgcgccatcaaacgtggcaaggcttccaaggaatggcgtggtcgccagcataagccgatgaaggccaaggatcatccggtgacgcaaatgtggtacgcgcgccacaacatcatcacgccggaaatgcgctatgtggcggagcgcgagcattgcagcgtggaattggtacgcagcgaactggccgcagggcgtgcggtcatgccttgcaatatcaaccatcccgaagctgaacccatgatcatcggctcgaagttcctcaccaagctcaacgccaatatgggcaattcggcggtcacttcgtctattgacgaggaggtggagaagctcacgtgggccaccaagtggggtgccgacactgtgatggatctgtctaccggcaacgacattcacaccactcgtgaatggattctgcgcaactcccccgtgccgatcggcaccgtgccaatgtatcaggcgctcgaaaaggtggaggatgatgcgtccaagctcagctgggaactgttccgcgacacagtgatcgaacagtgcgagcaaggcgtggattacatgacgattcacgccggtgtgctgctgcgtttcgtgccgttgacggcgaatcgtatgacgggcatcgtttcgcgtggcggttcgatcatggccgaatggtgtttgcagcatcatcaggaaagcttcctgtatacgcatttcgatgagttgtgtgagatcttcgccaagtacgatgtcgcattctcactgggtgatggacttcgtccgggatcgcttgccgatgcgaacgatgcggcacagttcgccgaactgatgactttgggcgagcttacgcagcgcgcatgggaacacgacgtgcaggtgatgatcgaaggacccggccatattccgttcgacaccgtgcgcatgaacatcgagatggaaaaggcgatctgcaaggacgcgccgttctatacgcttggaccgctcaccaccgacaccgctcccggctacgaccacatcacgtcggcgatcggcggtgtggaaatcgcccgctatggcactgccatgctgtgttatgtgacgccgaaggaacatcttgggctgccaaataaggacgatgtgaagcaaggtgtgatcgcatacaagatcgcctgccatgcggctgatatcgccaagcatcatccgcatgccatcgaccgcgacaatgccatgagcaaggcacgtttcgaattccgttggcttgaccagttcaacctgagctacgatccggacaccgccatcgcgttccatgatgatactttgccggccgagcctgcgaagatggcgcatttctgttcgatgtgcggtccgaagttctgctccatggccatcagccaaaacatccgcaaaaaattcggtaatgccgaagcacaggagaagctcgtcgccgacgcgcaaaccatcgctgccggcatgcaagagatgagcgagcgcttccgcgagcagggcggccatctgtaccagtagaccgaactgtagtaggttgtgacgaacgggattgtctggtgtgtagaaagccgggcaatccctttttgtcgcttatgccgatatggagcactccgatagggacaactcttttgcttgtaggcctgacccgtcaagccggtccgctcccattgggcgaacacctgaccggttttgtcgagcacggtttgtggggtttccaactgtgtgcgatcctcgtcaagctgcaattggttttttcacgtccttgatctgcgcgatcggcagtccactatccagacaagagggtataagcactcccccacggtcagtacatggctctaacctgaatttatgactcttcttcagctgaaatatattgtgaaaatcgtggaatgcggttccatgaacgaagcctcgcacgagctgtacgtgtcacagcccgcgttgagctcgtctgtgaaggaactcgagaacgagcttggcatcgagatcttcacccgctcgtcgcaaggcatcgccttgaccgtggacggagcggaattcctcacctacgcgcgccaggtgctcgatcaggcgtcgctgctcgaagaacgttacaagaacgcgaagccacgcaagcagctgtgctccgtgtccacacagcattacatgttcgccgtcgaagcgttcgtggaaatgatcaactccatcaaatccgacgaatacgagttcaccattcgtgagacgcgcaccaaagacatcatcaaccaagtggcgaacatgctttccgaaatcggcatcatctacctgtccgatttcaacaaagacgtgattggcaagatgttgcgcgaaaagcatttggaattccatccactgttccgtgctccgttgcatgtgttcatttcacgcaacaatccactggccggcaagaagaaagtcacgatggacgacttgaagccgttcccgttcatccagtacgagcagggcgaggagggcagcttcttcttcgccgaagaggcggtctggccggaatactcccccaagcagatcaacgtgaccgaccgtgcgacgattctgaacttcatcatcggtctgaacggctacaccgtgtgcaccggcatcgacaacggcgatctcaacaatgagaaaatcgtgaccgtgccgcttgacaccgatgagaccatgctggtcggctggatcacgaacgagcgtgcgaagctgtcgaaggccgcggaaaactatttggagaagctcaagtcggtggtggccgaccatggatacaacctgatcgactgaatgcactcatcaactggatgcactctgatatgagattgaaaagtgcctcgcaccgatgctttcgattggtgtgaggcacttttcatatgttcaactgtaggacccgcctatagaattcaggcaccatactgctccagataagcgtcggcagcggccttgatctcgtcggtcacatacgcggtgccgtcagcggtttcgatatgctggccggcctcgaagatctcgcgcacgttggcaatggcgaataccgggaagccgaactctgcttcgacggccttcaccgcggacgtgtcggaatccttggtcttttccatacgatccacggaaagcaccaagccgacgacctccacatccgcttcggccttgagcttgggaatgacctcgcgtactgcggtgcctgcggtcatcacatcgtcgacgagcagtaccttcatgccgtcggtcagctgggtgccgaccatcatgccgccgtcgccatgatccttcttctccttgcggtcgaaggtgtagccgacttccataccgtggccggaagtcagagcgatcgcggtggagacgcccagcggaatgcccttgtaggcaggaccgaaaatggtgtcgatgtcgttcggcagattgcctgcttcgatttccgccgcgatcttctccgcatagaatgcgccgagcgtggcgatcttacgtccgtcgttgaatgcgcccgcattgatgaaatacggcgacttacgaccggacttcagcgtgaactcgccgaatttcagcgcctgcgcttccagcaggaacttggtaaaacggtggtcgagggattcagtcatgtcatgctcctttgatgaatgatcgaggtcaacgccaagtttcgcccttggcgagcttgtctgcgagttcgggacgtgcgtcgagcagctcgtcgagttcgcgggccacacgcaatggcgcggtcggttcgaacagtgcggccgcaccgacttccacggcgttcgctccggcatacaggtattcaagcgccttctcaccggaatcgatgccgccgatgccgatgatcggagtgttcggtaatgcggagcgggtcttccacacggccacgagtcccatcggcagcacggccggtccggaaacgccgccggtcacatggtcgatgatcggttctccagtgcgaatgttgatgcgcatgccgagcagtgtgttgatcatgctcagcgcgtcggcgccgctttccacggccgcgcgggcaggcacggtgatgtcggtgacgttcggcgtgagcttgacaatcatcttcttgtcggtgagcttgcgcaggcgggtgatcagacggctcaacgccaccggatcagtgccgacgctcatacctccggcggacacgttcgggcagctcacgttgatttccagcatgtctgccggagaatcgttcagcttggacacgacttcgacatagtcgtcgtcgcagtgaccggccacattggcgatgaccgtagcgttgatggccttgagcttgggcaggtcgtcttccaaataatggtccacacccgggttctgcaggccgaccgcgttgatgttgctggatgggccttcagcggtacgaatgccgggattgccttcccatggcaccggggagacgcccttggtggtgaccgcgcccagttggctcacgtcgtagaaccagcggaccgccgcatactggaaggtgccggaagccgtggcgaccggattcttccacggcacgcccgccacctgcgtgggatgcttccactcgtacgaaccgtacaggttctcatgctgggtatcgtcgatcatctcattcaccccatcccaaacgttcgcgagtaaagaccggaccatcggagcagaccttcaaacgtccgtccaacgtgtcgaccgtacacagcacgcaagtgccatagccacagcccatgcgctgttccaagctcagctggcacgccatgtcacgcttcacggcccatgcggcgacggccttcatcatcggcagaggaccgcaggtcagaatcaccggcttgagtcccgaatccatcaactcgccttcgatgcggtcaagcaaggtgatcacgttgccttcgctctcgtcgatgctgtacaccttgtcggcatacttgcccgcatattcgtcgccgaaacgcacgttgcggtagccgaacaccgcggtgctgaccgcgccttcgatgccggcgatatgctgtgccgcatgcacgagcggaggcacgccaagacctcctgccacgagcacataattggcgggctccttggtcttgaacgaattgccgagcgggcccatcacacgaatggtgtccccagctttcaatccggcaaattctgcggtgcccttgcctaccacggcgaacatgaggctgacttcgtcgccgttggtttcgcaaacgccgaacggacgcggcatcagcttgcttggatcgttggaatatacgtcaacgaattgtgccggctttgcatggctggcgatgtattcgtcacggaacgtcaaacggtacacgccgtcagtcagttcctgattgtcaacgacctcgacttcatgccggctcgggaaaaagcctgccgcagtcgcttcggcaacggtcggaacgaacgttgttgcggtggtcatgaactccctctctgttacgttcgatggtttggtggttgtttttctttcagattgaacagttggccagtcggcaggttacggcaagaccgcacgcagattgtcacgcatatctttggctgcctcacgggctgattccgcaaccagatccagagcatcgtcggcgctcatggattcagaatacttgccggactttttccatgcaccgataacgccacgtgacgagttgacaagcgcacccatgccgtcacggtcgaacatgccggccacaccttgcgcggtgccgccttgagcgccgtatcccggtacaaggaagaacgtgtgcggcatgcgtgcgcgcaatgccttgccttcctctgggtgcgtggctccgaccactgcgcctacacgtgaatagccgttcttgccgatggtttcggcgccccagccttccaccagatcggcgacatgctcgtatacgcgttcaccggaggcgagttcaagttcctgcagttcactgctagacggattggaggtgcgtacaagcacgaaaatgtctttgtcgttggcggtggcggcgtcgacgaacggtgtgatgccatcggtgccgaggtatgggttcacggtcaccgcatcctcatgccatggatcataggcggtgtcgtccaatcctataccgctgaggtgatgagcatatgcagccgcggtagagccgatgtctccgcgcttgacgtcgccgagcacgtacaggccctgctgcttggcgtattcgcaggtcatggtgtaggcgtcgatgcctgccggaccgagcgtctcatacatggcgatctgcggtttgaccgcaggcacgatgtctgcgacggcgtcgatgatggcgcggttgaattcgaagaaggccacggaaagctgcatggacggcgcttccgccggatcttcaacctgttcgctgatttcctcggcaaagccggccacgatttgcgctggcacgagcgcttcggtcgggtcaagtcccacaacgctcggattctgcttggcttcgattgcttcgatcaggcgatccatcaatcctccttgttgatacggctgaagactagtttcgagccgatgatggtggcgagcggacggccggtgacctgccatccaccaaacggggtgttacgagccgaggaatggaatcgttcaggattcacggtccatgcctcgtcggtgttgagcaccaccagatccgcgcggtcttctgcaggaaccttgacgaggtccagcacgcgtttggtgtcgtcgtctccggggacggcgtctgcgtattcgtcaagcaacgctgtgacgtcggccttgctgtggcccataagttcggctggcgcagtcgacatgagttcaatcaggcgttcgtcggagataaagccaccgtccacaagaatcttgtggcatacgccatacgcgcattcaagaccaatgatgccgttcggagcatcgaggaaaccaaggtccttctcttccatggtatgcggtgcatggtcggtggccagcagatcgacggtgccgtcagctacggctgcgatggttgccttgcgatcctcttcggagcgcaacggcggattcatcttggcgagagtgccgtatttcagcaatgcttcatcgcacaacgcaacgtagtgcggtgcagtttcgcacgtgatcggtaagccttcagctttggccttgcgaatcgcgtcgaaagaaatcgcagtgctgacatgctggaagtgcacatgcacgccggttttgcgcgccatctcgatatcgcgttcgacgattttcagttcggtatcttcgggaatgccgggtacgcccagttctcgtgatacgggaccttcattgaccgccccggtgtcgtggtgttcgcaatgctcgatcaggtataagcctgatttcttgacgttgtcgaacacttggtcgaggatttccggtgttaccgcggaaccgtcatcgctgatggcggtcaccgggtggcacagctggtaggcgtccttgttgtcgtcatcgtgttcaggcaggtagccgatccagtcggccacgtcggttgcttccttgcctgcacgccctttggaagcgcatacgcacaggtcataacgcaccggcaaggtcacattatgggcttgttcgtaatgctgcaaatagtcgatgaccgtgtcgaaaccggcgtcgagcacttcactggcgcccggttcccccgccgtcaccttcacgccatccatggcgggaacggtgttcggcatgatgagcacgttcgtatacccgccagaggcggcagccgcgcaaccggaaaccatggattccttgtaggtctggcccggatcgcggaagtggacgtggggatcttcgaatcccggggcgatggtcatggccgaagcgtccaccgtttcatcagcgtcagatgggacgatcaggtcgatgacttcgccggtgttccaaaccttgatgtcgtgaagggtgagggtcatgggtcagaacttcgcttcctcgtcacagtagtcgcagcggtattcctgacggtcggaatgcaccaggtggaacatctgtacggccggctcggtggtagtcacgcagcgcgggttcacgcatttgatgatattgaccacatgttccggcagtgtaggctgctttttctctacgattttaccgccgcgcacaatgccgacggttgcggtgcgtgccacaaggccgagcacgtcaaggtcgatggtttcggcttcctcttcgctttcgattttgatgatgtctttggtgccgaacatgtggctgtcggtgttcatgatcagcgcgagcttggtcttagccggatcaattttcaggtattcgagcaccttgagcgcggtgccagcaggcacatggtcgatgatgatgccgttctgaatgctggtgacttccatcaggctgcaacctccttggattcaagcggttcatatcccggcagttcgtctccgaccaccgagctttccaatgccatgcgcataagcatgccgttcttgacctgttcgaagtaggcagcgcgtgggtcgtcatccacttcgacggcgatttcgttgactcgcggcagcgggtgcagcacggccatgtctttcttggcgtaagccatcttggcttcgtcgagaatgtaggtgtcgcgcagtcgcagatagtcgtcttcgttgaagaagcgttccttctgcactcgggtcatgtacagcacgtcgagatcgccgatcacggaaacgagatccttgacttccgtgtaggagcaggagtcggtggcgttgatgcggtcgagcacatactgcggggtcttgagctcatccgggctgatcagcacgaagttcacgttgccgaaacggcacagggtttcgatcagggaatgcacggtgcgcccgaaagtcagatcgccgcacagtccgacagtcagattgttcacgcgaccgaagcgcgactgcatcgtagcaagatctgccagagtctgcgtggggtgcatatgtccaccatcgccggcgttgatgaccggcacggaggctgcacgggacgccacgagcgcggcgccttccttcgggtggcggatcgccaccacgtccacgtagttggacacggttttcaaggtgtccgaaatggtttcgcctttggtcacggaagcgagctgggcgccggcgaagccgatcaccttgccgccgagtcggagcatggcggtttcaaagctcagacgcgtacgggtgctgggctcataaaataaagtggcgagcaccctgccgtcgcaggtgtgcgccacttctttacgatgagaatcaatgtactgcgccttgtggagtaattcctgaatctggcgaatggaaagatcatccaatgtgatgacgcttttcccgaccatcggcgtttcaaccgcctgttcgagtactgaagacaacggctcacctttcatgcaacttgtggttgaaggtggccactcgaagtgacctagccaactatagcctgaaatgcagaccctgccagttcaccgcgtgttcacaagtattcgtggcgcaacctccatccttccatgcacgaaaccctgaatcagcataaccgtcagagccgtataacttcggtccgacggccacaccatgctcctagccgttcaaatggcacgactcacgaacgaccgtagaacaggcgttccgttacgtcacgggctttgcgtatcacggcgagcaggtcgttttcgaaatgttggccgcgattcgcatcgtaaccgagatacacggcgatgcctcccagcgaatatgaatcgtccggcaaaatatcagcctgattgacgcgtccgctccacagataactgccgttgcgcgcggccgtgcacatacgccatgccttacgcaacaccacagcatcgccagcggaaatcagcttgcgatgttccaactcgttcaatgcctgcaacgtaccgttgacacgcaagttggcattgtctcccgcatgctgcaattgcagcaactggatcgtccactcaacgtcagacagtccgcccttgccgagcttcagatggcgatccctacgtactccgcgcggcagacgttcagcttccatacgtgccttgagtttgcggatttcggcgatctgcgtttccgtaagatcgattttcggataacgcaacgggtcggcgatgttcatgaggaaatcctcggcaagagacgcgtcgcctgccgcatatcgtgcgcgtaacagcgcctgatgctcccatgtgcttgcccaggatcgatagtattcctcgcaggatgcgtaggaacgtacgagcggtccgtttttgccttcaggcctaagatccatgtcaagttcgatttttggttcgaatgtggttggaccttgcaggatcgcacgtaggtcttcctgcacttttcgtgcgaaaaggttggcttggtcgtcatcggcaccttcggccggcctgtagatgatgatcacgtcagcatcagagctgaagttcacttccctaccgccgtaccgtcccatgccgatgatggcgatcgccgccggagcttcgtcgatctgtatgtcgttgatgcgatgctggatggcccactgcagcgatgcttcgatggccgcgtcgtatacgtcggtcatgccggcgagcgatgcttcatcgtcgatcacgccactcatccaagcgagaccgatgcgttcgatttcgtgtctgcgcatggctcggatggagttggcgaaatcgttgatgttgccggcattgcgttcaagcgtcgccttggtttgaatgtcgaggctttctcgcgaacgtggttgcaaagagtcgtcgttgccgagccatgtgactgattcgacggatttgttgagtgcgtcgccgaggaatcgtgagttggatagtacgtggcataggcgttgtgccgcggatggtgaatcgcgtaggaatccgaggtatccgctttcggagccgaagttttcttcaagtttgcgccagttaagcagtcccatgtcgggattctgcccttcgccgagccattgcagtactgcggggagcaggatgcggttgatttttgccgcacgggagatgcctgcggtgagcgcggtgacgtgccgcatggccgcgtcggcatcggcgaatccgatggattcgaatcgttcctgcgtggctttcgtggagagttccacctgttcgtcgtcgagtcccgcgttgatgggcagcatgggccggtaatagatgtccatgtgcaggtgacgcacctcacgacgtgtctcatcgtatttgttgacgagttcttcgggatgcatgtgaaatgcgcgcgcgagtcgacgtagttcgggattttggttcagctcgtcgatggtgatgtctcgtttgcgttcaagaccgccagcgttggctttgccgaggtctgggaacaggtgggtgcgtttgagcgcccacatttgctggcggtgttccatcacacgttcgaatcggtagtcccatgaaagtttcttggcttgtttgcgtgagacgtacccgccttcggccaaggcctgcagggattcgagtgtggagctggtacgcaatgcttcgtcggagcggccgtgcacgagttggagcatctgcacggtgaattcgacgtcgcgcaagcctcccctgccgagtttgatttcgcggtctttcagcgggttgggaataaggtcttcgacacgtttgcgcatctgctggcagtcatagacgaagttgtctcgcttggaagctgtccaaacgaacggtcgggtcatatccatatacgcttgtccgaggtcggtgtcgccggctaccgggcgggctttgagcagggcctggaattcccagttttccgcccattgctcgtaataggcttcgtgggattcgagtctgcgtaccagcggaccgtccttgccttcggggcgtagtccaccgtcgatctgccagagtgtcggttctgcgacgcccatgatgacggattggcatacacgctgcagcgtggtggctattttggtgccgattcggctgagtgccatgccgttggtgtccatgtcggcgggttccaccacgtagatcaggtccacgtcggatacatagttgagctcctgtgcgcccagtttgcccatgccgatgatggcgaaacgcacatgttcgctgccgtccacttcatggcgtgcgatggcgagcgcgccttcaagcgccgcgtccgcaaggtcggaaagttcggtgctgatgcgcggttggatttcgatgggatcgttcgccgtggcgtcttgcgccatgattgcggcgagttgtttgcgataggttttacgtagcgccgtcgcagcttcggcaagtggcaggcttgcggtcggcatggcatggtcattgggatcagcacctaccgatttgagcacatgcgctttgcgctgttcgtgattgtagagatggctttcgcaggcatcgttggctgcggcctccacgagttctggacggaatcgcatgagcttgcccatttcatcggatacgccgagcacggtgatcagtcgcacgaaagagttttcatcggcgatgatgttggtgaaatccttgccttgactttgcatcactttgatgatgtccaccaggttgctgagtgcgatgtcgggatcgcacgctttttccagcgtggctagtagcagccgcatcctgtcgtcatcgatgccgtcattgtgcagctcgtcgaacaacgtgcgagccctgtcgagatcttgcagccctgctcgaatcagatcaagcgccccgaacttgtgttgcatggaagtcatggtttctatagtaaccgctgataaaaccaagggcggttgcgaaatacccgcaaccacccttgatgtttgttgcatcgcctgaaatcagacgaagaatggtttgacgttggaccaaatgcgtcggctgacacatggatggttcatcgtgtacaggtgcacgccgtcgacgccccgcgccaccagttcgcagatctgctcggatgcgtaggcgatgcccgcttctttgagcagagccttgtcacctccccatttatcgagcatgatgccgagtttttcaggaactttcgactggcatttgttcgacatgttcagcaccgatttcgcgttcatgaccggcatgatgcccgcttcgatcggcacgtcgattcccgcagccctcgctttgtcgaggaatctcaggaagtcctcgttgtcgtagaacagttgtgagatcagatgcgtcacgccggcatcgactttctttttgagattgtcgatgtcctcttccagcgttgccgactgtgggtgcttttccgggtagcaggcgccgtagattttcatgtccggacgttgctggcggatgtatacggccagatcgctggcatgttcgaatactcctgccggttcggcaccgtcgatgcggtcgccacgcaaggcgagcacgccggagaccttggcctgttcgaacatgtcgagtgcctggtcgacgtcatccttgttcagatactgcgcggtcagatgggccacgctggggatgccgtattcgcttaccgtgtgggcgatgcgcgcggtcaatgtacggtcggatgatttgccggtgccgtaggtgacggaaatgaaatcggggtccaacccctgcaggccatccaacgtgtcgtagatggtgcctacaggggaggttcgcttcggagggaacacctcgagcgagaacattggcgaatgcatggctgtcgtcttgttcctaacgtttcgccttatttggtcagcttggcacgcacagcctgggctgcggccacgaggttttcgaggcttggccaggtttcggcgttgccgcgggtcttcaaaccgcagtcggggttgatccacaccttttcgacgtccatcttcttgaggatttcgtagatgcgttcctcgatttcggcttcggacgggatgcgcggcgagtggatatcgtagacgcccgggccagcttcggtttcgaagttggcgtcgtgaatggcgtcgagcaccacgagatcgccgcgggaggcttcgaaggagatcacgtcggcgtccatggcgtcgatgtcggtgatgatgtcgttgaactccgagtagcacatgtgggtgtggatctgcgtggtcggcttgaccgcggagtgcaccagtcggaatgccggaatggcccagtcgaggtacttcttgtgccagtcggtcttcctgagcggcagcttttcacgcagggcggcctcgtcgatctggatgaccttgatgcctgcggcttcgaggtcgagcacttcgtcgcggatggcgagggccagctgctgggtctgctgctcgtgggtgatgtcctcgcgtggccaggaccagttgagaatagtgaccgggccggtgagcatgcccttcatcacatggctggtacgggactgtgcgtaggcgctccattccacggtgatcgggttggcgcgggacacgtcgccccatacgatcggaggcttcacacaacgggtgccgtaggactgcacccaagcgttcttggtgaacaggaaaccgttgaggttctggccgaagtattcgaccatatcgttacgctcgaattcgccgtgcacgagcacgtcaaggccgatctgctcctgatgcttgatgcaggcgtcgatctgcgccttcatgtattcgtcgtattcagtcttggtgatttcgcccttgcgcagtctggcgcgttcggcgcgcacttccttggtttgcgggaaggatccgatggtggtggtcggcagcaatggcaggttcaacgcctcccgctgtgccttctgacgttcggcacgtgccggctggcgcacgaagtccgagtcggtcagggctgcgagacgttccgccacgttcttgtcggcggcgacgcgggtaccgtcgaagagcgcctggttggctgccaatgccccggatgccttcttgtcttcctcgctggcgtcggcgagaaccgcgaggtcgtgcagttcgccgagcttttcaacggcgaaggcgaaatgcttgcgcacatcatcggcgagaccgtcttcaccttcggtgctgaacggcacatgcagcagggagcttgcggtggagacggccacgttgtcggtgaccttcttcagcgcgtcgacgagtccaaggctgacggcgtaatcgttacgccagatgttgcggccgttgaccacaccggcgaagatggtggtgctctctgcgacgccgaacttttcaacggcggcgagattctcgtccttgccttcgttgaggtcgagtccgatgccgtcgaaggcgagcaggttgactgtctcatacacgtcggcgatgtggccgaagtaggtgttgagcagcaccttgatcttgccgtcgcgtgcgggcaggatcttggtgtacaggctcttgaacagttcgacgtcgcccggctccttgtcgagcacgaggtacggttcgtcgatctggatccattcggcgcccagctcggcgaacttggccacgacctcggcgtagacggcggcgaccgcgttgaccaggcccttgtcgtattcgagttcttcggcctgcggattgcgggcgagcttgaggaaggtgtacgggccgatgagcaccggcttggtggtgatgccgagcgccttcgcctcgttgaattcgtcgaacggcttggtgctgttgagcttgatgtcggtggcttcgtcgacttccggcaccagatagtggtagttggtggtgaaccacttcttcatcggcagcgcggtgacgtcgcccttgtctccttggtagccgcggcccatggcgaacagcgtctcttcgggattgtcgaaggcgaggcgctggtagcgctgcggaatgacgttcagcaggatggcagtgtcgagcatttggtcgtaatagctgaagtcgttgctcggaatcaaatcgattccggcttcctgctgcagcttccaatgcttggcgcgcagctccttggcggtggcgcgcacgtcgtcgagcgttgcgacacccttccaataagcttcgataatcttcttcagctcgcggttctggccgatgcgagggaaaccggagacggaagtgagaacggacatgaatcctccatctgatatgaacaatgcaacccgctcaagctaccacgaaatcgccagctataactcatcaagaaaatttaagtgtcgctataagcacgatttatatcagttggcatggcaacatttcacgcctctcagcatcatgtcgagaggcgaaggaatcattcaaaatccttggccgtcagcaatgcgatgagttcgccactgtgcagctgccattggttgaatggctcatttgatccgaacacggcgagagatgccggcgacatgcccagattcagcatgtcgagcagcattgcatccgattcggagctcgccagccattggcatgcgatcgacacagtgggctcatggccgagcaccaacagctcgcgatgcttctccttggtctgagcaagctcgtcaaataccgactgcaccccaccttcgtacagactctgacgatagtcgaccttcgggtcgtcgccgaacaccttaagcatgcgatcgcaggtctgcctggccctggtggcgctggagcacgcgatgcgcgtcggcaccatcttgtgcgcggccaggcctttggcgacggctttcgcctgcttacgccccttgtcggtcagctcacgcccggcgtcgccaccgtcaccaaacggctcggttttggcgtgacgcatcaccagcaacacatacttgtaatccttggcttttttcgcaaccttcttgaggctcgttcccatggacgaatgctccaatccttaacgatccagcgtatgcaccaacgcaacgcgctatgactattgtctcagaacaacggcaagaaacaccgtatcaatcgccgatagcctcgacctgcgcgtcgagatcacgcagcaccttacgcaacttgcgatcggaaatatcccgcaactcaagatcttcgagctgttcggcacgttcttcggcgctcagcgaatcaatatcggtggtcgtgtctttcgtggcacggtcacgcttgcgcaacgcctgaaatcccggcgccatagcccgcgaaaccataaggaagccggtgtgtccgatcatctgatggtcgggacgtatcgccaatccctgaaccttccagtcgcgttccagagtctcctggatatccggttccgtccagcagccagcctccctcaacgcctccgccatacggcttagctgcgtagtagtggtcacatacgccacgagcacaccgccgggcgcaatcactcggtatgcctgctcaagacggttccaggggtcaagcatgtcaagcatgatgcggtcgaaggaatgctccggcaatgtggcggcgaccgaatcgaaatcaccgattttcagatcccaccatgcggggcgcccgccgaaatagaccgtggcattcgcttcggccacgcgggcgaattccgaacgcatctcgatggtggtcagtcttccacgctcccccaccgcgtccagcaggttgacgctcatggcgccggatccggcaccggattccaacacgttcatgccggaacgaatgtcgccaagctgaatcacttgggcaatgtccttcggatacatgatctgcgcgccacgaggcatcgacagcacataatcggccaaccgagggcgcatcaccgcgaactgccatccgccaatggcgcgcgttcccttccaaggcttgttggcgtcgcgttccggatgatcctgattgatctgcgcctcacgtttggcgctcaccgtcaccaccacggacccttccgactgcccgatcacatcgtcatgcagaatgatgccgtgcgaggtctgcgtcacaccgcccggcaccaattggtcggtgatcttattggatctgcgatccgtgaactgtaccttctcacccgccgtcaacggtcctcgacgcatcaatcactccttcatacccacacggattccaccatcacgacagcacggaaccgaatgactcctgtccgacgctattcatgctacagcatattccggcgcacacagcacccgttaccgcgcgtacgcgctccaacgtccattcgcatgcgtcacctcaagctccaaaccgaacacttcgctcaaccgttccgaagtgaaaccgtgttccagatcacccgagtacacgatggtgcccggagccggatcgttgcctgcgacattgtcggcgtaggcgtcggcctcgctgccggtgatcctgcccatgatcgccacatggtcgaatccctgcggaatctcctcaagacgatgcgtcaccagcaccacggcacgatccgactgctcggcgccgacacggctcaacgcacgaagcgcaatctcacgaccgcccaaatcaagaccggtagtcggctcgtccaaaatcagcaaatccggatcggccatcagcgcacggcagatcagcacgcgcgtacgttcgccttccgaaagcttgaacatcatcttgccttcgaggtattcgatgccgaattcgcacatcagggagcgcgccttggcatagtcttcgtcggtgtaggtgtcgcgccaacggccggtggtcgcggtcaatgcggtcacgatggcgtcgagcggatcttcttggggagggaacgcgcgactcagttccgcggagctcaaaccgatacggttgcgataggagaacacatcgaccttgcccaagcgattgccgagaatgtcgacggtgccttccgacgggaatcctctggtgctcatcatttgaaccaagctggatttgccgatgccgttgggtccgaacagcacccatttctcgcccttgttgattttcagattgaccttggtgagaatcacgcgtccacggcgacgaaattccacgtcagcgagttccagtgcgatgttctgctccggcattcttcctcccctatcgttgttcggcttgtagatatggaaacgccttccgccagcataatgctttcagcggaaggcgttccacgcatcgtctacgtggtgaactggttattcggcggttttgccctgctcggcaagcacgtcttcatagaccttgacggtcttgtcggcgatcgactcccagctgaagtggtcgcgcgcacgctcgtaaccggcctgtcccatctgcttcgccttttcaggatcggccatgatgcggttgatagcgtcggccatgtcatgcacgaacttgtctggattggtcggagtgccggtgccgtcgtgcagctggtcgacaggcacgagatatccggtttcgccatcgacgacgacttcgggaatgccgccggtcgcggaggccaccaccggaaggccacacgccatggcctccaagttcacgataccgagtggctcgtagatggatgggcagatgaacgcgtcgcaaccgtgctcaagcgcgttgagctccggcttcggcagcatctcctcaatccagatgatgttgccgcgctcctcgtcaagcttggcgaacgcggttttgacctcgttcatgatctccggagtgtcgggcgcgcccgcgcatagcacgatctggatgcccggatcgacgaaatgcaacgcccgaagcaggtatggcaggcccttctgccgggtgatacgtccgacgaacagcagcgtgggcttgttgcggtcgatattgtagcgttcgaacaccttccagcccggatcgtcgtcggatggggtttcgaactggctcatggtgataccgttgtgcaccacgaccaccttgtcggggtcaagattcggataggcgctcaggatgtcttcgcgcattcctgcggacacggcgatcacgcggtcggcatgctcgtatgcgtcacgctcggcccacgagctcaaatcgtagccgccacccagctgttcacgcttccatgggcggaacggttcgagggaatgcgcggtgatgaccagcggcgttccgtgcagcatcttggcaaggtatccggccaagcatgcataccacgtgtgcgcgtggataatgtcggcgtccacatcgtcggcgatctgcagatcgacgccgaacgtcttcagcgcgccgtttgcttcctggagttccttgggaacgtcgtatccgacgaccttgagcgaacctttcggattgtcacccgggatttcgggaatctcattctcggcacgtggtccgtcaaacgcacggaccgtcacatccacgcgttccgccagaactttggaaagctcctccgcgtgcacgcctgcgccgccatacaccttgggcggatattcacgggaaaggatgtcaaccttcatatctgtgctctcctcttcgagtcaggcagttgttccatcactactgtaaggcaatttttcaatgaaacgcctgattgtttcattcgtgtcacaaagttttgcatctttcctaaaaatgcaggcaaggaggtcaataaaccaggaacgaatagtgccgtcattcgtgactcgcatgtgaaagcggggctgcatccttccatcggatgcagccccgctttacgttcatcgccttgctatcagacggccgtaccattctgatcgaggttcggattatgcttcgggttacccgccgtgaagaacaggctaagcacaccgacagcgaagacgatggagaccgtggcgaccaaccacatgggatgtgacggcagccacatgatcaccaggaatgcgattgcggacagtgcgatgagcagccagctgatcacgcggaaccattggcgtgcggaatgcggtgccttgaacatcttcgggttcgtgtagttcgggctggtggtcagcaggctttcggtttcttcgatggtgccgccggtcggcttccaaggtccatcggtaccgtcttgcagtcggcgggacttttcctgcagctggtattcgtccagcattccggaacgtgcgcggccatgggtttggtcgtactgctgcggcactcccctgcggttgttctttgcctgcgctcgacgttctgcacgatttggcattgggtcactcctttgttgcgatgtgctgcagttcactttactgcatgactgccggtttttcgccgaacggcacgtcattcggacgtttatgccacgtctgtattgttcgaggttccgggaagtggggatatgaaaaatcgtccgattccgttttggcggagaatcggacgatttttctgttacgttaactgcttatgttcagcgcggcagcatcatcggccttttggatgcgacgatgggtgccggcagttcggtggcgccggtgaggtattcgtccacggcggccgcgcaggaacggccttcggagatggcccacaccacgaggctctgaccgcgtccggcgtcaccacaggcgaacacgccgtcctggctggtagcgaacttgtcgttgcgcgccacattgcctcgtccgtcaaggtcgacgggcagctggtccacgagcgtggtggtgtccgggtgcaggaagccgacggagatgagcaccaaatcagccggaatcacgcgttcggtgccgggctgacgggtgaacggtccgttttcgccgggtgcaacgttcactaccttgagaccggtcacatgtccgttctcatcggccacgaagccttcagtagcggtggaatgctccaccttcaccttggcctgttcctcttcggtaccgacgaagttcacagaatccgtgctgtacacgtactcggcgcgctgggtttcgaagccttcttccatggaggaggtcttctggtacaggcgcgcgaaggtcggccatggctggttggccgggcgttcgcttggttcctgcggcatgatctgcagcacagtgacgtccttggcgccttggcggatggacgtgcccaggcagtcggatccggtgtcgccgccaccgatgatcacgacgtgcttgccttcagcggtgatgtcgttgactggcttgacgccgtagacgcggcgggtcgcgtcgggcaggaattccatggcaaagtggatgcccttgagttcacggcccggaatcttcatgtcgcgcggcacggtagagccgatggcgacaaccacggcatcgtagcgggatcgcagatcgtcccatgagatgtctttgccgatctccacgccggtgcggaacacggtgccttcggcttccatctgttccacgcggcggtcgatgagtcgcttgtcgagtttgaagttcgggataccgtagcgcatcaggccgccgatggcgtcatcacgctcgtatacgaccacggtgtggcctgcgcgggtaagctgctgggcgcatgccagaccggacgggccggagccgaccacggcgacggtctggtcggtcaggcgctgcggaggcaatggcttgacgtagtcgagttcccaagcctgatcgatgatcgtgcattcgtcgttcttgatcatggtcggcggctggtgaatgccgagcacgcaggctgcctcgcacaacgcggggcagatgcggcctgtgacttcggggaagttgttcgtttcggacaggcggttgtacgcgtcctcccacttctcctggcgcaccagatcgttgaattctgggatgatgttgcccagcgggcagccgctcatgcagaacggcgtgccgcagtccatgcatcgggccgcctgttcggtggtccaaggctgcaggccggattcggcgtggacgtcgaaccaatccttgattcgctcctcgacggggcgttcggccagttcgcgacgggtacggaccttcaggaatccacgtggatctcccatgtcagcgcgctccttccataacctgctcgtacacctgttcccagacgccgggcgtattgaaatcgatgttgttctcttcggcgttcttcatcgccttctgcatggcgaggaagtgcttcggaacgatgtgtgtgaatcgcttggatgcgttctcccagtcggcgagcagtccgtccgcgaatgcggagcctgtttcttcggcatgctgcttgaccagaccgtgcacgatttcgttcgactcactgtcgagcggttcgaacagcaacgcgccgttggcggcggcagccgggttgacctgcttcatgtcaaggtcgagcacgtacacgtggccaccggagaagcctgcgccgaggttgcgacccgtgggaccgaggatcacgacggtgccgccggtcatgtattcgcaaccatggtcgccgacgccctccaccacgaaggtggcgccgccgttgcgcacgccgaagcgttcgcctgcacgacctgccacgaacatctggccggaagtggcaccgaagccggtgacgttgcccgcgatcacgttctcatgcggatcgaaggtgatgcccgcctccggacgcacgaccatgcgtccgccggaaagtcccttgcccgcgtagtcgttgacttcgccgtacacgcggatggtctcgccacgcggaatgaacgcgccgatggactggccgcccgcaccatggaacgtcatgtcgatggtgtcgtcaggcaggccttcctcgccgtaacgcttggtgatctcgtagccgaccatggtgccgagcgtacggtacacgttacggatcggcatctcgatgcgcaccggctccttcttctcaagggcgggctgcgcgagctcgatgagcttgttgtcgagcgccttgtcgagctcgtggttctgctcgatggtctggtgcaggatggttcccggcaccggtcccggctgcatgagcacgttgctcaggtcgatgccgtcagacttccaacgcttgatcgcttcgttctggtcgaggcattcgacatggccgacggcctcttccaaggtgcggaagccgagctgggcgagcagctcgcgtacttcctcggcgatgaacatgaagaagttgatgacatgttccggcttgcccttgaagcgtgcgcgcagttcgggatcctgggttgcgatgccctgcgggcaggtgttcttctggcaggcgcgcatcatgacgcagccttcgacgatcagcgcggcggtggcgaaaccgaattcctcggcgccgagcagggctgcgatcaccacgtcgcggcccgtcttgagctcgccgtcacattgcacggtgatgcgggaacgcaggccgttgagcacgagcgtctgctgggtttcggacaggccgatctcccacggggtgccggcgtgcttgatggcgttgagcggagccgcgccagtgccgccgtcgtagccggagatcagcaccacgtcggcatggcacttggcaacgcctgcggcgatggtgcccacaccgaactcggaaacgagcttgacgtgcacgcgggccttcggattggccatcttcgcgtcgttgatcagctgcttcagatcctcgatggagtagatgtcatggtgcggcggcggggagatgagctcgacgcccggagtcgcgtgacgcaccttggcgatccacggcggaaccttggcgccaggaagatgtccgccttcgccaggcttggcgccttgggcgagcttgatctgcaggtcggtggcgtgcaccaagtagtcgctggtcacgccgaaacgtgccgatgcgatctgcttgatcttgctgtagcgcagcggatcattgatgcggtcttcggattcgccgccttcaccggagttggaacgtgcgccgatggtgttcatggcgatcgcgagggtctcgtgcgcctcctgggagatggagccatagctcatggcgccggtggagaaacgcttgacgatctcgctggccggttcgacctcgctgatgtcgatcggcttgcgaccggacttgaacttcatcaggccgcgcagcgtcatcaaacggttggaggtgtcgttgatgtgcgccgagtacttcttgaacatgtcgtagtcaccgcgctgggtggactgctgcagcaggaagatggcttcagggtcgttgaggtggtcttcgccggtacgacgccacttgtattcgccgccggtgcgcaggttgcggtgcgggcgggcggtccactgcgacgggtaggccacgcgatggcggatggcgacctcttcggccagttcgtcgagtccgacgcctccgacgcgggaggtggtgccggtgaagtattcgtcgatgacgtccttgttcaggccgatggcttcgaacagctgtgcgccacggtagctcatgatggtggagacgcccattttcgccatgatcttgagcacgccggtcgacaacgcgttggtcaggttcttcaccgcggtttcggcatcgacgttgagatagcccttgcgggacaggtcttcgacggattcgaacgccagatacgggttgacggccgccgcgccataggcgatcagcagagcgacatggtggatttcacgcacatcgccggcctcgacgaccatggagatctgggtgcgcgtgtgtctgcgcagcagatggtgctgcaccgcggaggtgagcagcagcgacggaatcggtccccacgtgtagttggagtcgcgatcggagagcacgaggaagttggatccgttttcgatggcttcgtcgacttcctggaagatctcgtcgagacgttccttcagcgccttgccgccgccagcgacctgataaagacccttgacgacgaacggcttatagtagccgccgaggatcttggcgcggtcgaggcgcttgagctgcgccatctcgtcggagttgagcaccggcaacggaatgaggatcttcttggcatgcagttcggaatcggccagcaggttcggctcgggaccgatggcggattcaaggcaggtcacgatcttttcacgctcccagtcgagcggcggattggtgacctgcgcgaacttctgggtgaagtagtcgaacagcatgcggctgcgggaggaaagcgcggccataggcgcgtcattgcccatggatccgagcggctccttgccggtgttggccatcggggcgagcagcagcttcagatcctcttcggtgtagccgaaggcgcgctggcggcgttgcacggactggccggagtggttgacgtgctcgcgcttgggcagctggctcatctcgacggtgttgccttcgacccactgacggtacggatgctgggacgcgagggacttcttgatctcctcgtccgggatgatgcggccttccttggtatcgacgaggaacatcttgcccggttccaggcggcccttggacacgatgtgttcctcggcgttctccgggagcacgccggtttcggatgcgagcacgatgtagccgtcgtcggtaagctgccagcggccggggcggaagccgttgcggtcgagcagcgcgccgacctgggtgccgtcagtgaagatgatgtgcgccggaccgtcccacggttcgatcagcgtattgttgtattcgtagaacgccctgacatcggggtcaagctggtcgttcttctcccatgccggcggcagcatcatggagatggcatgtggcatggaacgtccggacaggtgcagcagttcgaggcattcgtcgaacgtgccggaatcggagtagcccggggtagcgatcggcagcagcggcttgaattcgccgagcagttcggagcttaggcggccttcacgtgcggacagccagttgcggttgccctggatggtgttgatctcgccgttatgggccagctggcggaacggctgggccagcggccagctcgggaacgtgttggtggagaagcgggagtgcacgatggcgatcttcgccttcatgcgctcgtcggaaagatccaggaagaagggcttgagctgcatggtggtgagcatgcccttgtaggtgatggtgcgtgcggacagggacgcgaagtagatgcccacctcgtgttcgacgcgcttgcggatgcggaaggtcttgcggtccagttcgatgcctgcaagctggccttcggggtcggccacgaccagcgtcttgaacgcgggcatgctggcgagcgcctgcagtccgagtccgtccgggttggtgggtacgacgcgccatgcgagtacttcgaggccttcttcgcgcacaattttggcgatggcttgttcttgttgtccggaggtggcgatgtcgcggtcgaggaatgcgatgccggcggcgtagtggccttcttcgggcagttcgacgcctgcggtggcgcgcatgaattcgtcgggcatgctcatgaggatgcctgcgccgtcgccggtgttttcttcggcgcctacggctccgcggtggttgaggttgacgagcacttcgatggcgtcgtcgacgattttgcgttcggggcgcttgttgagggtggtgaccatacccacgccgcaggcgtcgtgctcggcgccgggatcgtacataccttgggaatcatggatcgtgagatctaacggggcgtggaaagtcaccgaaaccaccttcaatgtttttgggcaagaaaagtcttgcggttctttaatgcgtggtttagaataccgcgcccctgtatcaaatacgtttcgcgtgtccatataacgaatactcggaaaagtcaagactgttttttcttgggaaaatgtggaggatatgtgttgggttgtggtggttgccggtatcgatgcgtgtcgttatgctggtggttgtccgaagagtacaggggagccgatgtggctgagatgggcgtttgcccggacccttatgacctgaacagggtagtgcctgcgtagggatgttacgaacggtgcgcgtgcgcgtcttctctgtgctgacggctggtgtttggccgtgtgtttcgtggaaagagaagggatttggcgtgtctgatgcgtcgcaggtgcctgagcagcttggttcgggttcgaagaagttgactccgaagaatgtgctgctgggtttgcagcatgtgttggtgtccaatgtgtggcttgatccggtgtttgtggctggtgccattggcttgccgttggcgttgtcgtcaaatatggtgaatgccattttcattgtgtctggtttggtcacattgattcaggccacgaggttggtgcgtttgccgattgtgcagggtccgtccgccgcgttcgatgcgttgatgatcgctgcgggcactgctggttcgttggctgccgctggtacgtcgatttttgtcagttcgctgattttcttggtgctgtgtctgacccgtgtgattgagaagatgcgttttctgttcgcgccgatagtgtcgggcgtgattatttttctggttggcgtttcgctgtcgagtttcacgttgagcgagtttcttggtggcgctcccggcgatgatggttttgccgatccgaagacgttggccgtgtctatcgtgacttgcgtgctggtggtggcgctttcccagttcggcaagggtatggccagggcgctttcctatctgattgctctggttgccggcactgcgctttcgatggtatttggcatggctgatttttccggtgtcgcgtcgaagccttggtttggtcttcctcagattatgccgtatggcggttttgactttgatgcggcggtgtttgtgccgttcttcatcgcatatatggttgcgattatggaggcgcttggcgtgtatcaggcggccagtgagatccagggcgtcaagcttgaggatcgtcaggttcgttatggtttggccggcgaggctgccggttccgcgatttcttcgctgatcggcggtttcaccactaccgcgtatccgcagaatgtcgcgttgcttaaggtcacggatgagggcaagacccgtacccgtgtgccggtgatcatcgccggcgtggtatttgtggttcttggtttcattccgaaggccggagcggtattgtcgttgattccttcccctgtgatcggcggcattttcctgccggccgcggcaagcctgatcagcacgggcttcaatacgctgcgcaaggtggagtcgaacgaccgttcccaggcggtcattggattgtccctgctgttgggcatcgcgctgccgagcgcgttgagcggcttggagggcggcgctcacgtgttcttctccaattcgattctggttggggcgttctgtgtggtgattctcaaggcactgctgatcgacctgccgaatctgatcaatcgtcgtaaaggaaacagcgaagctgaagttccgtcgcagatctgatttgctttcgaatatcagtatcgtttatagaaaggaataccgcatatgacatcaatgtcgttgggtgccgacgcgcaggaagtcaaggcaaacgtgcttgagttcatcgaaaagtatggttgcgaagtcgctccggatgaggcgttcgacgcgctcgcacataagattttcgctttccagtttgcccataacatgcagtatcgcgcgtattgcatgtctcgtagggtgactccgcagatgttgtcggattggatggatattccgccgatgccggtggatgggttcaagatgctgacgctcacttcggtgcctgaagatgattgcgaggcagtgttcatgaccagcggcactacgcatccgggtcagcgtggacgcaactatcatcctgatcttgaggtgtgggatgcgtcgatgatcggcccgttccgtcatttcatcatgcctgaccgtgagcgcatgcgtatcgcggtgctctcccctgcctgggagatgaatcataatggttcgttggcccgttatctgacgcgtgcggtggagcagtgcggcagcgagggcagcggcttcttcttccatgaggatggtttggacttcgctggtgtggaaaagttccttgatcagtcggtggcagacggcgagccggtgatgctgatgggcgcttcgtccgcgtatctgtatctgcttgactatcttgccgagcggggcaaaacctatgcgttggcgaaggattcgcgtgttttcgataccggtggtttcaagagcacgaaaaccgatatgaccgtcgatgatttgtatgcgaagttccttgaggtgtttggcgtcgcacgcacgcattgcgtgaacatgtacggtatgacggagttgagttcgcagatttacgatcagaatctgctgtcgtactatacggatggttcgtcgaattatctgaaggcgacgccgtcgtgggttcgttccgtgttcctcgatccggcgacgctcacgcctgtcgccgatggcgagcagggggtgatcgcgcattacgatttggcgaattggaattcctgtctggcgattctgaccgaagatcttggcgtgcgcaccgattccggttacgagctcaacggtcgtgcgaagggtgcggaggcacgcggctgctccatcgccgtcgacgaggtgatggcggcaaacgcatgagcgtcatcgacattttccatgcgccgcgcggcttcgtatttgaggatttcgaaacacgcggcgttctcaccgaccgcggtgaggtcacgttgcgttatccggtactcacgcctgagactgtccaagatttgtgcgagacaacgcgttgcaatcgatcgcagacattggcagcatattccgtcgaacacatcgtcgacatcatcggcgaggcggtggaattgtggacgaatcccgattatgagggtcgccagatagcggagtctctgattccctccatcaccggctatgacgcgacgatgacgcgtatcgaactgaaacgttacatgcgcatgttccgcagacgcgaactattgcgttttcttgatgacgaactgccaagcccgcgcatgctggacgaataccgaccgaacaagtccggcggatacacgcgcctgtacgggccggacttgacattccacgtgttttccagcaatgttcccggcattcccgtatggagcatgaccatgagtctgctgacgaaaagcgcgatcatcggcaaatcatcgttcgacgaaccgctgatgcccgtactgttcgctcgttctctgacacagatcaacccggatctcgccgacgtattggccatagtgccgtggcgcggcggcacggtagagcttgaagacgtggcgatcggcgaagcgaacgccgtgatcgcctacggttcgtcgcacaccaccgaggcgatccgtccacgcgtgagcgcgggcaaaccgttcctcagctatggcgcacgcatcggcttctcactcatcggacgtgaagcgctacgcgcggacactcacgtgcaaaccgtgcaccgtatggccgtggacgtggccacctacgaccagcaaagctgcctggcgccgcaaaccatcttcgtggaacgcggcggagccatctcccccgctcagacggcggaactgctcgccagcgagctcgactcgcaacaacgcaaatatccacgatcaaccccttccgacacggaatccctcgccatccgcagggcacgctctcaaaccgagatgcaagcgctgttcatgacgtccatgactccagacggcgccgcacaggccgacccacaggcaccgttcgtcatcgaatcgccgcaaggcaccgactggaccgtgctctactaccccaataccagcagtctcccctcgttggggacaccgctcaaccgcaccattaacatcgtcgccgtggaccaactcaaacacgcgctgcccacactgaaaccctaccgcgagtggctgcaaacctgcgcgatcgccacaagctcatccagactgttcgcactcgcgcaacaagtgggcgaatacggcatcgaccgcatctgccccgtcggagaaatgaaccgcgcgaaatccggatggcaccacgacggcggattcaacatcctcgacctcgtcagagccgtcgacatcgaacgcaacaccgaccgttacgccgacaccttcgacatcgactacgaataatcccaaaggaccttacgtgaaccagcaatccgaacaccggacactcaccggcaaaaccgccatcatcaccggcgcaagccgaggcatcggcgccgcaatcgcactcagactcgcacaactcggcgccaacgtgaccatcgactacctaagcaacgacgaacgcgcccaacacaccaagcaacacatcgaaaacgaagcggacgcacaaggacgcgtcatcacatgcaaagccgacgtgaccgacgaaacccaagtcaacgaactcgcacaaaccacagccaacaccttcggcggcatcgacatcctcatcaacaacgcgctcagccactactcgttcgacccacgcaaccgcaacaccttcagcaacaccagctggaacgactacgcgacccaactcgaaggatgtctcaaaggcacctacaacacctgcacgaccgcgctgccctacatgcgacgccaatcatggggacgcatcgtcaacatctccagcaacctcgtagacagcccgatcgtcccctaccacgactacatcgcagccaaaggagcactcatcggattcacgcgctcgctggcgcaggaggccggagcgtggggcgtcacggtgaacgccatcgcggccggtttgaccgtgggcacggattcgagccgcgccaccaccgaagacgtccgcgagcgcatcatcgcgcagacgcctttgggcaggcttgccacggctgatgatattgcgggcggtgtggcgatgctggttggcgaggacgctcgtttcgtcaccggtcagacgttgcatgtcgatggcggactcacgatgcgctgattacgaacatccggtgacagcctcgttctaggctctatgccatcgggcctggaatgcaacaacctgcatccgaggcccgtttcaatctgcacactgtatccacccataccaagatggatcatctaaaaccaattcgtcagaggattatcggcattacaacgagcaggcgtcgaagaaacgctcgatgacggtgtcgttgagcaagcgtccggttcgggttggaatcacacgtccgtcacggataacgataaggccttcgtcttccatgggctggatgcgagccatatcaaccatgtttccaaggcgactcaaatccagaccctcacgtatgcgcagaccaagcatgatgatttcttcgaggttctcctcgttggagattcgttcgcttcccgaccatggcacattatcatcgttgatagcctgcccccacatgcgaggatgcgcaatatcccagctgcgcaagcccgacgatttgaccgtttcagatgtttcagccgacgtggactgttcaacatccatcacattgccgtaatggctgtgtgcgccgggaccgagccccgcccaatcaacattgcgccaatagccaagattatgttgcgattcataaccaggacgtgcccaattgctgatctcataccattcaagaccggctgcgctcagtagatcgtcagcaatctcatacttggtcgcctcatcgtcatcatcaggcgtaggcaaggttccaacagcaatctgacgtcccattttcgtgttcggtgcgacggtcaacgcatatgccgaaatatggtcaacacccaagtcgatcgccgtacgtacggaaacacgccaatcgtcgagactctcccccggcgcaccgtaaatcaaatccacgctggaacgcatgccggcagcatttgccgctgcgattcccgccgccacattggccggggtatgcgtacgatccaatgttttcagcacgcttggcacagccgactgcatgccgaaagagatgcggttgaatccgccgtccgcgagttccttcacgtaatcggcgttcaccgtgtccggattcgcttcggtggtgatttccgcattgtcggcaatgccccacgtgtcacgcacggcattcaacatggcgaccagatccgaggctttcagaatcgtgggagtgccaccgccgaaaaagacggtggccgcttccggttcgttaacgccatgcgcgatctgccaatcatggacgattgacatctcgcgaatcaccatattggcgtaattgccacgcgaagcgcccgctcccatgtcgacagcggtatacgtgttgaaatcacagtacccacagcgccgtatgcagaacggcacatgaatgtaggcttcgaacatcagccttcggttttctgggcggcgcgaatcttgtctttggtgtcgcggtcgttgcctgcgtctccggtcgacaatgcggcgatgaacgcctcctgcggcacctcgacatggccgagcatcttcatacgcttcttgccggccttctgcttttcgagcagcttgcgcttacgggaaatatcgccgccataacacttggcgagcacgtccttgcgcagtgcgcgaatgttctcacgtgcgataatgcgggagccgatggcggcctgaatcggaatttcgaactgctggcgaggaatgagctcacgcaacttcttcgtcatcatcacgccgtaggaatacgccttatccttatgcacgatggcgctgaacgcatcgaccttctcaccctggatgagaatatcgaccttcaccagatcggcggactgttcgccgtcctcatggtagtcgagcgacgcatagcccttggtgcggctcttcaactggtcgaagaagtcgaacacgatttcggccaacggaatgcgataatgcatttccacacggtcggcggaaatatattccatagtgcccatctgtccacgatggtcctggcacaagtccataaccgcgccgatgaattccttcggagtgatgatgtcggcggcaaccaccggttcgacgatctgcttgatcttgccgtcggggaattcgctcggattggtcacacgatgcacggaattgtcttccgcggtgacctcgtatggcacgttcggtgcggtggagatcaagtcgagatcgaattcgcggctcagtcgttcggtcacgatttccatatgcagcaggccaaggaagccacagcggaaaccgaagcccaacgccacggacgtttccggctcgtagatcaaagccgcgtcgttgagcttgagcttgtcgagcgcctcacgaagttccggatactgcgcgttgtcgattgggaacaggccagcgtagaccatgggctgcgggtcacgatagccttcgagcggatcggccgcaggcttgagcgcggaagtgatggtgtcgcccaccttggactggctgacgtctttcgcgccggtgataacataaccgacctcacccgcaccaagcgccttcgtaggcatcatgtctgggctgatcacgccgatttcaatcggatcatgggtcatgccaatacccatcatgtgcagtttctcacgggaacgcaactcgccatcgaccatacgaatgtaggtgacgatgccgcggtaggagtcgtagacggagtcgaagatcagcgcacgcgcgggagctttcggatcgccggttggtgcaggaacgtcggcaacaatgcggtcgagcagttcggtcacgccttcaccggttttaccggacacgcgcagcacttcggaaggatcgcaaccaatcaggcctgcgatttcctcggcatgcttgtctggttccgcgctgggaagatcgattttgttcagtacaggaataatggccagatcatggtcgatggccatatacaggttcgacagggtctgcgcttcgatgccctgcgtcgcgtcgacaagcagcactgcgccttcgcatgcggcgagagcgcgggaaacctcataagtgaaatcgacgtggcctggagtgtcgatcatgccgagggtatattcagtgccgtcgaacgtccacggcacgcgcacagcctgcgatttgatggtgatgccacgctcctgctcaatatccatacgatccaggaaacgatcacgcatctcacgttcgggcacgatgccgctgagctgcagaatacggtctgccaccgtggacttgccgtgatcgatatgcgcgatgatgcagaaattgcgaatcaacgactgatcggtgaaaccgggctggttatgctgctggcccacgccatcctcctcttgaaatattcgacgcaaacgattctaactgctagtatcggcatggtgagtcgcgacactcctaagcccgttggcaatttatccgcgcgccatgttatcatcatcgtttgtatgtccttatagaaaacgtcgtttggagaaatagtggcaaacattaagtcgcagaagaagcgcgttctcaccaacgagaaggcccacaagcgcaacgtggccgtgaagtccagcctgaagactgccgttcgcgccacccgtgaagctatcgccgccggcgataagtccgcagcagaagccgcctacaaggtcgcagctcagaagctcgacaaggctgctggcgctggcgtgattcacaagaaccaggctgctaaccgcaagtccggtcttgccgtggccatcaacgctctctgagttttagaagctcacagctaacgaaaatcccgcaggtttttcctgcgggattttttgttacgcaaatgtcttccgtttaattaccatctcactgtcgctacctacgcttgtcacacttgcgtttgtcggaatccttatcagaatgaatgaccggtcgtttcaaatatttcgcttcacttggcagatatgtattatgacgcaccaacgctcccggaagctgaatgtcgaaaatcaccgataccaatcgcatgctgaccatcaatgcgacgatcagcagatcaagcaccacttcggctggaaaactgacgattccagcgtccacgcctttgcagacaagcaccgtcagtacgcaccccacggcagatggaaccgcataccaatgtttgtcacgaatcaccatcggcacttcgttgatgagcatgtctcgaatcaggccacctccaagcgcggtgaacatgccgagaaaaaccgcggtcatgcctgacgtgtggtacatcatggctttgctggtaccgttgaccgcatacaatcccaatgccagagcatccaacgacagcatggaccatttgagcctgttgatttcgggatggcacaccgcgacggccaccgaagccagcagagcaacgatcaccagtcctttatccgacacgcctaccggtggcgcgatgcccagcagcacgtcacggatgattcctccgcccaatgcggtgagccatgtggtgacgagaatcgcgaagatatcgtagcctttgcgcacggcggcaagtccgccgcacatgccgcagcagaacgtcgccaaatattcaatcccccaaaagaaggcattactctccaacgccaccgacatgctttcccatccttttcccttccctcacttccctcactctcggatttcgcgacttcccatcgtacacaataagccgaggggcgggaaacatggtgttcgaccgtaggcttggccgaacggccttgagtgtgtcgaataccatgttccccgcccctcggcggactttgaactataagtcagtcgcgaaaaatcagcagaccttccacatccagttgtgcggatcctcgatctcgccaagctggatgcccagcagctggttgcgcaggttcacggtgaattcgccggagttgccgtcggcaacggtcacgtcgaacttctcggacttgaaacgaccgatcggggtgatgatggctgcggtaccgcaagcgaacacctcggtgacttcgccggacttgatgtcttcgagcaactggtccagagcgatcatggtttcgaccacgtcgtggccgttgtcctggatgagctgaatcagggagcgacgggtcacgcccggcagaatgttaccggtcagagacggggtctctacgtggccgtccttgtgcacgaccatcatgttcatgccgccaagctcctcgaggtaggtcttggtagcggcgtcgacgaagcagacctgctcgcagccgtggtcgatgccggtgtattcgcccagcagggatgcggcgtagttgccaccgcacttggcgaagccggtgccgccagggccggtgcggaaccacttgtcttcaacccagatgctgaccggcttcacgccgcctgggaagtacgggccggacggggatgcgatcacgcagtagtccacttcctgcggagcacgcacgccgaggaacggctcggaagcgaacatgaacggacgcatgtacagggtgtactcgcggcgggtcggaacccagttcacgtcacgcttgacgagggcggccacggaaccgatgaaatcgtcgatcggcagttccggcaggtacagacgcttggcagagttctggaaacgctcggcgttcgcatccggacggaacagccaagtggagccatcggcatgacggtaggccttcagaccttcgaagcattcctgagcatagtgcagaacggatgcgcccggatccatcttcagcggcgcatacggctcgatgcggcggtctccccagccttcgcccttggtccaagtcatgtgggccatgttgtcggagaagacctgaccgaatgccggcttgtcgatgagttcggcacgtttggcgtcggatgccgggttgtcgttcgggagcacggtgaacttctcggtgagcttgtcaagctctgccggatcgtgatgattctgttcagtcattctttacttcttcttgttgcagccgcccgaaagcggcccgcggttgttggtatcccagtgcttgtgacaccggttctggttagtaactttcccacatcataatctctttcgattacaagcgttcgcgatatgagataggaagaaacatcctgcgaaaaagtcgccgccctcacgcctgattgatgctccatagactcggaacgtattctgaattgttcaaaaaatgactgtgcctcattccccaaaacaccattatgacgttcaggtctctgacagcgggatgtgggtgagaatgatggggcgagtagtttcgacgtcgtagcacaacatgccgctgtcgcctattggggtgaggagacttcatggcggaaggcgctggaaacgcagccttcccaacgctcgtcgcgttctgcgtgttccgttcgtcgcttccggtcatgctgcgatcctttcgggtgaagcatgcaagccaaccctccgatgtattggcggatactcgaaaaagcagtaccaccgtcattagacggggcaataagattgttggcgtcacgatgcttgtttcagcggcgttctcccggattgcggatctgcatggccgcgccgtcttccatgattgagaagccgtgcttctggtagaaggtggcgttcttgctttcttccggcatgacttcaatataaaggtagtcgcgatatctctctttgaccatgcccaccaggtggcctgcgatgccatgaccctgatattccggatcgaccagcacgtaatgcatataagccaccatctccgtgtcatcgagcacgcgcaccaagcctaccaagcggtcgccgtcccatgcgctgaacacggtggacgatcccatcagagccttgtacagacgttccggatatttgcctgacacccatccgacggatcggaacagttgctgcgtccgttctttggtgaacttcttttcatcggtatacgtgattcccatagccccgagcgtggttgcatgctacgcgcggactgaagccagtctctgcattcggacgtgattttggaatcacgtttacgttggctcaggccagccagtaaccgcacgcaacggccatgacgggcacgacgatcgaagccagcgcatagccgatgaaacaagcgattttcccattgcgcaggagcgtaaccgtctcgttcatcatggttgagaacgttgagaaaccgccgagaaatcctgttgcgagcagtaggcggcagtcggggcttatggtgttcgccgcgaacaatcccgccaccaagccggcaagcagaccggccacaacattgatggcaaacgtcgaaagcgggaacgttttgcgccacaatgccttgatatacgaatcgcagatatagcgtgcggccgcgccgacgccaccgcatgcgcatacgccgatcgcaagcattgcgctcatcgaatcgcctccttgtcagcatgttcgtctttgtttcgttccgccaaccacgaaccgcataaggcaccggcgtaggcgagcgaaaaaccgacaatgaacgttgcgcagcaataggtgaggactctgggaatcgcatgatcgtcaatcatcatgaattcttccaatgcgagcgtggacatggtggaaaggcctccgcacatgcccatgccgaatccacgattcacgtattcttttgcacggcctttcaacaggctggaagatcccagccatgcggaaagcgccgcatatacgaagcaggccaccatattggccgcgaacgtaccgacatggaagccgcccacgtccgcaatggacgagctcgcataccgcagtcccgtgccgacgcatccgccaaggaataccaccgtcaccacatcaagccgaataatatgcttattcaaatgtttctctcttccgcaccgtctcactttgtctctcgtgcattgtttccatgcatcgtcagtcatgctagtcgttattcgattggaatgctgatgcatgtgacgtatttgctggaatcctgcgtcagatcattgtcgatcagtgtgatctcacgtgggaagcctaccaccgtcaaatgatgattctcgatatagtccattaatgtgcggcatcaggatggctgccgggaaaacggatcgtcacgcagtccgtctccggcagtacgcaatcgctcccttcgtacccgacagtgccatacgggttcactgaacgtataggcgagtataatccgtatccacccgttgtatcaatattgcgtaaggaatgcaggatttgccgtcagtctcttatgtcttccagctcatagaacgggtgttgccgggtatgaaaaagcccatgcgcgtctgagcacatgggcttttcatcatctcttacggttgttcaaaaccgtagaatggaagtttgcttccttaagctatctgaactcactcagcgttttcagccggagcggtttcgaccggagcagcctcatcggcagcgtcttccggcacctcgacggtgacgacggactcttccggatcctcgacgtcgagcacaacgccttccggcagcacgacgtccttggcgaagaccttggaaccgtcggttaggccgtcaacgttgaccacgatcttctccggcaggttggcgacatcggcgcgaaccttgagctcctgaatgtcgacgaatgcgacggcagcgcccttcggggtgccctcgacgaacaccggcacctcgacgtcgatcttctcgccggccttgacctcgtagaagtcaacgtgctcgacgatgcgcttcaccgggttgcgctgaacgtccttgacgacggccatcttggtctcgtcaccgaacttgatggtgaacagagcgttggtgtgacgcagggacagggtggtttccttcatcggcagctgcacgaagaccggctcttcgccgcctgcgtacacggtggccggaataaggttggcgacgcgcatgcggcgggcagcgcccttgccgaactcggtacgggcagcgccttcgagggtaatggtggtagccatgggctatttctccttatgttttattcgttcattctgtttcggcgcatcaacgagccgtgaatcaacccacaaggagcctacaatcacacgccgagtcgattacggaagccatacgcttccctcgccaagacaacagttaaccagtatacggcgagggcggacattatcgaaaaacgtctcacatcaaaaatgaaaaaatctgtcaaagcccacgaaaacgccgtacgcacgtacaatcgatagtaattgtgaacaatccgtcaatcgcaaggaaacgagacagcaatgaagcatgacaatgacacaatcgttcgcgacatttgcatcgccacgggagccgtgacggctgcctgtatcgcatcgttggctacgactgcgaaatacctgttccatttctgcatcgatacgcaatggaaacgttccgttttccatcaatcgctgattgcgccggagcgtatcgaaaaacttcagcagggtgaggcacaggaagcaggagaatggttcgcgcaagccaaacagcctgtgacgattaccagcgatgatggacttcgactgcatggatggctgttcgatccggattgcactgcgccaaaaccacacctgtacgcaatctgcatgcatggttataccggtgtaccggaggaaaccgcgaaatgggcacatcgttacgcccgcatgggcttcaccgtattggttccgtcacagcgtgcccaagacttgagcgagggacggtacgtcggcatgggctggcttgaacgcaatgatctactgaattggatcgaccttatcgcgtcgagtgacgccgacgcccgtatcctgctgtatggcggttcgatgggcgcggcaacggtgatgatgacgacgggagacccgcgtctgccgcgcaatgtggtgtccgcgattgtcgatagcggctacacgtctgcgcgcatggtgttcatcgacagccttcggcattcgtcgcgtctgccgaaaccgcttgccgcggtatgtgtggatgccgcgggattgttctgcaaacattatgcagggtacgatttttcggaagccacctgtctgcagtcgctcagacatactgtcattccgatgctgttcattcatggcgaacaggacgacatcgtgagctcacgttttctcaagatcaattacgaagcgtgctcgagcatcgatcgagaaaagctcatggttcccgacgcacgccatatggaagcatccgtcgtggatcccgaactgtattggaacaccgtcaatgccttcatcaaacgcgcattcgaattgtgagccatgaaaactgtgtcaaggttcacatgagattttcctcatgcttatccccaaggtgaacatacacaatgttcatttgttggaaaatccaatgaaatcaacggcttacccacttctgccgcctcccggcacgctcaaggccacggaatacttcaccattatcttgttgtttgttcgtcgcagggcgaacaaacaacagagaggaacgaatattacatggccaatcaacatccttggcatgtcggccgacttccttggacccttcgtcgaaaaggacatcaagaaatcggctttgatctcaacggtctgcttcgcctgcaggttcgccggtaccggagccagtatcgcggcaggatgcccccggcgtgctcatcttctatggcgtaatcatgggcattggattgggcgtcggctatctgacgccggtgaagaacctaatgctgtggctcgccaaaggtctcgccaccggcatcgccgtcgcgggattcggtctggccaaggccatcgcgggaagcatcagcgtcatcctgaccgtcgatgccgtgttcaacgctgccggtgctgcttgagcagcactttggcatgaagtcagtgtccaccgtgcacggactggctttgagcgcgtgggcgttcgccggattgtccggcaaccagttggcatccttcgtcgtctctcatgcgacggatgcggcccaccgatacagcgcgctgattccgatcatcaccgtactgtacgccgtcgctctcgcgtccatcatcgccgtgacgctcgccacgaaaggcaagggcgccaacgccttatcatcacgttgagcggcatgatacatcgttcaacacgctgacacggcggatgagcccatcaacgccttatgcggatgttctgggcattcgcttgttagccgccctgcgccggggaacagactctggttccgctccccggcgaacttcttcccattgatatatacgatgtatatgattctttcctttcccaatccatttccccgtattccaccgcatcgccttccgattcacgtacgctgacggtagccgtgaaaaacaatggcatcccctccgttgcggtcgaatatatggatcagataccacaattgcagcaataccatgacgaacaaggttcccctgcccgcgtgttttccgccacacaggtactgtagtgggtatggaacaatcatctggagctttcccgccgtcccgcatcgaagtgcgcggtgcctgcgtacataatctcaagaacgtcgacgtcgacattccgttgaacaaattagtcggcatcgccggtatctccgggtccggaaagagctctctcgctttaggtgtgctatacgctgaaggatcccgacgttatctggaggctttgtcgacgtataccaggcgacgtctcacccaagcgagtcgagcgcaggtagtcgacatacgtcatgtgcccgcggctctcgccctccatcaaagaccttcagtgcccggcgtgcgatccacgttcggcacgatgacggagctgctcaacagtctgcgtctgttgttctcccgttgcgcctcacatgtctgcgagcattgtggcgaacgcaaccgtcccacaatgaacgtggcggccgagttgcctatacgatgcacatcctgcaatcaactcatgcacccaccatccgccgaacagctgtcgttcaattccgccggcgcatgcccgacctgctccggaacaggcatcgtgcgaaccgtcgaccgtgcttccctggtaccagacgagaccaaaagcatcgacgccggcgcagtattaccatggggatcgttgatgtgggatctgatgaagcaggtgtgcggcgcgatgggagtgcgcacgaacattccattcaaccagctgaccgacgccgagcgggacatcgtgttcaacggcccggccgtcaagaagcatattctatacaaaccgaagaaaggcaatgatttcgccgaacttgacttcacgtacttcaacgccgtgtataccgtggagaacgcgctcgccaaagccaaggatgagaagggtatcaaacgcgtgtcgagattcctcagcgagcaaccatgtccggattgttccggtacgaggctttcacagcaggctcgtcaaccgcagattctcggtattaatctggcacaagccacggcgatgacacttgacgaaacgatacgttgggtgcgttcagtacccaagtcattgccgcaggagatgcgtgcgatggccacagccatctgcgaatcgttcgaggatacggccgagcggctcgtggaactcggattatgctatttgtcgcttgaccgcgcaggtgcgacactgtccaccggcgagcgccaacgtgtgcagttggcccgttcggtgcgtaaccgcactacaggcgtgctgtatgtgctggatgaaccgtctatcggattgcatccggcgaatgtggatggactgttgggcgtgatgcgcgatttggtggctgacggcaattcggtggttgtggtcgatcatgatacccgtgtgcttgccgcgatggatcatttggtggagatgggtccaacggccggtgccgaaggcggtcatgtgatcgctcagggtgcggtggcggatgttatgacggcacctggttctcagatagcgccttttctgcgtgatggtggcaaaatacatgagcgggcgcggccgcagattgacttagatgcgatgttcgccaagggtcggattcatttggagacgaataccgtgcatacggtgcatccgttattggtggacattccgcgaggacgtctcactgtggtgtctggcgtgtcgggttccggtaagacgacgatggtattggagacactggtccctgcgttgcgctcggccgctgatggtaccgtttccccgagctcgattcgtctgattgacgcggatggcatttcgaaagtggaactgatcgatgccacgcccattggagcaaacatccgttcgaccgtggcgacatattgcggtgttcacgatgatctgcgtcgtgcgtttgcgaagacttccgatgcccataagaagaatctcaaacctggcgcattctcatacaacacgggcaaattgcgctgctccacttgcgatggaaccggtaccatttcgttggacgtgcagttcctgcccgatgttgacgtcacgtgtcccgattgccatgggacacggtatgcacagaccgccgatgacattcgattggtttgcgcggacagcgtcgcccgttcactgccggaattgatgttgctaagcgtcgacgagatgatgcctctattggatttcctacgccccgttcgatcgaaactggccacactgcatgagcttggcctggggtatctgacacttggcgagccgactcctgcgttatcaggcggcgaagcgcaacggctgaagctggccagcgaaatgggacgcggacagtccggttcggtattcgtgttcgacgagccgacgatcgggctacacccgttggatgtgctggtattactacgcgtgttcgactcgttggtggcttctggggcgacagttgtagtaatcgaacatgatcttgatgtaatcgcgaacgcggattatctcatcgacatgggtccgggcggaggcatggccggcggtcgcatcgtatgcgagggaacaccggaaacggtccgtgcctgtcctgacagcgtcacgggcagatatctgcgtggatgatccgacgcgaactcgcccgtgacggtttcccatagctgctttcctcggggttgtctgggatacagtcagaaatcccagtcatcgtcgtcggtctcgactgatttgcccattacgtacgagcttcccgaaccggagaagaagtcatggttctcatcggcgttcggacttaacgcggcaaggatcgacgggttcacgtcgcagatctcttgtgggaaaagcgctggatatccgagattcatcaacgccttgttgccgttgtatcgcaggaacttttcgacatcttgcgtcaatccgacaggctcgtagaggctgcgcgtgtactccacctcgttgtcatacaactcgttgagcaggtcgtaggtgtagtcgcgcagttcgccgcgtttgtcctcgctgacccgctcaagccctttttgatatttgtatccgatgtaataaccatgcacggcttcgtcgcggataataagacggatcacgtcggcggtgttggtgagtttggcatgcgcggagaaatacatcggtagatagaagcctgagtagaacaggaacgattccagcagcgtggaggccactttgcgcttgagtggactatccccctcgtaatagtcgagcacgatgcgcgctttcctttgcagatactcgttctcctcactccaagagaacgcctcgtcgatctgtcgggtggaacacaaggtggagaaaatcgaggaatagctcttggcgtgcactgactccatgaacgcgatgttcgtatagacggcttcctcatgcggggtaagcgcatcgggtatgaggctgaccgcgccaacggttccctggatggtgtcaagcaaggtgagaccggtgaacacgcgcatggtcaacgtatgctcggcctcgctcattgtgcgccaaacgggcaaatcattggagacgggcactttctccggcagccaaaaattgccggtcaacctgtcccatacctcaaggtccttgtcatcctcaagtttgttccagttgatggcactcacacggtcaatgagcttaatcctctgtcgaggtacggatatcggcgccatgatggtcgtcctttctaatcgtcgtcttatcgtcgcggccgtataaccgcctgtattcgtccggagccgtcagacgaagcatcgcgcggtaaaccaaacgagacatgtcttttcttttcctttcaagtcacaggtttcacaacatgcaactgacgcagccttgtacttcggtgccagacaacgcctgctgacgaatgcggatgtaatacagcgttttgatgcctttgcgccatgcataaatctgcgccttgttcaaatctcgggtagtcgccgtatcggggaagaacaaggtcaacgacaggccttgatcgacatgccgcgttgcctcggcatacgtatcaacaatggccttccatccgatttcgtacgcatccgcgaaatactggagattgtcgttggtcatatacggagctggatagtagatccgtccaatcttgccttccttgcgaatctcaatcttcgaggcgataggatggatggagctcgtggaatgattgatgtacgaaattgacccggtgggcggcacggcctgtagatattggttgaagataccgtcacgtatgatgtcgtcacgcagacgacgccaatcatcctcgttggggatatggatgccctgccgtgcgaacagcgacgcgattttcccggtcttcggcgccagcgagcgctcgccgttcgtatatttgtcgaaatagttgcctgcgcctgcaggcttcgcataggcggaccgttcgaagcctgcaaaccgtgttccgcgttcgactgcgagctcatgcgaggcacggtaggcatggtatgcaacggtcatgaagtacatgtcggtgaagtcgagggcttccggcgaaccgtacatgatcgattctctggcaaggaatccatggaggttcatctgtcccaggccgatggcatgaccttcgtcgttggcgcgtcggatggatggcacacacgcgatgtccgtatgttccgacaccgaggtcaatgcgcgaatcgcgcgttccacggttcgtcccaaatcaccgtccatcgctttggcgatgttgagcgatccaagattgcaggacacgtcacgtcccacgtgattgtaggacagatcctcatgataggtgcttggctcctgcacttggaggatctccgagcacaggttgctcatggcgattcgtccgtcgatcgggttggctcggttcacagtatcttcgaacaccatgtacgggtatccggattcgaattgcaattcggccaaagtcatgaagaactctcgtgcgtcgatgtaggttttcccgatgcgttcatcgtccaccatattccggtagttttcgctgatggaaacatcggcgaagggtctacccatgacgcgttcgacgtcatatgggctgaacagggccataggttcgtgtctcttcgccagctcgaatgtgatgtcgggtatcactactccaagagccaaagatttgatacggatcttctcatccgcgttctcgcgtttggtatcgaggaaatgcatgatgtccggatgatgagcgttgaggtacaccgcaccggcaccctgtctagcgcccaactggttggcgtagctgaaagagtcctcaagcagtttcatcacaggcacaacgccgctggactggtgtttgatgcgcttgatgggcgcgccggcctcgcgcagattgctaagcaacagcgcgacgcctccacctcgtttgctcagctgcaatgcggcgttgatgccacgcgatatggactccatgttgtcttcgatacgtacgagaaaacagctgaccgcctctccgcgctgcgctttgccgaggttgaggaaagtgggcgtcgccggttggaaacgtcctgatataagttcttcgaaatacgattcggcggccgcatggtcgccggcggcaagcgcgagcgcaacggcggccgcgcgttgcgggaagttctccaggtactgtttgccgtcaaaggttttcaatgcgtatgagcggtgaaacttgaaagctccaaggaatgtatcgaattcgaatccgcagtcatccacgttgcggtagaacctgtcaaggaattcggcatcatattgggcaaatacggattcgtcgtaatagccgtctgcgatgagccggctgagtctgtcttgtgtggagttgaaacggacggtgttcggcagcacgtgcttttcgacgtactcgcgtacggcttggatgtctttatcaaattggatgcgcccctgcttgtcgtagagattcagcatcgcgttgagcgagtgccagtcatgggcgcgatcgtaggaggctatgacgtcggttactgcgtgtggtgtcgttgaatcttctggcatggttatcgttgttcctgttgtgtgtattcgtcgaaaaatctgcgcagtccttcgcgcacggtcgcggtgtcttctgaagtgcccatcagttcgaaccggtagagtagcggcacgcggcatttagccgcgatgatgtcgcctgcgatgccgtaggcttcgccgaagttggtgttacccgatgcgatgacgccgatgatgccactgcggttgcgttcatcattgaggaatcgtttgacttgcacgggcactgctttgccgattgttcctccgccgtatgtgggtgtcagcaagacgtagggctcatccacatgcagctccggctcgtccggccgcagcgggatgcgcattgtatgaatgccgaattcatccaatcggcatccttcgacgaagcgtgtcgtattgcccgatgccgacgagaagtacaccaacgcactcaccggcagcgagcctccagctcgtggattttgtcgggacgatacccggaccaggattcgtcgtctgcgatgatgactggcatctgccgccatccttcgttccgcaatctgtcggaaatacgtgcgttggccgtaatgtcgacagtcgtatagggaaggcctcgtttgtccaattggcgtttcgtcgccgtgcattgcgggcagtttgctttggtgtataacgtaatgttcatgttccacgtcctttcacgaccgtacgtcgttggtatgtggcacacattatccgaacgaaaataaaaatcaagaccacaacatacagtgtctcgtcacattttcaaacactatatacggcgtgtttccagtattggcaacagttttgaagttctagagcaggacgtgggccggatttgtgggatttttcacatcggatgcaatcgttcttcaccgaaagccccatgccataaaaaggcatataggaaccagggtcttattcccttcgggaacccagccgtcactcactcaagttgaccttggacacccaatcatgcaccaaccgcagaaaagacagacatcccgcaccccggcaacgcagattcaggtttcttcgcagaaatctgcagagattctttcggtacctcttcgaccgagctgggaagtgtccgacataccacaccgaccaacggtatgtataatgtcggtgtattcgactccatcatcgaaggagaggcatatggcgcgcaatgcgcaccctgaagtgacgcgacagcgaatccttgacgccgcgaaaaagctgttcgcgcaaaaggggtatgagcgcaccacgattcaagatattctcgacgagctcgaagacctcagcaaaggcgctatctaccatcatttcaaaaacaaagaagcgatgctgcatgcgctggtagattccgacaacgaacgacttcttccccaggcaaatcaagaggatggctcacgaaacggattgcagaaactacgcaattcgctcatgatgcagattaccgacaccgaacatatgaccctcatgcgcgatgcgtttcccctgctgaacgacccgaaaatcctcgccgaaaatcttcgcatctggcgaaccgacagcaccaaaatcgcgtacgacttcatccaggaggggttaagggacggttcaatcacaaccgaataccctcaagaagccgcggaacttttttcactgctgttcaattactggctagccccaaacttctaccccatcactaccctaagtgaattcaagcatcgcatccactgtcttggattgattatggactcgctcggagttccacttatcgatcacgacagtgatatggaagatcggcttgcggaaggcttcttcctactcgccagtaatccgcaataaaagctcggcaatgtcaatctatctttatttgtacctttttttacataccgtcagtcggtatcgaaaggaatagtcatgaaaaactcgtcagcaaagacactccaatccagcttgcgctccgcaaacttcatcctgcttgtactcggtcaaggcatttccttgttcggcaataccatgctccgatttgccatgtccatgtgggtactggacgaaaccgcatcatccacgaccttcgccaccgtgctggccatatccgtcattccgaccatacttattagcccattcggaggtgttatggccgaccgagtaagcaaacgtgccatgatggtggcgctcgatatcatctcaggaatcgtcacactgctcgcgactgtgtttttcgcactatccggattcaacattctcgccatcgccatcatgcaggtagtgttggcagtactcgatgccatggaaactcccgtcgtgcaatccgcactgccacaaatcatcggaagagagtcctccactgatcttcgccgaggcgcggccatcatcaaccaagtgcagcagctcagccaattactcccgagtttcctaggtggcgtgatgtacgggctggtcggcattcgaccgatgatgctcatcaccgcagcatgtcttatgtcggcagccatggttgaatgcttcatcagactcgcaaagcccctatcgaatcaagatgatgccggcatctgcctgctcgacgtcatcattggcgatatgcattcggcgaccgctttcctgcttcgcaaggagccgaccgtagcacgattagccggtgtttgcacatggatcaatctgatactgactggattcagttcagtaagctttccttacattattcgaactacgttaggctacgatgcggcgacatatggtctatgcgatggcattatcggcattgccggcatagcgggaacattcatcgctggctgtttcgccaaccgtttgaaatcacgaaacgccccttcgttgttgttcgtggaaagtcttatgctgctcccaccggccatcgccttcctgcttccatgttcaacgcaaaccaagctcatcatgctggtgctctgcactgcggcagtcataatcgccgttgatttcttgaacctcattctcgtaccatctattcagatgaggacaccaaccgcgcttacaggcaaggtcatggccattatttcatcattgacgatatgcgcccagccactcgggcaaatgctttacggatggctgcacgcacattgcacggtttggcttatactgctgatttcagcactggcatcactacccttggcatggttggctcgcccactgtttgcgcaccttgacgatacgatttccaagtaaggcagggtaatgaagccgatatacgaacgtccgtatgctgagaatgccgcccaacatattgcgattcggcttgaaatcagccttccttaaacgaatgcctttctgcttgcaacgaatcaccaccagcgcgacgatcacactgatggtctgtgcaaagattgtgccaaggaccgcatctgccggaccaagctgaaaatgccccatgaacaggtagacgagtgcgatattgaaacactgattcccaagctggcaggaaccacttggctgaatcactatcttgagagcctgccgaatctggaagcccagaaacagatgtgcagacaagttatcagcatgcgatgttcaacggctgacatcagttatacaggaatgttcgatcggggttctttggcacggcatgtccaaaattgttacgcctatgcggattggacgtccacgctggtggaagtgaattacgtaaacgagaacttctgtctgtcattcacacagaagttcgccacagatagatacgtaaaagcatttcgcgaattgttggagcaatacggcatagcatgcaccgagatcgaagagacaaagttcatctgaacgttccgccattcaatctcggcacaaccatgatgcatacgctttgacgttcgcgatctgagaggccgatcagtcgccgattgaaaccggcctcccctcgtttcctcccgtctcatccgcgcttcccatgtatggacccatcagatcgatatatcccttcgcgtcatgagcgagaagcgcacgcgttgcacgcagggattcgatatcccttggaaaacggtagagcgcaaccattgccgacaaatccctaagcccgttacaggcgtccattaatcgtttcttctcctttcgcggtgcgaaaagcgcatcatccctactttccggttccgggaagcagatataccctcccaatgtcatcgccaaccccatccctttaacggattcagtcgttcgtctcagactttccactccctgctggaacatcttgtcatcacgagtccggaacccttcagtaaggggccgcgagccgactgcccccaacagcgacagggcaagatcatgcaggtacagcggatcctcccaaatgttcgtcacctgatacgcgcccttctggtaaacgcgttccatgatttgcgaagctgattcagtctgcttgttccacaaagcacgatacgcttccacgattttccccgcatcgtacagatatcgcgcatccatacacgcgggatattcaagcaacatggattcggcaaggtcggcattgcaagcatagtccagatcggcttgaattctaagatcgcgcagatggtcgcacagatttcgataggagaagtcttcatcgcatccggaatccactactttcggatcgtccctcagcatgcacatgccgataccgccatatccaagcaccatcaacgcaacatcggccgcacgcggctcttcctcaccccaacgtagcagactgtacgcggccagccaatatacttcctgcaaatattcagccatgcaggccagtctcttctttttgctggtagcgtattttccaccctttttcttgcttctccgaaacacatccttggtgtaggtcaatccaatctggaatggcattctgctgctgggcctttgcaaagccaccgctatcgaagcgtcattgatcatttcatagagccaaacgctcataccgtacttacgcacgatgttacgtcatccatcaagaaaattcgcatcatgctcaaccagatcataatcgaacgaaatcatggcccacgccagattcgccacccatgatgtgctgcagaataattccttccccagttcacagactttttcgtcaaaaagcgaaagagatccgatctcaccgtattcatcgtggatttttcccaattccgcaagatatttgccagaactgtatccatcaaaccgcttgataagttcttcgatcgttgccaaaaatccctgttcatccatatggaacgggccagtgattatttccgccatgtgcaactcctttgttgtagggtgcacctactgtctcatattcaaatcatcttgcgccaccgaaccttgaaaatctgtggatatgtggaaaactccacccatatccataggcgaataacgactgtggataactcacaattcgcatgcaacagacctgatcttacgaaaatcaccatatgcaaaaaggtcccttccctcaccggaagagacctttcaggaaaagcatcaacgcaacgtttcagctgttagttgatgagctccttgactgccgcgataacggcctgcaggcttgccttggcgtcgccgaaaagcatctgcgtgttgtcttcgaagtacagttcgttctggataccggcataaccggtaccgcgaccgcgcttcatgaccaccacgttctgggccttgtcgacgtcgaggatcggcatgccggagaccggggtgcccggcttgcgtgcggccgggttggtcacatcgttggcgccgaccacaagagccacgttggcctgcgggaactgcggattgatgtcatccagatcgacgagctcctcgtacggcacgttggcttcggcgagcagcacgttcatgtgaccaggcatacggcctgccaccggatggatggcgtaggagacttcgacgccgtggttcttgaggagcacaccaagatcagcaagctcgcgctgggcctgagcctgggccagaccgaagcccggcacgaagatgaccttttcggcgtatacgagctgtacggccagatcgtccgcggaagtttccttcatgctgccttccggaccctcaccagcgccagcggcggcattggcaccaccgaaaccgcctgcgagcacggacagcagcggacggttcatggccttggacatggcgatggacagggtcacaccggcggcaccaaccagtgcgccggccacgatcagagcgatgttattgatagccaagccggacatggccactgcagtaccggtgcaggcgttgagcacggaaatgaccaccggcatatcggcgccgccgatcgggatgacgaacacgagaccgtagcacagcgcgaacacggtggtgagcacggaccacagcagacgctggcccggctgcacgcacagcatgacgaaggatacgacggtcagtacggcgaacagaatgttccagaagcccttgcccggcaagttcagcttcttcacccacttgatgccctgcagcttgccggctgcgatcagagagccggagaacgtgacggaaccgatcatgatgcccaaaccagcggtgatcaacaccacgatggaaggcgtgccctcggaggtcagaatgtcgttcaaagccacaagcgcggcggcgccgccacccacggtgttgaatacggaaacgagctgcggcatgtcggtcatcttgaccttcttggcggaaaccacaccggcgacggcaccgatgatgatgccggctatcagcagcacaacggcaacgccatgctggaatccgttggagatctcacctgcgaacagcacaatgaacgccatgaccacggcaaggatcatgccgacagcggagaccatattgcccttgcgagcggtcttcggagagttcatcaagtgcaggccgataacgaacatcacggcggccagcagatagacgaaccattcgatgacgccgagcggcgtgctcagcatttcagccatggtacccatttacttggcctcctcttccttcttcttgcccttgtcggacttgaacatctccagcatgcggtcggtgacgacatagccgccgaccacgttcatcgtgcccagcactgcagccaggaagatgaacacccaggcgagcgggctggtggcatgcgcggcgacgataacaacgccggcgatgacgatgccgtggatcgagttcgcgcccgacatcaacggagtatgcaaggtggccggcaccttgccgataacctcaacgccgatcagcagcgcgaggacgaacagagtaatcgcaacaacgatatccattgcttactccccttccttcttggcttcctcgccgcggccggccacgaccatggcgttgtcaagctcttcgttcagatcgatggccagcttgccgtcacgcacgaaatgcgcaagcacatcggccacattgcggctcagcaggttggatgcggtagtggaaacgccgcttgacaggtacggagcgccgatgatggtcacgccattttcagtgacttgggtgccgacggtggaaccttcgacgttgccgccgaggtcgcttgccgcgcagtcgacgatcacagcgccacggtgcagtccggccacgccagccttggtcagcagaaccggaggcttgcggccgggaaccttggcggtggtgatgacgatatcgaagccggcagccttctgatcgacggcagcctgctgctgggcctgctcttcggcactcagcgcacgggcatagccgccctcgccctgacccttggagaagtcaagacccagatccaggaacttcgcgcccaaggattcaacttcgcccttggaagccggacgcacatcgtacgcggtgacaaccgcgccaagacgcttggcggtgccgatggcctgcagacccgcgatgcctgcgccaagaataagcaccttggccgggcggatcgtgccagcggcggtggtcatcatcggcaggaacgaaccgtacgcgttggccgccacgatggccgccttataacccattacggaattctgagaagtcatctcgtccatagactgcgcggagctcaactgacgcggcagcttctccatggcaacaccgaccagaccggccttttcaatcgcagtgacataatcggcgtcggtgaacgaaccgagcataccgataatccaggtaccctgcttaacgcgtccgagcagcgcgctgctcggacgatcgacgaaaccaagcacgtcggcacgcgcaatcacttcatcggcggagacgacctgcgctccggccttactataatcctcatcaacataatgcgatgcgacgcccgcaccggattcgatcaggcagttaacacccgatttacgcaacctcgttacgatatccggtgtcagagcaacacgagactcgtgttcggaggtctcattgagaactccgaagaccacggtggcttcagctgtttcagccataggtgccctttcttcctcgttaaagaaatcaaaatgaacagatacagcgcaccagtgtaacgtaggtcacacctttgtatgaagaaaagttcacctattgaatggcatcgcatggcaattcctttacgcaggccccgctggatgcgcactttccctacgctaccgtaaggtgacgtgtcgcattcatgggtctatcattcctacagatattggatttaaatgtgtaggagagtcacgtgtccgtcatcacctctttgaacaagcgagctgcaaatcttgcgcagaaggcactgcgtttgggaggtgacttcgttcaccccgtcagcgacgattccggcaacactccggattacaacgatccgaacaacatcatctcccccgacggccatatcgaccttccgcacaccgtcgaatggggcgaaggattcccatccaccacgttcctcgatccggaaaccggtctgttgaccaccaaaaccgagggcaagccgccgctggacgagggcaccaccatctacgatatttacgccgatcgagccgagcgtatgggtgacgagccgctctacacctataagacgaacggcgaatgggtgaccaaaaccggcaacgaggtgctcgccgatattcgtcagatcgccaagggtctgatgcattacggtcttaagaagggcgacggcgtggcgttcatgtgccgtacctcgtacgagtgggatgtgttcgacgcggccgtcatggcatgtggtggtgtgctcgccacgatctacgacacggattccgcggagcagatccgtaatatcgtcaataattccgattcccgcttgctggtggtcgagaccaccgatatgcgcgccaaagccgatggtgccgataaggaatgcccggcactggaacacattatctgcttcgagaacggcggtctcgacgaaatcatggcctacggctccggcgtgagcgacgaagagcttgacgggcgcatcgcttccatcaagaaaaccgacctgtgctccattgtgtatacttctggttccaccgccgcgccgaagggtgtggagatgacccatgagcattattgcaccaccgcgttgaatcttccggcgtatatgccgaaactgctgcatgagaggaagaacagcgtgctgctgttccttccacaggcgcactctttcgcacgtgccatcaactacatttgcgtggccagcgaactgcatatttacatcgcgcagggcatcaagacgctgatcgccgatcttcaggtcgccaagccgtccgtcatgatcgttgttccgcgtgttcttgagaaggtgtataacgcggcctcgcagaaggctggtcatggcgctaagggcgtggcgttcgccgcagccgttgtggcagcccagaattacatgaaggaggtcagtgcgaagggtaaggccggagctttggccaaggctcgccgtatggcgttcgacccggtggtctacgcttcgctacgcgaggtgctcggcggacgtgcccagtggatcgtggcgggcggcgctcctcttgacccggaacttatggcgttcttccgtggcgccggagtgcccgtgtatgagggttatggcttgaccgagaccacggctccttgcgcgttcaatccgcttggtgtgccctatcatcagggttccgtcggcgtggctttccctggcttcgagctgcgtatcgccgaagatgaggagattcaggtcaagggtaccgccgtgttcccgaagtaccacaagaacgaggaagcctccgaggattcattcactgaagacggctggtatcgtaccggcgatttgggacgtatcgacgatgacggcttcctgtatatcatcggacgtaagaaggatctcatcatcaccgcaggcggcaaaaatgtctcgcccggtccgatcgaagaggttatcaagcgttgcgaattcgtttcccaggccttggtgcttggcgacaagcgtccattcatttccgcacttgttacgcttgacgaggaatccttgcgtccgtggttggaaagcaaggggctgaatcgcgacatacccatggaggaggccgccaacaatgccgccgtccgtgcggaagtgcagaagtgggtcgatcaggccaacgaaggtgtttcccgtgcggagtccgtacgtaagttcatcattctgccggaggaattcactcaggagaatggtttgatgaccgcttccatgaaggtgattcgtccgaaggtcatcaagcgttatgccactttgctgaatacgcagatgtacaccaagaagaagtagtcttcgaaacagcagaatgaggtctgactcctacgggaatcagacctcatttattattttccacgcaatcgttgcgaagcggatcctaagcagatcagaagcctagcttctcgagctgtttggctgaaccgtcaaaaggacagtccagtggactgtccttaggtgaagtgagcagcttcgctgcgaagcggatcctaaacagatcagaagcctagcttctcgagctgtttaggatccgactgccatcccttggcaaccttgacatgcaaatcgagtttggctttctgtccaacaatacggttgaccggcgtacgcaacttcttcttgacacgcacaagatgttccgctcccttgccgatgatgatcggtttctgggaatcgcgttccacataaatcgacacaatcacgtgggctttgccatcgtaagcttcgccactatcgttgtcttccggatattcgatggaatccacgactacggccagtgaatgcggcaactcgtcatccaattcttccaggaaagcgccacggaccagttccgcaatggtttcttccggacgctcttcggtgatctgctcggccgggtacatttgcgggccttccggcatgttctcgataagcacgttcttgacttccgcaagattgtcatgcttcagcgcgctgactggcacaatatcggtgaagtcggcgaattcgttgatttcaatgagcttgttgatcagcccgtcacggcttaattcgtcaatcttggtaacgatggcaaccagcggcaccttccatttgaatgtgccatcatctcgcttgactgcgaaatcagaacgcagacggctcaaaatgcgcttgtcgccgggaccaatctcctgattaccaggcagcaggaaagcaacggcgtccacgtcggcgagcgactcgtccacaacatcgttcagacgctgcccaagtagtgtgcgcggtcgatggatgccaggcgtatcaaccaaaacgatctgcgcattatccgtggttaaaatgccacgaatggctttacgagtggtttccgggcgagatgatgcgatggcgatctgcgtaccgatcaacgcgttgatcaacgtcgacttgcccacgttaggacgcccgaccacggcaacgaaaccggaccgatatggaacgggcgtggcggaatcggaatggtcggaagtcgtctcggttgttgctgcgtcagtcatgcttgtctttggaatccttatcgttgtcggatgccttttcggcatcatccgcatgttcttcgttacgtgtttcagtttcgtccacgccctcgacgtgggccggctccaccacaatggtcgacacttttttgcggcgtcctgcggagtcgaccgcggtcatgcgcaagcctcgagtgactgcggaggatccgacgatcggcacacgtcccaacagcttggtcagcaagccgtaaacggtgtcgacatcatcctcgtcaatgtcgatttcgaaaatctcttccaagtcggcgataggcgtgcgtgcgggcatgctccatttcttgtcaccgatccgttccggatcggcatgttgcgtgcgatcatgttcgtcttccagttcgcccacaatctgctcgatggcatcttcgatggtgaccatgcccgcgattccgccatattcatccaccacaatggcgacatgctggcgtgtgcgctgcatttggtggaaaagatcgtcgaccggcttggattccggcacgagcatggggtcacgaactatcgattcgacttcgcgtgtcatcgccgcatggttgaaggccgtcgcgcgcacggcatctttcaaataagccacgccgaccagatcgtccacatcgtcgccgatgaccggcacacgtgagaatccggaacgggagcaaagcttaagcatattctccaacgtttcgtctcgctcgatgcaaatcatgtcggtgcgcggcaccatgatctcacgagtcagcgtttcggaaagcgtgagcacattgcgcagcatttcggaaacttcaggatcgaaatcgttgacttcgaccagacggtcaatggttgcccgtccttgttcgatctggattttttcgagctcctcgtcgtcggaaagatcactgccgcgacgcttcgcgcctttttgccccccgatttttgcgaatggggttaatagaaccgcaatggaaacagcatccacatgctgcagcataatgtcgactggcttggatgccccggcactacgcggacgcaccaacagcgaaatcaccgcaatgacgatggcaaaaacaaatccggcaagcaattcggcccatagtggagcgtccaacatgcccgcaatcaccgtcacgagcacaccatcaaccacattgcagcagatgcggaagaacgcgcacgatccggcggtggcatagcgatcggccaccaaccgctgaaccttatgaatgcgcctgattttcttgtcgcgtatgaattgcgaaagctcggcatccgtttgaatttcgagaataaggttattcaggctcgccctggtcacacgtcccacagcgccttcagtcgcggccattgaaagcgacagccagaccaacagcagcgccaccacggcgagcaccacgatcatcgcaatcattgttgcctgcataattcagcccccatcatgccggacgatatgctaccggcaacgtcaatcattatttggcgatctgccgtcccgtgccatgctgcctatcccattcggcgagcgcgtccggcgtatccggcggaaggatggcctgcgtccccgctccctggcgaagcgcgaagaaggtgagtagcagctgtcgctgcagaccgaacatctgacgctcctgttctggggtggcatggtcgtatccgagtaggtggaggatgccatgaatcgtcagcagcatcatttcctccatggtgttatgtccggccgcgagcgcctgctgcgcagccacccacgggcaaatcacgatatctccaagcacgccttccatcacagttcggccgtctcctgggcgcagctcgtccatggggaagctcatcacgtcggtggggccttcaagattcatccaacgcatgtgcagttgggcgatgggatcggggtctacgaacatgatggtcaggtcggattgcgtgctgacccgcatttggtccatcacccatatgccaagatcggagaacaccttgccgtcaatttgccagacggtttcgttggttacctcgacgctcattcggcgttcctttcgatttgctcgcttgtttgcctggatgtggttttgcccgtggcgtgtctgctgtggtcgccggcaatggccgcgtgtcggtcgtacgctgcgacgattttgccgacaagcgcgtgtcgcactacgtcttccggtttgaggtgggcgaatgcgatgtcgtcaatgccgtcaaggatgcgttcgatggtggcgagcccggatttcggtactgtcagatcgacctgcgtcacgtcgccggtgataatcattttcgtattgaagcctagtcgggtcaggaacatcttcatttgttgttcggtggtgttctgcgcttcatcgaggatcacgaatgcatcgttgagcgtgcgtccacgcatgtatgcgagcggtgcgacttcgatggtgccgtcgtccatgtagcgcttgagctggtccgccccgagcatgtcagaaagcgcatcatatagcggacgcagatatggatcgactttttcgttcaatgtgccgggaagaaaaccaaggctttctcccgcctcgacggctggtctggtcaggataatgcggcgcacctgcctatcttggaatgcgcgtaccgctttcgccactgcaaggtatgttttgccggtgcctgccggcccgatggcaaatgtgatggtatgtgattcgatggcattgacatatgtgatctgaccagccgttttggcacgcaccggcttgccgagcgcaaaggtgatcactccgggcacatgcggtttgcgtcggtccgcatgattctcgcgattggaggtatgctcctgttgccgatcggccagccgtagttcctccactacacgtccatggcccgggcgagtagcacgcacaggatttttcaacacgttttgatcgagcatgcgtcgcaccgtatcggcgtccatcggagccgtatatgcggcttggatgatgttttcgatcacatgctcggcctgtgcggcttgggattcggatttgctggaacgtgacatgatcgcgatgcggttgcctctgacgataatggtcaagtcggggaacgcacgttccacttcccgaaggacctcgtcgaccggtccgagcacggtcaccgggtcaagctgctgcggaatcgcgatggtacgtgtagtagtggccacaaaacctcttctgacgtcgatatatggggaaagggaagattattcgtcaagcttttcgccggtcagcacgtgagcatgcacgtggaataccgtctggccagcatcaattccggtgttgaagatcaggcggaaggcaccgtggaattcctggtcggcgatattttgcgcgacctgagccatgtgggcgagctgctggggatcggccgccgcaagctcggccacgttcgcataatgcttgcgaggcaccacgagcacatgtactttggctttcggattgatgtccttgaatgcgtaggtggtatcgtcctcatacactttttcgcttggaatttctcctgcgatgatcttgcagaacaggcaatccttgtcgctcataatgctccttaatgctggttgtccttcggtacccatgctattgcgcaaccgggataatccgccgcatttcgccggcgtgtggcgtcagatgaatcgtcccaacgcccgtgcgagcagcgataacgcgacgggaccagctgtcgatgctcgcagaatattgcttccaagcacgcatgcttcagctcccgcattggtgaaggattcgatttcagcatcgctgatgccgccttccgggccgaccaccacgtacacggtgcgctggcgcccgtcctgcaagcatttgtcggaaagcaccgcgatcgcttcctccagctggctccaagttttggtagcatcctggtgcagcacaatcaccatgtcgccgtgcacacaggcacgcttgcaaatggcaatcaactgcttgctggtcacgcactcccccaattccggcgtccaggagcgtcgggattgttcagtggcggcatcaagcacttgccgccacttcttatcggtgcgccccgccttccatttggcgatggaacgatcagcctgccatggaatcacctcatccacaccgatctgcgttgcggtgtcgatggcctgctcatcgtgtcctgttttcgccagcgcttggatcaaagcgagtttggtggtaggctgcggttctttgccgaagctcgacacttccgcgattccttgttgcgcatcgcgcaacaccgcgtggatacgtagccctttaccgtcggaaagctgcaattcgtcaccgtctttcagacgcatggcctgaatggcatgtcgacgcaccgactggggcaacgtcaatttccatccggcgttcaattcgtcactgttcaccggcacatcatcatgttccgtatcaagcaggaaaagggcatcagtcatagtttcagagcctaccagcacctcggataccaatggcgtaattccgcgcgacacgccgagacttgcatcacaccgagcatctgctatagttttcgtttgttgccgctgagcaacacacctgtccgggtggcggaatggtagacgcgctagcttgaggtgctagtgcctatttatacaggcgtgcgggttcaagtcccgctccggacaccagcaaaccccttggaaacaaggggttttcttgtatctgaaagctattcggcgaaagatcgatcacatgcagttcatccatcttgattccattgacgacgagcgcgtgtcggcatacacgaatctcacggaaatccagcttcgcaacaagcttgaacccagcaagggcctgttcatcgcggaatcgccgaaagtcatcgatcgcgcgctgaccgccgaccgggaaccgatttccctgcttgtcgaagaaccgtggatcggaggcatgtcggaaaccttcgcacgcatcgaccaacgttggggcaccgacattcccgtgtacgtggcatcccctgaacagctcaagcagctgaccggctaccgcttgcatcgtggcgccctggccgcgatgaaacgctggccactgcccagcgtcgaggaggtgtgtcgcggcgcacgacgcatcgcggtcatggaaaacatcgttgaccacaccaatgtcggagccctcatgcgatcagccgccgcgttgaacgtcgatgcagtgttggtgacgccctcctgcggcgatccgttgtatcgacgcgccgcccgcgtgtcgatgggcacggtgtttcagattccgtggactcgtattggcggagatgataaacactactggccattcaccggcatgcaggaattgcgcgatcttgggttcaccaccgttgcgatggcccttgaagacgattccatttcgctggaggagcttgttcgtcgtttgaacaacgacaacggcgaaaaggaccatatcgacaaattggcgctgattttcggcaccgaaggcgacggtctgtcgcatcacaccatctcccgcgccgacctgacggtcaagattcccatgagccacggagtggacagtcttaacgtcgccgcatcgagcgccgtggccttctattcaacagctgttcactgaaacagtcagcaaattttcaagactcgcgatgcaaactccttgcatgttgcagaaaatatgcaattattgagtgcgtaagtggtttgcgatgatgcagaccgaccaatgtgtgcggtgtcgtaacgacgctctaggagaggagttctcatggcaaagaatccgaaaattctttccatcgtgcttgcaggaggcgaaggcactcgtctgatgcctttgaccagagaccgggcaaagcccgccgtcccgttcggcggcgtgttccgtctgattgatttcccgctgagcaatttggtcaattcaggctatatgcagaccgtggtgctcacccagtacaagtcccattcgcttgaccgtcatatttccacggtgtggcgtttttcgccgttgctcggcaactacgtctcccctgttccggctcagcagcgacttggcaagcactggtatctcggctctgccgacgccatctaccagaccatcaacatcatcgaggacgtgcagccggatattgtggtgatcgtcggcgccgaccacgtctaccgcatggatttccagcagatggtgcagcagcatatcgaatccggcgcggagttcacggtggcgggtattcgccagccgatcagccagtccaaccagttcggcgtgatcgaggttgatccggagcacccgaatatgatcaagagcttccaggagaagccgcagaccacgaccggcctgccagatgatccgaactccattcttgcttccatgggcaactacgtggccaacaccgacgccctgttcgaagctttggcgcttgacgagaaggccgaagacaccaagcatgatatgggcggcgatatcgcaccgtacttcgcggcccgtaacgaggctggcgtgtacgacttcaactccaacgagattccgggagcgacgccgaccgatcatgcctactggcgcgacgtgggtactctgaagcagttctacgatgcgcatatggatctgatctcgtatgtgccggaattcaacctgtacaacaccgaatggccgatttacacgctgtccggcaatctgccgccagcgaagttcgtccatgccggtcgcgaccgtctcggacacgccaccgactcgatcgtctcccctggcgtcatcgtatcgggcggtgaagtgcatcattccgtgctttcgccgaacgtgcgtatccactcgtggtcccaggtcgtcgattcgattctgttcgacggcgtgaccatcaatcgtcgagcacgcgtctacaaggcgatcctcgacaagaatgttgtgcttaccgagaattcgaccgtcggtatcgataccgaacatgatctggcccgtggcttcaccgtcacgccggaaggcatcaccgtggtgccgaagggtaccgtggtcgacgactgacgttctgccgcacacagaacaaaagcgtgcttcccggcgtcgggagcacgctttttctgtgccattttttcttgatgatgatatccaatcaaatatcatcaaaatctgttttacaaaaaattccgcaacgaacatgcagtttcgctgcggaatcaacatatcagcaatatcaggttgatatatcacagattttctgtcagtattttggcagattgtcgaaattgaagccgagcgcagccaactgctcgcgaccttccggcgtgatcttttccatgctccaacgcggttgccacgtccagtcgatgcggaattcctcgacgaggccggcaagcgtgctcgcgcactcgtcttcgatcagatcagtcaacgggcatgccggagtggtcaatgtcatcgtgataatggcacgaccaagctcatcgatctcaatgccatacaccaatcccaaatcaatcacatcaatgccaagctcaggatcaatgacctgatgcaacgcttccttcacgtcggccgcagtagctcgaccaatgtcgtcaatagccttcaacgcgatgccgtcatcctgttcttcggaacaaccgcatgctccagcctgattgccgcagccacaagcgtcctgcttggtgtcttcgtgttcgatttccactggtttgccgtccttgaatcctttggcgagatttgggttaagcatgacgcgacgcgccgcggcctcgtcattgcccaatgccttggccacggaatcgaaaatcgaggcttgcggttcaggtaccaaggtatcgctcattgtcgctccatatatgattcgaatatgttccgttgagtagcctatcgcgttggctggagtttgtctcacgtgtttcgcccgttgtagaacgcggcgcacgaagcacgggagacatcctgctttccaccatagaacaatacttgtcaggctttcgcggccaatgccttggccacggagtccttcatgccttcccatccgagcagcgcgcacttgatacgcattggatacttggacactccttggaacacgatgccgtcttccaacgattcctcggcggattcatcgtccaagcctttgccgcgtgattccatgagcttatggaacgttccggccaattccatggcctcatccacggttttgccttccaccagatccaccatcaccgaaaggctggcctgtgaaatggagcagccgtgaccgtcccacaccagtcgttcgataacgtgcggctcctggtcggaaacctccacatgcacggtggcctcgtctccgcaggtcggattgaactggtgggactcgccgggagtgcaatactcgtgggttgcctgaaccgtggtctttcccgcctgggaggcgttttcggaagccagatccggagcgaaatgctccttgccatgcggattcttcgaggcttcgagaatgacctcttggtacatctgctcgagatcgtcgccagacattgcaaaatcactcatatgcgttactcaactccaaaaaacggacggaccttcttcaacgcctcaaccaatgcctgcgcgtcttcgacggaattgtagatgccactggatgcgcggttggatgcgtacacgccgaagtgacggtggaccggctgcgcgcaatgatgtccgacacgaatggcgatgccctgcgcatcgatgaactggccaacatcatgcggatgcacgccgtcgatttcaaaagccaccgtgccgatgcgctgctcgttggtccgcggtccgagaatgcgcacgccgtcgatctgccccatcttgaggagttcgcctgcgataacgcgctcgtgggcttcgagattctccatgccgatattcatcagccattcggccgcgacaccggccgcaacgacctgcgcgaccggctgcgtgcccgcctcgaaacgcgcaggaggagccatgtattgggcttcctgatccatccaggcaagttccaccatggatccaccgaaattcgccggtggcaacgcctccaacatgtcgcgcttgccgtagaggaagccgacaccggtcgggccgtacatcttatgcgcgctccatgccgcgaagtcaacgtccaaagcgtggaggtcgatcttcaggtgcggtacggactggcatgcgtcgagcacaaccaccgcgcctacctcgtgcgcacgtttcaccatcggcgcgatgtcggtgatggcaccggtggtgttgcccacatgggtgacggccacgatctttgtgcgttcggtgatcacctcgtccgcagtgttggaaaggattcgtccttcatcgtccagatcaaaccatttcagtgtcgctccggtacgtgcggcaagctcctggaacggcaatagcacggagtggtgttcggccttggatacgacgatctcgtctcccggcttcacagcgaaacgtcgtgccgcttctcccccacgtcccagcgatgcgttgccgaatgcggtggctagcagattcagtcctgcggtggcgccggaggtgacaacgatctcctcttcgccttcagcggagttggcgccgacaagacgtgcgactttggcacgtgcctcttcgaacgccatggtgctgcgtgcggcaagctcatgcgctccacgatgcacgccggcgttgatggtgcggtaaaaatcgctttcggcgtcgatcacgcattgcggcttctgagaagtcgccgcggaatccaaatacacgagcggatggccgtggatctcctgatcaaggatcggaaattccttgcgaatcgctgcaaaatcggtcatgccagcgcgctttcggaatcggatccttccggcaggtatgcgtcatagccggattcctcgagctcatcggccagttcagggccgccggtcttgacgaagtgaccggctgcgaacacatgcacgatgtccggcttgatgtacttgaggattcgcgtgtagtgcgtgaccatgagaataccgaactggttggcttccttggcgcggttcacaccttcggagacaatgcgcaacgcgtcaacgtcaaggccggagtcggtttcgtcgaggatggcgaacttcggcttgagcagttcgagctgcagcacttcggcacgcttcttctcgccgccggagaaaccctcgttcacggaacgtgtggcgaacttcggatccatcttcaggcgcttcatcgcctcggacagttccttggtccacgtgcggatggccggagccttgccgtcgacttcggtttttgcggtgcgcaggaagttggtcatcgacacgcccggcacttcgaccggatactgcatggctaggaagatgcctgccttggctcgctcgtccggggtcatcttgaggatgtcttcgccgtcgagcagcacctgtccggaatcgaccacgtacttggggtggcccgccagcgtgtaggccagcgtggatttgccggatccgttcggccccatgatggcatgggtttcaccggagttgacggtcaggttcacgcctttgaggatcggcttgatgccgtccttggtttcgacgtgcgcgtacagatctttgatttcaagagttgacatggttttcgctcctacgttctacttctcttccaacacctgggcgatcgcgtcgttctcgccgcgtgccaggcgcttgtcgataacgttcatgagatgttcgctgattgcgggaatgccgatttcctcgacgagttcgccaaaaaagcctcgcaccacaagtttgcgggcttcggtttccggaatgccgcgagactgcagatagaacagctcctcatcgtcaaagcgcccgacggaagaggcatgtccggctccgatgatgttgccgttttcgatttccagattcggttcggaatcggcgatcgcgcccggagtaagtaccaaattgcggttgagctcatacgagtcggtacccggcgcggtcggagcaatcagcgcgttgccgacccatgtggagtgcgcgcccttgccgtcaagagcgcctttatataccacacgactcttgcactcgggatggttgtgcacaatcatggtgcgatgttcgatatgctcgcccggatccacaaagtagatgccaagcatgttgagatcgccttgatcgccgccaaaatcctgatccatacgaatccgaacgacatcgccgccaagcgtgaccacggaatggcgcagggacgcaccctcccccaagtggatacgctggttgcccacatgcttggagcccttgttccactcttgaatgaacgtggtggacacatgggagtccctacctgtgagaatctccacaccttcggcgatacgtgcatcgccgtcatgctctaccacaacgtcagcgtgggcgcgatcggcggcaatgatcaccaggtggaatgcgtccagatccgttccggcaccatgaatcttaacgagtatcggctggctgatttcaccgtcgatacgcagaattccggcacgggaggcggagttccattccactgcggacacacgatcgcagggcttggaaacgatgcccgtatcggcgtctcccggcttgccctcgctataggtcacgccttcagtaagagccgtgccgtcgatcatagtgacggcaatctgggtttcgttcgacggcgtgaacgcgttgaagaactcttcgacacgttccacaggggtataacgccaatcatcctgcttgcggtcgggcacttcaaatgcgtccacatcaaatgaccgcggcgagcgatccgccgaagagggcatggctgccggattcgcatacggatcgttcggatccgcaacgggaatattgatttcctgagtttgtgccatggtaatcagcccaccgatccttccatctgcaattccaccagtcggttcagttcaagcgcatattccatcggcagctcacggctgataggctccacgaagcctcgcacgatcatgcccatggcctcctcttcggaaagaccgcggctcatcaggtagaacagctggtcttcggaaaccttggaaaccgtagcctcatgtgccatggaaacgtcatcttcgcgcacgtccacatgcgggtaggtgtcggagcggctgaactcatctacaagcagtgcatcgcataccgtcgagttggacgatccttcggcacccttgacgattttgacgagaccacggtatgcggaacgtccaccgccgcgggaaatcgacttcgccacaatggtagagctggtatgcggggcaagatggatcatcttcgcgccggtgtcctgatactggcccttgcctgcgaagccgagcgacatggtgctggccttcgcatacggctcggcgagaatgcaggccggatacttcatggttgccttggaaccaatgttgccatcgacccattccatggtgccgccttcacgcacgtaggcacgctgcgtcaccagattgtaaacgttgttcgaccagttctgcacggtggtgtagcgcacgcgggcatgcggctcgacgaaaatctccaccacaccggaatgcaacgaatcggtcgagtagatcggtgcggtgcagccttccacataatgcacgtacgatccctcgtcggcaatgatcagcgtgcgctcgaactgacccatattcggcgtattgatacggaagtatgcctgcaacggaatatcgacatgcacacccttcggcacgtagacgaacgatccgcccgaccatgcggcggtgttcaatgccgagaatttgttgtcgttgctcggaatgcacttgccgaaatacttcttgacgatttccggatacttctgcaccgcggtgtcggtgtcgacgaaaatcacgccttggtcttcaagatccttctggattgagttgtagatgacctcggattcgtactgtgccgcgatgccggagacaagacggcttttttccgcttcgggaataccgagcttgtcatacgtcgcacggatctcgtcaggcaattcctcccaagtcgtggcctgcttgtcgatcggcttgacgtaatacttgaaatcgtcggcgtcgaaatccttcagatcgacaccccattgaggcatcggacggttgatgaaatcgcgatagccttccaatcgcttttccagcatccattccggctcgttcttatctgcggaaatagcgcgcacgacattctcgtcaatgcctttttttgccgcttctccggcgaaatctgtgtcatgccatccgtacgtatagtcgccgaactgctggatgatctcgtcatcctgcttgattttgtcttcattcactcgcgtgcgatcagccacatactggctcatctccacgtcagccgcggcgttgggcgcttggttctctgccaccgtacgctgcctccaatcactcgtttgtacctatgacaacctaacagaacgtggggctaaacactagcgcccctttcgctattcggcaatgatttgtcgtgatttatcttacatagcgtaaaggcggaaaccgaacattcagtcttccgcctttgcgtctttctgccgttagcccgcatatcaggcctgaacgtgaaccgtcgttcccatcaggcaccaattgtagaaccattcagcctgatcccagccgacgccgacgcaaccatgggacgtgttcttccccatagcctgaatactgctgtcgttaaacgcactttgagtggcgatgcgatgaatcgcgcaacctgttttcgagaaatagttgacgaatccaacatccttgacatcccacttctcggtgtttccatccgatagggtaagggtgccgctcatatcttgggactggtacttgagccacactttgaagtcaccgtcaggcgtgcagttgtcgtaggagttcggatcgcagtaggttggcgtgcacaagtcgccgctcggctggcactggcccgtctgataatcattgccctgaccggcagacatatgcatgacacggacggtctgcccattttcaatggctgtaacggtatgcgaagacaagctgactaccacggtacgcgtggtttttttctcattctgtgggtcgcaagtgccttgaatacttactgaatcagaacctttggcaaacgcctcagcggcatcacggccaacattggtgtcgctaccatcagtaacggttataccatcatgcccagctacattggtttgcagcacatcaccgacactattaacgatgacatcaccgtcaactcgatcagcatggaagttcgatttgatggaatcgttatagtattgctgcaatttgtcaccatcgataatcaaagagccatttcgggtttgattatcgccgagcttctcactatccggtccaagcgtgatggccgatgcaatggactgcgcaccgaattccgccactttatggtcgccgatcttgatagccaccggcttcgctatccacgcgtcagcagaagccttggcctcgttggcttggtcatccgtgatggcgggatcagtaaccttatttttaagagtcaccatttgagcggtctgcttgccaaaggactcaagcacgttcttggcttctttgacgatatccgtcacatcgataccagtcccctgctgacctggcgtcacatcgaaagcggtaccatccgcgttgagctgtagcgacgggttggtggcggacacggactgcactcccaacatgtcacctaccgtctgggcgctgactcgagaatcatcgaaagactcgacgtcgacatcctcacgggtccagaatgcatacttctgaaagaaggaatcgtcacgtttcgcgttcatcacattttcggcgatggattccgcgtcaatggcgacgccaagatccttcaacgtgactttcttgctcgttccctcataggaaacgggaaccgttaatgattccgccgtatcggaaatctcttggatgatatgatctcgggattgtcctgtcatggacttgccccagagcgtgacacctggcaacgcatgtgactggaagaaccagtatccgccgccggccacggcaccgagaagaagcatcaccgcaagaacaatccacagccacaacaggtggcgcttcttgctggcattcacagtcaacgctgcaccatcatcaatgggatcggccgtttcggcaaacgaatccaagctcacctgcgagatgacttttggttcatcgcccatgttcgggaaggcgaacttaccgttgccgctttccggagaatccatatcgttcaagctcatgctccctcgtaaaggtttttcattacgaatacgtcttgttgataattcaaggccaagcccttattatgcaacatggccatgaactcctttggactcatgaccatgttgcatatcgggttatccgacgttaatcacaattcgtcgatttagcgctcctgctggtggtccagagcggccttgaccagacctgcgaacagcgggtgcggcttggtcgggcgggacttgaactcaggatgagcctgagtggacacatagaacgggtgcacctcgcgaggaagctcgacgaactcggtgagttcgccgtccggactctggccggaaatgcgcagacccgcttcacgcagacggtccttatatgccacgttcacttcgtaacggtgacgatgacgttcagtgacatgcgtggtgccgtacagttccgcgacgatggaaccttcttcaagctcagccggataggagccaagacgcatggtgtgtcccatgtcaccattgccggcgacgatgtctttctgctcctccatggttgcgatgactggggtcgcgcaatcgggctcgaactcggtggagttcgcgtcctccaagccgaggacgtggcgggcgtattcgatgaccatggactgcaggccgaggcacaggccgagggccggcagcttgttctcacgggcgaacttcagggcaccgatcttgccgtcgatgccacggatgccgaagcctccgggaacgacgatgccgtcgacctggtcgagcgcggcggccgcgccctcctcggtctcgcacttatcggcggcgacccacttgacgttcaccttggcatagttggcgaaaccaccggccttgatggcttcggtgacggacaggtaggcatccggcaaatcgatgtacttgccgacgatggcgatgttcacctcatgcttcgggtggtgcacacgctccagcaggtcctcccactcgtcccaatcgacatcgtggaacggcaggccgagctcgcgcacgacataggcgtcgaggccttcgtcgaacagggtcttcggcacgtcatagatgctcggggcgtccacacagttgaccacgccttcggaatccacgtcgcacatcagggagatcttgtccttgatggactggttcagcgggcggtcggaacgaagcaccagcgcgtccggggagatgcccagctgacgcagcatcatgacggagtgctgggtcggcttggtcttgagctcatgggcggcggcaatgtacggtaccaaggagacgtgcacgaacatgcagttctcggcgcccagatcgcggcggacctcacgcgcggcctccaggaacggctgggattcgatgtcgccgacggtgccaccgatttcggtgatgatcacgtcgacgtcatcggacgcctgcgcacgcatgcgggacttgatttcgttggtgatgtgcgggatgacctgcacgcattgtccaaggtattcgccggcgcgttccttgcgcagcacttcctggtagatctggccggtggtgacgtttgccttctggctcaggtacacgtcaaggaaacgctcatagtggccgatgtcgagatcggtttcggcaccgtcttcggtgacatagacttcaccatgctggaatggattcatcgtgcccggatccacgttgatgtacggatcgagcttctgctgcaaaaccttgatgccgcggctacgaagcaggcggccgagggaggaggcggtcaggcctttgccgagagaggaaacgacgccaccggtgacgaaaatatgcttggtaacgtgctcttgagaattgccatgttgtcttctaaccatggaacttcagtctatcagcggcatgagacgcggcgtgtttccttcaatacaaaaaggcggggccatcattgccttgatggccccgcctagcaggaataggagatacattcagtcaatcattggcttatgagatcagtcctcctttctgcgggaggccgcgaacgcgaacacggatgcgatggcaagagccaccgcggccagtgcgaaaccggtgatggcggaaccagtattcgggctttgcacagcatcgctcttcttgtcggaagctggctggaccgcgggtttgcgcacggttaccgtgcgcgtgaaggtggcggtcttgcccctgctgttggtcaccgagtacacgagcgtgtattcgccttccttagaggtatcgaccgaaccttcgaccgtgatcttgtcggtcagatcgccgtcaacctcatcccatgcgctgacgccggacatcggatcgaactttgatcccagagtcacgctgtcggaagccaccagacccttgatgacaggcgcgctgtcggtatcgggcttggtgctgctgtcgagtttcagcacagtggcagacagtgcgcccgcttcgtacgaggccccttcggcgagatcgacattggcgatagcatcatcggagtagaccttgccgtcggctgcaagcacttggtaggagccgtttgccaagccttcgatcgcggtcttgtctgcgttggcgttgaagatcaccacgtaggtgccgtcggactgctcggcctggtaggccacgacgccgtcagcggacttgagcatcgtcacgttggcgttgatgtcgttgtagtcggtcagacgcagcgcgttgatctgcttgcgcagcttgatcaggcccttgacgtagtcgacggaatcggcgtactgggtggtgcggtcccaatcgatggcgttcaccgcgtcgcccgtgttgtagctgttgccgtctccgcccttggtgcgcaggaactcttggccgagctggatcgcggggatgccttccgacagatacacgacggagtcggcaagcttggcacgtgccacggtcgtggcgtcgtcatccgtcgggacggacttcctgagcttgtcgtacagggtcatgttgtcgtggatttcggcatagttgaccacctgtccggcatcggcgtagtgatcctgcgcgttgccgttccagcaggtcgtggtcgcgttctcgtcgtactggcagccgagcacgttgtgggcgatcaggctctcctggtcggccttgccggaaacgaaaccggtgtcggtgtcggagaacacggatcccttcaagccgtcacgcacggaatcgttgaagaacgcgatgccgttgttcgtgccgtcggacgcgacttggtacgcgttcggctggatggtcatctcaccctcgtccatggtggtgttcatatcccagccttcgccgaggatgatgatggacgggtcgatctcgtcgagcgctgcacgcacttccttcatcgtttcggtgtcgatcagacccatgagatcgaatcggaagccgtcgacgttgtagttcttcgcccaatacgtcaccgaatcgacgatgtacttgcgcatcatcttgcgctcggaggccgtatcgttgccgcagccggagttgttgaccagggaaccgttgtcatcataacggaagtagtagccgggaacggtcttgttgaacgagtggttggcggcattgtagacgtggttgtacaccacatccatgatcacgcgaatgtcgttctcgtgcagtcccttgaccatctgcttcatttcggtgacgcgagaggcggggtcggatggatcggaggaatacgagccttccggcacgttgtagttctccggatcgtagccccagttctgcgcaccttgcgcgttgtagctcagatcgccggtctcatcaacggaaccgtagtcgtacatcggcatgatctgcacgtggctgacgcccaactgcttgagatagtcaagaccggaggtggcgccgttcgccgtcttcgttccggattccacaacacccagatacttgccccgcttgtcggcggagattccggaattcgggttgatggagaagtcgcggatgttcatttcggcgatggtggcgtcagtggtcttgccgaattccggcatgcggtcgcctgcggagcccatgtcttcgctggagagcaccacggaacgttcgccgttggcgaccgcagcggtcgcgtacgggtcggcggagacgttcaccgtgccgtccgcgaaggtgagcttgtaggagtaggccgtgccgctagcaaggttcttcaccagggcgctccacacacccttgtcttcagaggccatgtcgatggtcttgtcgacttcggcattcacatcgtcggactggtaggtgacaagctcaaccttggtggcggttggagcccacaccttgaatccggtcttcgcgctcgtgtaagtggcgcccagatcgtcgccgtcataggcgtacttcttgtcgaaggcatccgtacgcaccaccgagcccgcaatggcgtcctgcgaaccgaagcccttgacttcgacggtgtacttgcctcgcacgtcaagatccttggccgtggtgatgatcaccttggtgccgtcggtcttgatgttcttgacatctacagccttgccgtcggcgtcagtgacggagaccttgccttcaagctcatccgaagtgacctttttggacagtcttgcggtcagcttgttgacgtcggagatttcaacggacttcatggacgctcccaacgatggacgtgaggaatacacggtggcgtcgccgcccatcagccacacttcggccgatgcggtgccgtccgattcgttgaacaccaaggcgtttgacgggatcttgtaatcggcgtcatccggatccttggccttccacgcatcctttccgtaacggcgcagcatgccgatgtcggaggctccgtcgacgttgtagtaggtgtagttggcgaaggagtattccgcgacctcgccccagtcatcgtgggtggtgaaggtggcggctccgccgttccaattggaagcccaggtccagatgtcccactggggaacggtgaccgaggtgtcttcggcgttgtagtacaggccgtcatcacggttgtagtggaccttcacggtaacggtgttggccttgcattcgtagtcgctcggagcggagtcgagggtttcgacggtggtcgattcgccttgatcctcatatttggtgccgtcgatccacacttcggctgtgccgtcggcgttcaccgtggcgctacggtcgccaccgtacttgttccagtctgcggtggtgacgatgaagccgaacttgtcgaacttgccgccgaaggtcagcgtagccaccttgccccagcagtcagctccggtgaagggatggttgactgccgagaggctcgagccgccagcgtctgtgccccacacgtacacgccgcgattatcggaatcgctggctggcttgtagtgcacgacgagtcgggtctggccgttgacggattccggattacccacggtcgcggcctgatcggccacacccacgtgcgtgatgcccgcgttggcgtggtagttgccgccgcccttcgggttctcccactggtcggtgccggtatcgtgaaacacgaagtcgatcttcttgcccctggtgtcgatggtggcgcgatagtacccctgctcgtcgagggtcatgtcggcttccggctggttccagtcatcgccaagaccgtagtggaccttcgggctcttccagctggaatcggcgggcttgtagtagatggtgacgcttctgtcgtcgggcagggtctcgtccccttcctggttcacgtcaggatcggacgggtcgttggccacgctggatgccgggtggctgtccttggtggcgcctgcatacagtgcgatggcggaatgcgccggtaccgtggtctcgatcttgccgttcttgacgcttacagtctgggagcagtccatggtggcgtacacgttgcagtattcgccgtcggcgagcgatgtcgtgtaggaggcgtccttgtcggtcttgccgttgttgatggcgatgaagcccttatccccgcgggagaaggcgatgttgtcgccgccgtcatcctgccagtcggcgaccttggtgccgttgacgtagttgcggaaggcgatcatgcctcgggtggaggtccagcgctgctcgcagttccagtcggagctgttggtggaacagacctcgtccatattcacgtccggaacggatgtggcggtggctcccggtgcgccgttgtcgttctcatcccacttgtagtcggaaagcagacgcggcgtgccgtagtcgtaggcaagcatgaatgcgttggccagctgatacttggcaccgtccttgtaggtcagggcgccctcgttgcgcgcggtgtcccagttggtgacgaacacgttggcgtcttcggaggcgagatccttgctcaaccgctcattaagtcccttgaggtttgcgatcttgtctttgaaggtctggttcatttcggacttgaagccgaattcggtcaccgtgccgttttgcacgtagttgctcggctggatgcccgcggcttcggaggagttcccgatgacctcctggatccagtagatgctgtcggcgttcacgccgatcttctttgcgaacttctccttgatggccttcatgctgtccgtgtggatgtgcttgacggcatccatacggaagccgcgaacaccagcattccacagggcggcaagatagtcagattgaatatcctggaccttttcgctctcggagtcgaagtcccacatggagctcaggcggcattcctggacttcctgctggttggcgtagttggagatgttcttggagcagctgtggaagtcggaggccgtgatgccttccggatactgttcggtggcaaatcccgggtagtcgccggtcgaaccgttgtattcggttcctgcgacgccggtctgcttgccgtcggccacgtcggcaccggtggtctggttcagcacaacgtcggcgatgatgtcaacgccgacggcattgcactgcttgatcatgtttttgaattcggcttccgtgccgagcttggaatcgagcttgtagcttaccggctggtaggacgtccaccattgcgtgccttggatggattcctgcggcggcgacacctcgacgtatgccacgccttccggaccgtatgtgctcgtgcattccttggcgaccgtgttccatgtctgctggaaggcgatgacctgcacgtctttcttcgcattcgtttgcgcctcgggctgagcctgagccatatgcggtaccgccaccaaggtggcgcacgccatggcggcggcgacgcctatggccaccgcacggctagccggccgattcattcgctgaacgaccattgttctccgttctcatcgttgagatcgaattccggcccccatggcaggttccgcccttcgacaacgtatgcgccatggtcatccgcgttacctgcggatcatctaagacacactctgcgatgaatgtgcatacgtttgcaccctagatcggggttcatcgtacagtagatgctgcgcatcgcaatgaaacagcgtgaccgattgcaatatacggaaaagaaggacaagcgaaagaaaatgctttcagcaacaattcattgtgttgcgcaaaacggcaatcatatttgcgattgttgcagctttttctgcaaacgaatgcaatgctatgtaaaaaccggatgcccatcaagagcatccggcattcatagttcctccgagactatctcaaggggaaatcggaaaatcatcacttcgattccaacagatgcgccaccgcatccaacgccagcttgtagccatagaaccccataccggtgatagtgcccgtcgctactggcgagatcacggaacgcttgcgaaattcgtcgcgtgcggatggattggagatgtgaacctccatcagcggcaatccctcatcgatcaccatatgcgcggcatcggccagaccgtaggagtaatgggtgaaagccgccggattcatcacgaccggggtcttctcgtcggcggcctggtgcatccagccgatcatctcggcttcgtcatcgctttgacgcacttccacgtcaagaccaagctcgctgccccactgcgcgcacagggtacgcagggtttcaagatcctgcttgccatacacgtcaggctgacgcacgccaagacggccaagattcggcccattgacgaccactactttagtcatattccacttccctaccttgtttactgctgaatacgacggaacgcctcttcaacggcgtccgcaggcggatcctcaagatgaatcggatggccgacgccctcaagcaccacgaaacgaagcttattgccgcgagccttcttatcccggtgcatcaatgcgagcacatcatcccatgtgccattgttccaggacgtaggcagccccagagatcccaacaacgaacgatgatagtccacgagatcctgatcgatgtaccccagaagatgcgacagttcggctgcatacacgcaaccgaccgccaccgcattaccatgacgccagcggaaatgctcaagcttctcgatggcatgaccgagcgtatgcccatagttgaggaattcgcgcaatcccgcctctttaaggtcggcggacacatggtaggccttcacgctcacggtatgttcgatcagctccgcgaccacatccttcaggccggaatccaagaacgtcgacccgtcgaaggcacgcaattcaccggcatggtcctcgaggatctgcagaatctccgggtccatgatgaaaccggacttggcgacctcgcccaatccttcgatgaagatgtcgttcggcagtgacgcaagcgatttcagatcggcaagcactccggcaggcgtatagaaagagccgaccaggttcttcccctgaggggtattgatgccggttttaccgccggtcgaagcgtcaaccatggccagcaacgacgtcgggcagttcacgtagcgaatgccacgcatccatgtggcagccacaaaccccgccaaatcggttgccgcgccaccaccaaggccgacgatcgcgtcagaacgagtgaaaccctcatcccccaaacgctgccagataccattggccacttcaatggtcttgccggcctccgcgtcgggaatcacaatatcgtacgcatcatagcccgcctgacgcaacaaagtacgcgcacggtccgaatgacgctgcaccggctgggtgtggataagcgccactttggcaggcttgcttcccaacacctgcgcaagctggcccatcacaccctctccgatacgaacatcgtatggttcgatggtggaaccggtgacatggactatacgttgatcaatcatttccatcagctttctcgccgcggcttggggagactggccacgcgtgcccacatgcacgttcgccacgctcctgaacaccgggtcacgttccttgtagagcttcttccaacgctcattggcatcgccattaagcatcggacggcctccaccgcgatttgcccgctccatggcttcctcaggatcggccataagatacacgaccttgccgccgtccgcgatatactgcgccaatccttcctgaatggaaggcgtcatcggcgctcccccgcccaaggaaaagataccgtcgaaatcctcgagcatatcaagcacgacgtcgctttccagcctccggaattccggttccccatacttttcgaagtactcgggaatccgcattccggcatcatgctcaatctcattgtccgcatcggcgaacggcagattcatcatctgcgccacttccttgccgacacgagtcttgcccgcccccatcatgccgatgatcacggcgacaggcctacgcataccactcatagacgaatcacctcatatgctcaggccatgaggcaacgtactgctcggcgttacgcttggtttcggcaacgcaatcgccgccaaacttctcaagcacatactgcgcgatggtcaaacgcaccatcgcctcggcaacaacagccgccgccggaaccgcagtattgtcggaacgctggttaatggcctgcgccggctcgcccgtggtcacatcgacggtacgcaacgccttcggaatggaaggaatcggcttcatcgccgcacgtacgacgatcggctgcccattcgacatgccaccctcgataccacccgaacggttgcttagacgcgcaatacggccgtcatcgcccaccaccatttcgtcatgagcctgagaacccggacgcatggcctcaaggaaaccatcaccgatctccacgcccttgatggcctgaatacccatcaccgcactggcaagagcagcatcaagacgacgatccgattcaacatacgtgcccacgcctgcgggaacgccgtacaccacaacctcgatcacaccgcccaacgtatcggcgttctccttcgcctcatcaatacgggcaatcatccgctcttccgcattcttgtcaagagtgcgcaccggagaagcgtccaacgcctcaagatcctccggtttgggaagcgtggcctgctgcggatcggtaatacctgcgccaccaatggaaagcacatgcgaaacggtacgaataccgaacgcctgctccaagaactgcttggcaacctcacccaacgccacacgcgaagccgtctcacgcgcggaagaacgctccaacaccggacgagcatcatcaaaaccatacttacgcatgccagtcaaatccgcatgccccggacgcgggcgagacaacggggcattgcggccctcacgagcaagctcatgatcaagcggatccgcactcatcacctcagtccacttcggccactcggtgttggcgatctcaatggccaccggagaaccaatcgtctcaccaaaacgcacaccagtcagcatacgaaccttgtcctgctcgaacttcatacgcgcgccacgaccatacccaagacgacgacgcgccaacgcgccaacaatatcctccgtggtgatatgaacgcccgcgggcaatccctcaatcatggcgacaagcgcctcaccatgcgactcgcctgctgtctgccaacgcaacatgccaactccttttctcacgaatgcaactagtggactatcttaacggtatgtggtatatgatttgcctgccaagtctgctttgtggactggccatcagcgttgaagacatccgttcacgccgcattccacgcgcctggatcgccaccggatgcacagcgcaaatcatcgtaaacctcatatacgcgctttccatcaacactctgtacctggcattgcaggcaatactcttcgccgtactgtcggccgtactgcaatgcgcgctcgctttggtgaaacctggttcattgggttttggcgatgtcaccgccaccttgctgatgggattggcagtcggcatgttcggtctgttcgccgtggtgttttggtggcttgcgattggtgtggtcggcttgttatggctcgttttgtggacacgtttcgatccgcagaagcataccgcatatgccggtaaaacgccgttcgccccagcgcttgtggcagctggggcgataggcattgcgattggcgttttattctgagatcagttcgcgttctcgttgttgttcttgtactcgtcgcgaatctgccagaactcatcttcggtttccacgaatttcgtttcgccggtctgcaggtttgtggtgacaaagtacagccacttgccgtccggaggattgacggctgctgtgatcgcgccatctccagggttgctgattggcgtgggcggcagtcccttgtggattctggtgttgtacgcgttgctgtcatcgcccaactggtcatcggtcaactggcttgcggaaataccaagaccgtaggcgaccgtggtatccatgccgagagccatatcggcgtcaagacggttgagaatcactcttgccacctggccgtagtatttttcgctgccgacttccgcctccgcgatggatgcgatattcaggatgcgctcacgttcgctgcctgtaggtacgcccaaggaatcgagtttgctcactcgcgcgtcgaccatttccttgatgatgtcttccgctgacttgttttgcacattatagctgcctggttcaagccatccctcgaatttgccgccggcctcgtcaggaaggattccagcaccgccaccgtccatcacggcttggaactgtgaaacatccaagccggacacactcgccgcattttcgatgacgtccgacacacgttcacccgcacgcacttcggcaaaaccgccggcctggctttggtcagaaagcaccttgaccacatcggacgccctcatatgcgtcctcaatgcgtatgatcccggatacaacgtggcgccagctccgcttactgcggaagtgaaggcggctgcggatttgacgattttagctttaacaaggttgtccgcgatttccgcggctccctgcccggattccacgacaaacgtcacgcctttatcgcctgggcccgtgtaatcctcgatttggctttgagaattcgcttcgttcacggccttccaatgtttcagcgcgcgcacgccgaagaatccgccgacaccgatcagcacgatcaccaccagagcggcgataatggtgatatagcggcgacgacgcttctgctcacggtgacgacgcatgtccttacgtgatttcggtggttgcggcggcattgccgaaacgaaggatgcatcatccgacgaattcacccattgcgcgttatcggagaaaaaatcgtcgagattatcagtcacaggcctctctcctctggtctctctcttcggtcgatggccgtctgcaatatcaccactgcagactgctggtcgaccatcggacggtgctttcgtccaccgacctgcgcatcgaatagctgatgatgtgcagtcaccgtagttagacgctcatccaccaattcgatggacggcacttcctttagcgcatagttctcatcatctactgcgacacgcagtctcttctcaagattaacagtccatcgccgtgcttttttcgcgcttttgccttcttctccgcttagtagcaacggcaatccgactaccacatggtcgaccgattcgtcttcgatgacgtccacgacctcgtccaatgcacggaacgaatccccgtagacctgaatattgcctgcggggtgtgcaagagtgatgccaggatcagacagtgcgagtccaaccctggcatcacctaaatcaatgccaagccaaaccatgcttggtggttcagcccttcatggcctgattggccaaagcctcaagcgcctcattgatcttggtggcatccgcgccgccaccctgggcgaagtccggcttgccgccgccaccaccgccaaggatcttggaagcgccacgaaccaaatcgccggccttgataccctgcttgcgtgcagcctcgttagtggccacggcaaccataggcttgccttcctcgttcacaccggcgagagccaccacaaccgggaattcctcaccaagctgtccgcgcacatccagcacggtcttgcgcagcgcgtcgaaagagccgaagtgctcgacgttcttcgctgccaccttgaccggagcctgggatgccttggtttcggaaaccaaagcaggcacggaagccgcaagctgggattcgtacatggtcgcaagacgacggtcggattccttgagcctggcaagcagtgcgttcacacggtcagcaagctcgtccggacgggcattgaccatgtcggaaagctgtgagaccagcgcatgctcgcgagcgttgaactcataagcgctttcgcccacaaccgcatcgacacgacgcacgccggagccgatggaggcttcggacatgatgttgatggcaccgatcttgcccacatggtcgatatgggtaccaccacaaagctcacggctccatccatcttcgccgatggagaccacgcgcacgacgtcgccatacttctcgccgaacaggtgcatggcacccaaggcgatggcgtcgtcgaacttcatctcctgcgtggtgacggcaagattttcgcgcagcttctcgttgacacgcgcctcgacggagttcatcgcatccttgctcggggcgctggaccactggaagtcgaaacgcaagcggttcggcgcgtcttcagagccgcgctgggtggcctgcgggccaagctcctcacgcagcgccttgtgcaccatgtgggtcgcggtatgcgcgcgggcgatggcaccgcgtcggtcaaggtcgatgttggcgttgacttcggcgccgacaaccaacgtgccttcggtcaggcggcactggtgcacgatgaggtccttgatcggcttctgcacatcgtcgacttcgagcacagcaccatcgtcggaaaggatctcgccctgatcggcgagctggccaccggcctgcgcatagaacggagtgcggtcgagaatgacttcgatggtggccggaccggtgactgcggggacggagcccttgccttcctgcatgatgcccagcaccttggcgcgggcggacatgtcggtgtaaccaaggaagtcgatgggctggaccagcgtcttcttgaaatcgtcatagaccgacagatccacattgtgacgcttcttcagggcatctgcacgggcacggctcttctgctcggccatgagctcgcggaacttcgcctcatcgaccttgacgccctgatcggcggccatttcgagggtgatctcaatcgggaagccgtaggtgtcgtgcagcttgaacgcatcttcgccggaaacggcgtcggatccggattccttggccttggccacagcgaggtcgaaaatctcggtgccggattccagcgtgcgacggaacgcgtcctcttcaccatatgcggcttcggacacatcgtggaaggtgtcgttgagttccggatagctcggctccatagctgccttggaggtcggcagcagggtcggcatgaccggatcggtcacgccgagctcgcgcatggccttgactgtgcggcgaagcagtcggcgcagcacgtagccgcgaccgttgttggacggacgtacgccatcggacatgatcatcaatgcggaacgcacatggtcagccacgatgcggaaacgcacatccatggcttcgtcatcgccatacgtgcggccggacagcttctgggcggcttcgatgaccgggaagacctcgtcggtctcatagatgttctgcttaccctgcatcagataggcaagacgctccaagccggcaccggtatcgatgttcttgttctcgagctcgccaacgatgtgcaggtcggtcttggacttgacgttgtcgacctcgtagttttcgaacacgagatcccagatttcgatgtaacggttctcgtcggcgatcgggccgccttccacaccgtattcaggtccgcgatccacgtagatctcggagcacggaccgccagggccagggccgccggtggtccagaagttgtcctccatgcccatgatctggatgtgttcggggtcaacgccctcgttcttccacattgaacgggcttcctcgtcgtcggtgaaggtggtcatccacagcttctccggatcgaagccgtagccgcccttgtcttgcggggtggtcagcagctcatacgcatagtggatggcttcttccttgaagtaatcaccaaaggagaaattgcccagcatctggaagaacgtgccgtgacgggtggttttgccgacctcgtcgatatccaaagtacgcacgcacttctgattggatgccatgcggctcttcggcggagtctgctcgcccatgaggtacgggatgaacgggaccatgcctgcgatggtgaacagggtggtcgggtttggagagatcagcgatgccgaaggcacgataagatggccgtgcttttcgaaataatcaagatagcgcttcgcgatttcagaagtgcgcatatgagattaagctccttttttgctgaaaggcctagtgcctttcaaacgaattcgtgattgttgtccgaacgtacgttacgggaataagatcagctgatcttatccgcgtatttggtattaagttcagcctcgcgggctcgacgcgtttcgttgaactcattgaacaaaccttcaagggtgcgcacggcgacatgatcttgatccggcccgaacagaaattgtcgagccgcatcaggggtgttggccttgacgtacgcctgtgctttggtcactgccaccgcaccgatgcccacaccaatggagatccagaagagacgcttgaacatcactcccccttgttattgctgttgacgttcttcttgttcatgaaggactgcgcggtggttttcagggcatatgcagcggaagcaaccttgataaccggcttgcccaagaaggatccatacagatcggtcagggcgctgacattattggcggttgtggaagccgctgcggaaatcttgttgacgtcttccagcgacttgttgacctgctgcaccgtggtcacactctcatcaagcgcaggaatcgcatgatctcccgtttctttgactgtctcggcgagctggtcgaacagtttgccgagacgaatcaacgggtagatcatgaaaccggcaagaatcgcgaaagcgattgccgcaatcagaccggcgatttctccaacacccatcttgtacctcttttcagtcccacggttgcccgcgaacacaacacgcgcataacagtagtaaaaagcccagacctaaggcaagtttcgtccgccggtcactggttatacgatacgacggttaccgcttcagcgataggcttactggtgtcgaaatcgagcgtggtgaccgatccgttcgcagggcgttcgctgaggtcatagccttccggcgcgaaacggtgcataaggctcagcagcgtgttgccgtgggaaatctgcaacacgtcatcactgtccctcagcgcaggattcgaagcgatcagcgcgaatccctcctcgactctcgaccaatattccacgtcggactcggcatcgtggaatggatccgcttccttaaggaagtcgcgggtcgcaccaagaccgaactttgcgacgatgtcgttgtagttcttcgcaccgtgcggccctcccgcggcggtccacgccacgcccatatcctggccttcgaaatagccgtagaactgttcgcggaaatgcatgtcactgaccagttgggggcgggtgtgtcctgcggcctcattcacgtcgaggatgcgctgggctgtcatttgcgcacgcgtggtgtcggagcaatatgccgcggcgaaatcaaactccttcagtttgtttgcggctttgtctgcgtcggcgatgccggattccgtcaatggagaattagaccagccctgcaacctgttatatcggttgaaaaacgtctgcccgtgtcggacaagatgaagatgaagcaacatgggttccatgctaccctcacggtttgagcaaatccgtgctatacgatgttgttatgggtcattttatttcacgttggctaattcttaccgtcgcggcgggcgttatggttgcggttctgcccggcatgcacgccattggcgagccccctgtgcttggcatcgcggcgttcgccttgttcatggcgcttatcaatgcttccataaagccgattatccatgtcatagcgttgccgttctcgattatttcgttcggactggtcgcactggtgatcaattggctgttcatgcagcttgcgtcatggttggcgctgtcgtttttctctgtgggcgtcactattgacggattcgcatggtctgtgcttggctcacttgttatgacgattgtgagcggcatagtaggcggcatcatcggcgactgaaggcttcccgttgctcaaaaaggccgcacatgcgcttgagatagcgaagagcctcgcaatcctgacgattgcgaggctcttgctgtatgtccttatactgtatgttcttacagtatgtagatccagatcagcgggcgtagaattcgaccacgtactggatgttgacctgcaccgggatttcctcggcttcaggcttgcgagtcagggtggccttcagggaaggcaggttgacgtccagatagcccggaaccggcggcagcacatcgcggtgagtgccttcggccgcaatctggaacggaaccatggtctggctcttggccttgacctgaatggtctggccaggcttgacgcggtaggacgggcggtcgacgatgttgccgtcaacgaggatgtggcggtgaaccacgaactgacgtgcctgagcggtggtgcgggcgaagcctgcacgcaggaccagggcgtcgagacgggtctcgagatcgatcagcatggcgttaccggtctggccggcggtgtgggtgcccttctcgtaagcggcgcgaagctgcttctcagagatgccatactgagcgcgaagacgctgcttttcgcgcagacgcactgcgtaatcggactcagtgcgacggcgggtgcggccgtgctcacccggagcgtacggacgcttttcgaagatgcgctgagccttaggggtcagagcgatgccgagggcgcgggaaaggcgcacctgacggcgagaacgctgaacgttcgtcattggtttaatcctttgtttgttctgtcgttgtctgaacggagcgcacaccggtttccgatatgcgctgagccagcctctccagtgcttcttcgtgcatgcgcacgaacgacttgaacacgtgccgtaaacagctcgtatcggtcgccgacccactgatgggctaagactccagacggtatgctcccttgcgggcgcacaccaatcgttaataatacacatgagggcgggacgagctcgtcgtttcgccctcttcggcatgtcatgccatcatgacgccgctatggttcagccagcactcccctgtccatgcgatagattcgatccacatacgtcaaggcatccggatcatgggtgaccatcaacactgcggtgccgtcgtgcgccacttcctgcagcagccgcatgacgatggcagtgctttcggcatccagatctccggtgggttcgtccgctatcagaagtttcggaccattcatcagagctcgcgctatgctgacgcgtctcatttcgccgccggaaagctctttcgggtagcattccgccaaatcgtcgacctgcagtcggcgcagcaatgcgtgcgcacgttccatggcatggtcctgaacgggatcgttgtgtgttttcgataccggagccgccgcgatgacgtccggaagtccgtcgtcaaccgtctgttcggaagatgcgtcggatacggtttcttccactgatttcgcatcagacgaatccgcaggtatctcaacatcgcgctgcgccgttttgccgttgcacagcacggaaggaagaatcacattgtcgagtgccgtgagattcggcagcaatgtctggctttgcgtgacgaatccgacgatccgattgcgtacgactgacatttgtttgtcgttcaaccgcgtcacgtcattgccgtccaagtcgatagagcccgatgtgggtttcagcagtccggtgatgagattcaacaatgtgcttttgccattgcccgaacggccgacgatcgccacgaactcgccttggcccagcctgaaatccacatggtccacggctgcgaacggtttgccgcgacgggtgaactcgcgagtgagctcttgtacttcgagaaccgtgttttccgccatcattcaccttctctcaaagtcagataggtttcgggagcggaaagtttcaccgccgtcgtcacggaggcgagcagtccggtaagcaccgcgaacacgaaactcactgcgatcaatgccaacacattccacatgttggtttgcagatacggcaactgcagctgccgtccgataagcgtgctgaacgggaaaatcgccagcgacgcgaccgcaatgcctatcacaccgcccaaagctccgatcatggccgattccttcacgatgatgccgaccaaagtggaacgattggcaccaagaatgcgatacgcggcgaattcacgtttgcgttcgttcatggcggacgagaacacagcaagcagcacgatcagccccatgacccagaacaccgcgacgaaaagggtcacgtagcgaatgatcacgttcagattggatttcgttgtggctgtgatgccccccggatacacgtatccgaggcttttgattcctgttgttttggtgatgttcgaagcgacctgctgggcggagtaaccgtccttgaccttgatgagcacggcggaaacggctttgtcggcatattcttccggaatggcggcatgccccaccttggcggaatatccgaccacgtcgggaacggtctgcatgttcacgaacacggaattgtcgagcgacgtgccggtattggcgagttgcgccgccacggggaattcgtgcccatagagtttgaccgtgttgttgcccgacacgctgatgctggctcctgcaacgatctggccgcgctggagcgtaccgtcgaactgcgatgcgatccaaggggtgatcacgaagtcggtatcggggttgaatccgatgatctggactttctcgtcgcagcatgcggcggccaacgatgagatatatgtttgttccgtgatttcgtcgatgccgtcggcttttgccacttcgtcggtgatctcgttggtgaagtagaacgtgcttgccgatccgttggtcagcaacgcttcggcttcgtttttggtgttttgcggcgtgaccatgagatcggcgcccatacgttcctgcatgctgttcaagccggcttcaaggttcatggacagcagtgaaccaccatagaaggccacggtaagcatggcgacgacgatggtgagcgccgcggtacgaaacggtttgcgtttgagattgaccaggggcaacccgccaagggtgatgtgttgcgtcatattgggtcaggcgcgcttcgccggcttgagatcgagatatgccgcgattgccgcaagtacagccagcagcacgccgagcacgatcagcgtcggcaaggtgaccatatggcagcgcatcatggcacccttgcacacgccgatgagcacggtcggcacggcgatggtcagcacgccgagcaccgcattggcgaggtcaagaccggcgcgggtctgatcggatacgagcaggccgacaatgccaagcgccacgatcacgatgccgatgccgagcgcggcctgagccgtgtaatgacatgccatcggcgtttctttgaccgcgcatacgtgagcgaaggtctgcggcgcgatggcgatcaagatgccgagcacgatctgcgaaatgcctgcgtacagtttcttattcatagcttcctctcaaaaaagacaaacaccgccgattattgcagggtctttttgaaaaagaaagtcttgttttttcctccttttcgtgctacagaggagatttcatccgttcttcatctccgtcatagcatttcaatgggtgccatacgcaacagcagacgcttgacctcaccattgccaaaatcaacggtaatgaccgaattcatgcccttgtcctgcgtttcaatgaccgtacccaacccgaaatgatcatgcgtaagcttgtcgccgacatgcacgtctgcaatgttcagatcattatggctaccggccgggcttgcggatgaggatttagttaaatccacaggcttgtttttcggcttgacacgtcgcgtggtgaccttgcccgatttccctcctgacttgccggagccatacgaaccatacgagccgtatgaggaaccggttcccgatcctccgcacgagcgccgggatgtggaaccatacgaggatgatgagccctgcgtagccgggccgccgtactgcgagcgccctgccccatatgaagacgatccgtatgaggaacgagaccaccgcgagccggaaccgtatgaggaaccataatccgactttccatacgaggaaccgccgaatgacatcgatccgaaatcgtcatcatcgtcccagccgccgaactcgtcgtcgtcatcctgccagctggcatgcatgcgttcgacgccggcttcgcgtcttttccaatcaatcagttcgtctggaatctcatcgaggaactgactgggcatcatgtcgctggcttgcccccattgcgcgcgtacggccgcgcgtgtcacatacaggcgtcgcttcgcgcgagtgatgcccacgtaggcgagacggcgctcctctgccagttcgctggtgtcttccatggcacgctggtgtgggaatgtgccttgctccatgccggtcaggaacacatacgggtattccagaccctttgcggtatgcagggtcatcatcgtcaccttgccggaatcttcgttctcccctggcaattggtcggaatcggccaccaacgcggtggtttccaaaaatcccgccaatgtggcgtctggcgtgttctgctcgaattccgccgccactgattgcagctgggaaagattatcgacgcgggaagcgtcctgcggatcctcggagcgctgcagctcttccaaaatcccactcttggcaagcacttcggcaaccacttcggatggcttcgtgtcatggtccttcgcaaaagccgcaagctcatgcatcatgtctcggaacgcactcaacggtttcgtcgtgcgcgtggacatgccttcgatctgttccatatgttcgatcgcttcgaaaaaagtggtgccatgggcatcagcatacgaggcaacgagtccttccgcacgaacgcccagtccgcgcttcggcacattgaggatacgtcgaacgttcacattgtccgcaggattcacgatggcctgcaaatacgcgagcgcatccttgatttccctgcgttcgtagaatttggtgccgccgacgagctgatacggcaggttggcattgatcatggcctcttcgagcgagcgtgattgcgcgttggctcgatacatgatggcgatgtcgcgatacgccacgccttcctcgttgtggattcgtgcgatttcgttggcgatccatccggcttcctgttgcgcgttgtcggccgcgtatccgacgattttgtcgccttcgccaagtgccgtccacagttttttcggcttacgattttcatttcttgcgatcaccgcattggctgcgtcgagaatggtctgcgtcgaacgataattctgttcgagcatgatggttttcgcgttagggaaatcctgctcgaaatcctgaatattacgaatatccgcgcctcggaacgcataaatcgactggtcggaatcgcccaccaccgtaatccaagacggtccgacacggcctgcccctcgcatatgtggatcgggctgttctcccgaatcaatgccggaaagctcacgtacgagcacatattgcgcatggttggtgtcctgatactcgtccacgaaaatataacggaacttatgccggtaatattcgctcacctgtgggcaacgctggaacaattcgacggtgcgcatgatcagatcgtcaaaatccacggcattcgccatggccagacggtactggtactccgcatacatcacggcgaccagctcgtcgacgtcgccggccgaaacctgatatccgcgctggccgggcttgtagtcgcagttcacgcttttcagctggtcctgccatgaaatcaacgaattcttgcaatccgagatcttgcccaatagcatgcgcggcgtataccgcttcgtatcgatgttcaaatcgccgctgatgagcttgaccaaacgttcgcaatcagccgtgtcataaatggaaaatcctgaggtaagaccgatttccttgccgtcacgtcggaggatgcgcacgcacgcggaatggaaagtggagatccacatgtgttcggcttcaggccctacgagggccgcaaggcgttcgcgcatttcggccgcggccttgttcgtaaaggtgatggcgagaatgctgctcgcccaaaaaccgtgtgccagcagccatgcgatgcgtctggtgagcacgcgggtcttaccggatccggcaccagctccgatgagcagggcttgtccgtagtacttcaccgcttccatttgctgcggattgaggtccttgatcagactttgcggatcgcacaggactggtcccatattctgctccaccggttcctctttccatgaagattcgaagtcgattactgcgaaattcatgtctatcacacatgcaggtcagcgcaacactcgcatggtcaattgacgcgcgtatgctgaacgtttatatgcggttcaccgtatgtcaacatcaacgccgccttatgcggccaacaatctaaggggattcatgaaggagctcgaagagcgcattcgcctgcagggtaccgtcaagccaggtaatgtgctgaaagtggatgctttcctcaaccaccagtgcgatgtcgaattgttcgaccacatgggtgccgcttgggcggaacattttgccggtaaaaccatcaacaagatcctgaccattgaagcttccggcattggtatcgcctgtgttgccgcgcgtcatttcggcaatgcgcctgtggtgttcgccaagaaggcgcagtccatcaatctcgatggcgaccagtacaccaccaccgtctactccttcaccaagcagaaggaattccccgtcatcgtgtccaagaggtatctcaacgagggcgaccatgtgctgttgcttgatgacttcctggccaacggcaaggctctgaagggcctgatcaatctgtgccatgatgccggagcgacggtcgagggcatcggcatcgcggtggagaagggtttccagggcggcggcgatgagctgcgcgcagcaggatacgacgttgattccctggcaatcgtggagtcgatggatccggaaaccggtaccatcgaattccgctcctgatcatcgcatctcacgggcgcgcatcagaaaccattacaacctgttactcatcacagcatgaatgagagaggattcattgtgagagaagagaagaagaaagacaacacgaacgagaagaagggcgtttcctttgaagcgcttagcagcttggacgcgcctgtttcgttctggaagggcatcccgttcggcctgcagcatgtcatggcgatgttcgtggccaatctggctccgattttcttggtggcttccgccgccaacatgagtgccgagcagtctgccacgattattcaggccggtctgctggtggcaggtctgggcacctgccttcagctgtatggcgtgtggctgatcggctcccgcctgccgatggtcactggcatttccttcacctatgtggctgctgccatgtcgatcgcccagaaccaaggctacggcgcggtcgccggcgcggttgtgcttggtggcctgttggaggttgcgcttggtttgacggccaagtattggcgtcgcttcgtgccgccgatcgtatccgcgattgtggttacgtcgattggtttctcactgctttccgttggtgccaccagtttcggcggcggttccggcgctgaggatttcggaagctggcagaatctcacgctcggtctgatttcgctggtcgcctgcttggcgttccagctgctgatgaagggtactgccaagcagctttccgtgttgttcggcttggttgtcggctatgttgtcgcgattttcatgggcaaggtcgatttctctggtttcgcgaatctgcaggttgtgtccgtgccgcatttcatgccgttccagcttgaattcgatccgggcgcgatcatctccttcgccctgctgtatgtcgtgtcttccgttgaggtgctgggtgataccgctgcgctcaccaaggttggtctcgaccgtcagcctaccgataaggagactgcgggcgccattgcaggcgacggtctcatctcctccgtctccggcctgttcggctgcttgccgttgacgtcgttcgcacagaatatcggtttggtcgccatgaccaaggtcgtcaaccgtaaggtgattctttccggtggtctgattctgatgatagccagcttcgtgcctgccgtggcggaagtgttcaattccctgccgcaggccgtgcttggcggctgcaccatcatgatgttcggcaacatcatcctgtctggcttccagatgatttccgaggccggctatacgcagcgcaacatcaccattgcggcgttgagtctcaccatcggtatcggcttcacgcaggtcggcgacattttcgtcaacttcccgccgctgttccagtccatcttcgcatccaattgcatcgccgtggcgttcgttgtggccgtgctgttgaatgccctgctgccgagtgaagagcattttctgtcggctccgcagcatcaggaagactgagtccgttcagatcctaaaaggttatgaggaatccccctgctcaaacgagtcagggggattcctcatattcatcgcaaaactgctttgccgcgattcgcaagaaggatgtttcagtgtccttgcttgatccagttcgcaatcgcatccttgacagcctgggcgtacagcgtattggacatgccagggtgaataccatctccggcaagctcatcaggatacgccgaaatcgtagcgtcccagtcaacgagaacaacgttgtcggaatgggcggccgcgaagttgctcaacgcgtcgttcgttccggggacccaagacacgggggcatgcgcattaatcagcacaagcacatgatccggtccaatgtcgttcagtatgtcattgagttggccatcggtcaccgctgaattcgtagccaagccgaccagcacccattggcgcaatccttccggctggcttttggcttggtctataagtcccaatgccttggtcatcgagcgtgaggtttccgcatcaacagtgattccgggaaaaacggattgcaaacctttactggaggcaagcatcaccgagtcaccgaatgcgaccatctgctgtccgtcaggcatggtgtatgcgggtttcttgggcgctggcggatgcttcctatcgaagtcgagatgcatgccctgctgctctttcagcattttcgcattctcttccaacgcgcgttccacactggtctgctttggtgcgttggctaccgcgtatccagacatcaagcatgtactcaataccacggcgatcgtaatccagcatctggttacatcccacattccgttttctggcagcgggcgaatcatggcgataaatccgccacgggcgacgggctgttctaccaacttccacgacatggcggtacaacatgcggtaagagcgagtgtgattagcagcatccatcccagatgccgagcaccccactgggggaacatcgccttggtgaacaaccataaaggccaatgccacaggtaaatgccgtatgaatatcggccggccacatcaaatggtttgaacaccagcagatcctgcatccaagatccgaaaggaatggaaccggcgaccagaaccactgaaagtagcgaagccgcgaaaatccctccatagaaggcagcaggaccctgctcaacgtgctgcatcatccataacagaatcagtaatgccacaaaagccgccgcagggccgatcttgctccagaccagacgagcgcgttccatgatcgccgtttcttccggacgaccgttgccacgccgtatgatcatcagcagccatgccagcatggcacctagccaaagtcccatggcatgtgtgtccgaaccgaaatacactctggttggatcggttcccgggtgatactgcaatcccatggaaagcgcactgcacacggcaagtccggcaagtaccgccaccggcacccaacgtaccagaatttttcgaagcaggtagatcagcaaaggagccaacagatagaactgtatcagcaccgacatgaaccacagatgacggaacatgtctggattcatctgcgagaaatagctggcgccactgccgatggcataccagttgtaacaacccagcatagccgtcactatctggttgttaatgtccaccaacatgtcttggttgatgaaccatgccaacgatacggtgacgggaatcatcagaatcagcgccgggtatattctgcgcagacgcttgaggtagtattccttgaaacctattcccttgccggaatcaatatgattcagcaacgacgagaaaatcagaaaacctgaaatggtgaagaatatgtcaacgcctaggaatccgccccgcagagtgccctggtcgcagtgatacaacactatcgcgatcaaggcgatgcccttgaggccattcagaccgacaaaacgacgtcttaccacaacaatcaaccgcttctctcaacatgcgacgtatgcgcgttaggcacaacgtttcgtatcgtactaccagcccctcccccattatgcggatcatgaacagatatggaaaggtgttgtctgggacgattggaaacgttcggcgatcgaaaccttaaaagcggtgaaacataaggattattcgaaaaagaaaggaccgtacgtcccattggcattggatttgattccaatggaacgtatggtcctcttcatacggtcccgtcaatcatttgactgcgggatctccttgctcacttggagaagacgttgccgtaagtgtcttcgcctgcttctgcgattgccgcggacttgcgggcgattgccagctcctcgttggtcggaatgacgcagatggtgatcttggaatccggggtggagatgatgcgcggttccttggaacgggtggcgttcttctcttcgtccagcttgacgccgaacggggcgagcttgtcgcacaccatcttgcggaccacgtcatcgttctcgccgacgcctgcggtgaaggtgatcacgtctacgccgcccatctgagcggtgtagttgccgatgtagccgacgatgcggtgcacgtagacgtcgagagccagcttggcgtcctcgttgccttcggcgaccagacggtgaacctcacggaggtcgccgaagccggtcatgcccatcatgccggaacgcttgttgaacagagcgtcgagctcgtccacgttcatgtgggcgttgcggatcaggtggaagacgacggccggatcgatatcgccggtacggccacccatcatgaggccttcgagcggagtcaggcccatggaggtctcgaccggcttgccggaaacttcggcggaggcggaagcgccgttgccgatatgcagcacgatctgcttgaggccttcagccggcttaccgatgacgctcggcaccacggaagagatgaactcgtgggaggtgccgtgggcgccgtaacggcggatgtggtactggtcggcgatttccttgttcagcgcgtaggtgcttgcggccttcggcagctggaagaagaaggaggaatcgaacacgaagatctgcgggacgtccggcaggagcgcgcgcatgacttcagcacccttggcttccggaccgttgtgcagcggcgcgagcacggcgaggtccttgacctggttgatggtcttgtcggtgaccagagccgggttcgggaagatggaaccaccctgcaccacgcggtgaccaacagccacgatgccggcctcgtccagcttcggaccgaactcgttgaagaagccgagcacgcgcttcagaccctgctcgtggtcgtggatcggctcttccagctcatgcttctcgccgttgaactcgtgcttgtagtggccgtcaaccggctcgccgatcttctcgaccaggccggaagcaataccttcaccggtttcaagatcaaccagctgatacttgatagagctggaaccggaattgatgacaaggacggttttcgccattgtgggcatcctccatgtgttaatcgatgtgccgcttgcgcgactttccaaactttagattactctttgcttgctacaaaatagcgttttactgggcttcgatggcggtcagggcaaccgtgttgatgatgtcctgcacggttgcgcctcggctcaggtcgttgaccggtcggttcagtccctgcagcaccggaccgacggccactgcgccggaggaacgctggacggccttgtacccgatgttgcccgcgcacagatccgggaacacgaacacattgacatggcccgccacatcgttgcccttggccttggtggctgcaacggtcggcgaccaagccgcgtcgaactggatgggaccgacgaccgcgaggtccggagccttctccttcacgagtgcggttgcttcctccacgagatcaacgtccggtcccttgccggatcccagcgtggagtacgacagcatgccgaccttcggatcgaggccgaacgcctttgccgtttcggcggactggatggcgatttccgcaagctgctcagcggacgggttcaggttgatggcgcaatcggagaacactgcgacatggtccttgaagcacatgaggaacgcgccggacacgagggaagttcccggcttggtcttaatgacctgcagggccgggcgtacggtgttggccgtggagttgatggatccggaaaccagaccgtcagccttgccgagcaccacaagcatggtgccgaaatagctgtcgtcggtgagctgcttgcgagcctgttcttcggtcatgcccttcttggcgcgcagttcgcacagcttggcggccatcggagcgagcacttcctcgtcgtccttggcctggaactgcgccttttcgagggatttgagaccaagctcctcgccgcgggcgagaatgccttccctgtctccgacgatgatcagatcgacgatgtcgcgctcaagcaggtagtcggcggccttgatgatgcggtcttcggatccttccggaagcacgatggttttcttgtccgccttggccttgcccagcagactgtactggaatgcgtatggcgtggtcggcgcctcgaatggagcctcaacagcggagataagctcttcggcgttgacattcgcctcgaatgcctccgtggccttggtcacggcgtcttcctcgtcaaaatcaacggcgggtaacgtccacaccggcacctcgtaagctgcgaactcctccttgagaggttccacctgttcgtctttgcatccggtgatgaacacgccggcgaccttgctgcctgcattctcgatgatggtcttcgacgcctcgacagtgcccaggacctgttccggagtgcggttgatggtgcatacggcaagaagcacgacagacttgagatcagcggctacgtcagcattgaacgcaaagatggacgggtcgttgatggcggatttgtccgttccgacaacaaccacggcttcgggctgggcggtttcgatggcttccgtgtaggcggccacgatatcggcccgggaaccttccttgtcggtgcgtgcacgcttcgggcaaacaccgacggattgttcacggctcagccccgagttgcttgcttcaagaagaacgtcggtgaaggtttccttgcgacaaaccgccggacggaacacggccgtcttcttggcagctgcgaatgccttggtgacgccaagggccacgacgttgcggccgtttgctgcttcagggctgataatggtgacgctggttagactcacgatgtctgctcctattcgttgtttttaaggtgtgtgactgcgctgtttcgcaccatgtgccattgtaatgcgtgaacggtaacagacacgcatttcatgacatggtgtcacaacgcattacaaagttacggatatggcaaaagccccaagggaaaatcccttggggctttgttcaagcaatcagcctatagaggctagactcactcgttatcgccagcggttgcggcggtagcggagacagcaccctgcttggtggtgttgacgccagagtagacccaatcggtgtaatccgggtgatcgtagccgttgtcgactgcgaactggaaggcttcctgacggaaggcttcgagctcgttgatcttgtcggcgtacttgtcagcatcgatcatgcgcagagcttcggcaacgagctcgtagcggtcgatgttgttcacgcgaaccatgtcgtacggggtggtggtggagccctgctcctcgtagccgtggacgttgaagttgtcgtggttcgggcgatcgtagatcagaccacgcacgtcgcgagcgtaggagtggtaagcgaacaggaccggcttgtcttcggtgaacaggtcagcgaagtcagcgtcggagatagcctgatcgttctccttggtggactgcagcttgaccagatccacaacgttgacgaccttgaacttgatgccgagctcgttgagcttgtcggcagcagccatgatctcctgagccggaacgtcgccagcggaggcgagcacgatctgggcttcgtcgttggacttggcggtggaagcccactcccactcggcagcgcccttctcgagctcagcgcgagcttcgtccagggtcagccaagtagcggccggctgcttaccagcaatgatcgcgttgatcatgttggtggacttgtagcacttctcagccacagcgagcagcatgttggaatccaccgggaagtagatgccgatcacgtgatcgttgttgaagcacttgttcagcaggacggaggtgacacccggatcctggtgggagaagccgttgtgatcctgacgccacacgtgggaggagacgagcaggttcatggaggagatcggcttgcgccacgggatctcgcggacggtagcctcgagccacttggcgtgctggttcagcatggagtcgatcacgtgcacgaaggactcataggagctccagatgccgtgacggccggtgagcaggtaggcctcgaggaagccttccatctggtgctcggagagctgctcagtgacctggccggtgacagccatgtgctcgtcaacctgggaggacaggtagccggcgtcccactgcttgttggtgacgtcgtaagcggcctgcagacggttggaagcggtctcgtccggtccgaagatgcggaaggagtccgggttgttcttgatgatgtcgcgagtgtagacgcccagacgacgggtggcttcgagctggccccagccgtggccgtactcggcgacttccttgacctcgtagtcttcgagggccggcaggttcagctcttcgcggatcacgccaccgttggcattcgggttggcaccgatgcgcagttcgccggtcggcatgaaggcggtgacttccggcttcacggcaccgttctcgtcgaacagttcttccggcttgtaggactcgagccagttcttgaggacttcgaagtgagcctcggtatcgcgggcggaagccagcgggacctggtgggaacgccaggagccttcggtcttcttgccgtcgatgaacttcgggcaggtccagcccttcggggtgcggaagatgatcatcgggtagaacggacgagtcatgtcgtcggtctgggctgcggccttgatgtcgcagatctcgtcgaagacggtctcgaacagctcggcgaaacgacggtggatcgacaggtgatcctcgttgtcgaagccagcgacgaactcgtacggctcatagcccatgccgtggaagaactcgtggagctcttcgtcggagatgcgggacaggatggtcgggttggcgatcttgtagccgttgaggtgcaggatcggcagcacgataccgtcggtgcgcgggttgacgagcttgttggactgccagccggtggccagcgggccggtctcagcttcgccgtcgccgacgatggccggaacgaacaggctcgggttgttcatcacagcaccgtaggcgtgagacagggcgtaacccagctcgccaccttcgtggatggagcccggagtctccggagcgtagtgggacggaatgccgcccgggtaggagaactggcggaagaacttctgcagaccagcttcgtccttggtgatcttcgggaaggtctcagtgtaggtgccatccaggtaggactgagcggtaccagccgggccgccgtggcctgggcccatgatgatcacagtgttctgctggtgatcagcgatgagacggttgatgtggccgatgaggaagttcaggcccggggtggtgccccagtgaccgaccagacggtgcttgacgtcttcgcgggtgaaaggctccttcatcagcgggttgctacgcagatagatctggccgatggagaggtagttggctgcacgccagtacttatccacgccttcgatagcttcctcggaaaccggagcgttcagcttcttccaaggggtgccaataacaggactcgtcatgtgtactcctgtactcctgcactgtgttgtgcgattgtttattttcattcggtcctgaatcttgcaaaaccttgcggttccgcggaacgattcattcccaatcacttgagcatattacgagcgaggtgcgactttttgctgtttttttgcgactgtgtgcgcaagtgtgtcgtttctgttagaaaatgagagcttttatcgggagatttgtgaatacttcacatgctatcaaaaagattgataaacggctcaatatcaacgatttcaagccatcctcacacctttttcacgttcgttttgcaatacttgcatgcggcgtgttgaaccatgcatagtaagcaattgtgaggtttgttcactttctgttcacagcgtttccaatgtctgctcgcgtcgccacaatagaacagttaatattgttgcttcttcatacctcatattaaaagggagagtgttatggctgcaggtcctgtgctcgttgttgatttcggagcccagtacgcccagctgatcgcacgtcgcgtgcgtgaagccaatgtttattcggagcttgtgccgcattccatgccggtcgacgagatgctggccaaggatccgcaggccatcatcctttccggtggtccggcttcggtgttcgagcctggcgcgccgcgtgtggacaagaaactgttcgaggccggcgttcccgtactgggcatctgctacggcttccaggccatggcctatgccttgggcgcgaatgtcgacaaggccgcccttggcgaatatggcaagaccgagaccttcatcgacaagtcggaaggtctgctcgacggctcccccgccgatcagaacacgtggatgagccatggcgtggccgtcaagaccgcgccggagggctttgaagtgctggcgcataccgagggcgcgcccgttgccgccatgcaggacgaatcccgcaaactgtacggcgtgcagtggcatcctgaagtcaagcacaccccgatgggccagcagctcatcgagaccttcctgcacaagtgcgcggggctcggcaacaactgggatgcctccagcatcatcgaggatcaggtcgcgaagatccgcgagaaggtcggcgacgcacaggtgatttgcggcctgtccggcggcgttgattccgcagtcgcggcggctctcgtgcacaaggccatcggcgatcagctcacctgcgtgttcgtggaccacggtctgctgcgcaagggcgaggccgagcaggtcaagcatgatttcgtcgaggcgaccggcatcaagctcattgccgtggacgcctccgaagacttcctcaccgctctgaagggtgtgagcgagccggagaagaagcgcaagatcatcggcgaaaagttcattcgcacgttcgagaaggctcagcgccaggtcatcgaagaggcgggtgcttccggcaaggaagtcaagttcctcgttcagggcaccctctacccggatgttgtggaatccggcggtggcgacggcgcagccaacatcaagtcgcaccacaatgtgggtggcctgccggacgacatcaagttccagctcgtcgagccactgcgtaccttgttcaaggatgaggttcgtgccatcggtaccgagcttggattgccggacgaaatcgtctggcgtcagccgttccctggcccgggtctcggcatccgcatcatcggcgaaatcaccaagaagcgtctggatctgcttcgcgaggccgacgccatcgctcgcgaggagctttccaaggctggtcttgaccgcgatatctggcagtgcccggtcgtgctccttgccgatgtgcattccgtgggtgtgcagggcgacgagcgcacgtatggttcgccaatcgtgttgcgtccggtttcctccgaagacgccatgaccgcagactggtctcgcattccgtacgatgtgcttgccacgatttcgacgcgcatcaccaatgaatgccgtcagatcaaccgtgtggtgctcgactgcacctccaagccgccggcaaccatcgagtgggagtagttccccttggtttagatgtgccgaaaaacccagtatttatgcgggtttcgggacttggtacttttcgggcaaccgattttgcaacagatgaaatagtcccccttggcttgcaactaaacctaaaaatcgcaaatttttaaggcttttgccctgttttgggcagaagcctttttgcatatttgataaaattttctctttaatatatcatcaaatcagataaaacagcgaggtggatagtatgaaaacagaaaaaataccatatatatttaagtacaaaagaaagaaacgaaattgttgctttccttataaatctaaaaaaacaaattgattgaacaaggcagatacaccgacgccgtcgatgatgttctctgcaaagtgctttctgccaagaaaagaaagcttaaaatcaaataatcttgccacgacataagaccgcctacacgatgtaagcggtcttatgttttagttcgataaactggaatttctatttgtgttgccatgtcattacataatctttttctccggtagcctcatctaagccactatgctgaatctcaaatccttctctcttataaaaagatattgcccgtgcgttcttttggtatacgttcaagtgcaacttattccttttatcctttgcataattcagcagaattttacctataccctgcgattgcatttcaccagaaacaaaaatgccctcaacatattcatcatttaaccctataaaaccctgtatttctgtatcatactcatacacataaacctctgctagtaacagcgcttcttttactgatttgaaattgcttttccagtattcggcggggataaaattatgtgcctttatatttgtatccaaccatatatctgcaactttatttatatcatcccttttaaattctctaatcataacggtgactctccataaacttgaatttaaattataacggtctttgcaaatacaccatatctaccaactgtattccactctcatagattgggtggtcataattatctataaagaaatttgatatgatatgcgaacggacaaaaccacacttttcataaaatggtattgtcagtgggctatcgcctgttcccacttgcagaatggcatattgctctctgtaattattaacaataaactcaattaaggctcttgcataacctttcccttgatattctggaaccgtcgcaatgttcttgatttcaagtatgtcattttctttatcggttatgacacactcacacttgaccccattatcatcaagtacatacatcttgccgttatcaagataacggtcaaccatatcttcctgctcatctgctaataggagcaaatcaagatattgttttttattttctttaacttcaataattttcatcaatcgcacctacaaattctgatttatcaatctttaatatcacatattatacatcataaatatgaaaatttctacccgccatctgttgacctcaaatttaaaacaggcggctttttttattttcaaaaaaagttgaaaaatttttgctcagagggggcgcaaaatgcctctcccagttcaaacaagtgagtgggagtgattccaagctgattcgttactgaacgcaaaatcgcaatcaatatgatgaagcccccgaaagtgcgaaacttccggggcttcatcatgctttccgccttctaggctcgagccagataacacctctcaaggtgtcggacgcctcgtcgctgcttacctctttacgtacggtgtcaggtttccattggttccgtgtttttcgtaggcattatgacgtttgcgagcgccactacctttgccatgttggggccggacaaggccaagccgtgtcaggaaagctaagaaccatcgtggcttgacatagcggcatccgcagaatgattacgatcctgtgcaaacgtagaatgtccttcctccgtttttgcggaggaaggacattttcataccgttttcaatattatttgcggattatcctggacaatcattgctaggccagcatgctggtccacatgtttgcgaaatcaggaagcgttttcgcagtggtggcgatgttcttgattagaatgccgttgattttcagccccagcatcgcagcgaacgtcgccatgcgatggtccgcataggtttccatttcagccggcctgagattcgttgccggcactggcacgatctccagaccgtcggccagctcacgggcttctcccccgactctggtgatttcgttgaccaatgcttccagacggttcgtctcgtggccgcgcaagtggccgatgcccagcatgcgcgtaggcttgtcggcgaagaccaggattgcggccagcgatggcgcaatctcgccggccgcagtcaggtcgaaatcacccaagccgttgatatggctgctgccggtcacttcgcagtaccggacgccgtcaatcaccggaaagctgatttcggctcccatacgttccaaatatcccggaagcaggcctccgggttgcgtggtggattccggccaatggggcacgcgcacggctcctccggcgatgagcgctgcgccaaggaacggggcggcattcgacaggtcaggttctaccgtcaccgtttcgggcaactgcacggctcccggctgcacggtccacacgcgggcgtgttcgtcggcgttggcgcgcacaccggaaccttgcagatcggccacggtcatgcgaatatgcggtaaactcggtgtcttctcccccgtgtgatgcagttccaaaccgcctggcactcgagagccgatgagcaatagtcctgaaatgaactgcgaggatcccgaagaatcaatgctgactacgctcggctcggcgcgctggctcaccgtttgaggtggagtgattgtaaatggcaggcgcccttcctcgccgtggtattcgatacatgcccccaactgttcaagaccgtccaacacgggcttcatcggacgcgcgtacgcctgctcgtcaccgtcgaaatccacaggaccatccgcgaacatggcaagaccgggcacaaagcgcatcactgttcccgcaagaccgcagaacaccttcgtaccaccgtggaaccggccgtcggacggcggcgccaccgtaaccgtggtgtcgacctgctcatcgatttcgcagcgcactcccaacgcgcgcaatgcgtccatcatcagctcggtgtcgcgcgagcgcaacagaccgaccaatcgcacaggacgatgcccgagagccgcaagaatgagatatcggttcgacagggatttgctgcccggcaccacaacggtggcgtcaagcgacttgctggcaaacggcgccggccaaagattctcttgagatgcgttcatagggcttatcgtatccaaaacccgtggaaaacaacgtttcaatctcgccatacagcacccgtatcttgctcgatctcgacaatcaaatgccatccataccatttccgtttgaaaacccaggcggacagaactatgcgaatatcacaaaatgccacgaggaattcccgcgatcgtcgtgtttgtaccggaaaccggggaaaggatttttcaaaccgtctgaaacacctttgtttccaacggttttggtcgggctgacaggatttgaacctgcgacattctgctatattcgggcatggcataagcgcaaccttgccaaggttgagaccgcgggttcgagtcccgttgtccgctccaccaagccccacctcgtgtgggttttctttttctcacacatctactccactcgcgtttttttttaaaaaaaaactgccgacacgcggaactttgcacagtccggcgtcgacagcctatctacatgttttacgcttcttcgccgtgccaggcgtagtcgaggtgcatgaattcggggaccttgtaccatttgaccggatatccggcgccatgcgcgcagaacaccgaatccggcgtgttctccaagtcggattccgggtcgtacgcggcctgttcaatcacctcatcgacgttgtggcatggccggtaccctgcgaatacgcaactcaaatgcccacgcccatgcgtgtaggcgttgacgtccatcgcatagtcacgcatttgcgcaaccggcgcctcaccttcaagcaccatgtattcgccgtcaccgtcaggcgtgtcgaacgagccgctcatacgctgaatatcggccatcgcatggccgaccatatcttgcggaacctccaaccggaagccataccatggctccagcaaacggcaatcgccgcgctccttcgcttccatcaacccctgacgaatcgcacgatacgtggcttgacggaaatcgccgccttccgtatgtttcaaatgcgcacggccaaccagcaacgtgatcttcatatcggtgattggagagccggtaagcacgcccacatgctcacgctcctgacaatgctgcagaatcagccgctgccagttgcggtcgagcacatcctcgctgcacacgctcgcatatgccatgccactgccggcaggcaacggctcaagcagcacatgcgtttccgcatagtgacgcaacggctcaaaatgccccacgccctcgatcggatgcgcaatcgtctccttatataggatgccgcccggaccgaacgaaacatccaagccaaaccggtcatgcatcatctgctggatgacttccaattgcaccgcacccatcaattgcagatgcacttcgccaagatgcggctgccataccacatgcagcaacggatcctcatcctcaagctcacgcaacgcgaccaggcaggcatgaatatcgcactcccccggcagcaacgtgtacgtgagcaccggctgaagcaccggatttacgccgtcaggctccttcccaagcccggcactgggaaatgttcgcgtcaagcccgtaacggcgcacacggtgcccgcaacaaccgaatcgaccgtactgaacttcgcgcctgaatacacgcgcacctgatcggccttctcatgccacaggccatcatcaccgattttcgactcgccaggatcggaaccaacccgcgcagtgccggaaagcattgttttcgctttgaattcgccgcccgtcaccttaagccaagtcagtcgattgccttgcgagtcgtgcgatactttatatatacgcgcgccgaattcgccgccatactccggctcgcgcacataccattcgaatcctgcgatgaattcgtcgatgccctccattttcagcgcggaaccgaagaaacacgggaacagggcacgttcggcaatcagttcgcgaatggtttcgtccggaatcgtcccttcttccaaatacgattccatggcggtttcgctttgcatggcgatgtcttccatgacatcggcaagcgcctcggttccgttgtgcgatccggtaaaatctacgcatccgtcagagaaacgtttcttcagctgctgcagaagtttcgttttatcggctgcgggagcgtccattttgttgatgaagatgaatgtgggcacgttatagcgcttcagcaatcgccataacgtttcggtatgcccttggattccgtccgcgccggaaatgaccaggatcgcatagtcgagcacggcgagggtacgttccatttccgccgaaaaatcgacgtgccccggcgtatcaagcaacgtgagggtgagatccggcgtggtgatgatcgccggttcggtgaagatggtgatgccgcgctgccgttccatcgtattggtgtcaagaaacgcgtctccatgatcgacgcgaccgagcttgcgtacgctgcccgtggcatacagcaacgcttccgacagcgtggttttgcctgcgtcaacatgcgccagaatgccgatgacgattcgtttcatgggttcctcccgctgcccaagcgacagccgaagcagccgcctatcgatatacgaaagcccttacgcctactgacgtaagggcttgatggtgaccccggggagactcgaactcccgaccttgagattagaagtcacatgctctatccagctgagctacagggccaaacttgaatcagtatagccagttcgcacgttcttgccaactcgaacgcgctgagcagcgatcataccgacggcaaaaccatggaaccaacggctccccgatcccaaacaagcaagtcatcaagaccggggagcatgggttcacggctcgataatccagctcaaaccgaccagcacgataaggaacagcacattcaccgccgaatagacggccagatagcgccccttcttatcggggtacttacgcgtcacgttcttgtatccgatcagcgaggccatggatgcgatcagcgtacccatgccaccaaggttggtgccaataatcagtgcacgccactggtcgcagaagcccgacagcagcaacgtggtcggcacgttggaaatgaactggctggacaccacggacacttccagcggatgcgcccccaccaaggaggcggccagctcgtagaattccggcacgcgtttcatattgccgatgaaaatgaagaacatgcagaacgtgagcggcaatccccagtcgatattgcggaacacgcggcgatcgcagaacaggaacgccaccaccacgatcacgcacatggcccatagcggaatgaaatcgctcacagccagcaaacacatgatgaacagcgcgcaatatacgatcgtgcgccaaccaccgtaacctgcgccgtagccggtcacacgaatctcatccggctgcggctgatcggaattcggagcgagcacattctgttcgatgccgctgccgtcgatagaggaaaattcggaaacaggtttcttaccgaacaccacacagacgatgaccaccagcaataccgccgcagcaacggaatacggtgccataatgccgatcatttcagcggacggcatgcccgtcaacgctttcaaatacaggttgtgcgcattgccgatcggcgtcaacatactgcccacgttcgcaccgacggtcatcaacgtgccgaccagcaccgcatgctcctccatgtgagccatggtgagcaccgcgatcgcgaatggaatgaacgtgaccagcgccacatcattggtaatcagcatgccggaaaaataggtgagcgaaatcagcgtgatcaccaatccgcgggcggtgctcacatgatgcagcaaccgcgaaccgatgatgcggaacacaccgatgcgctggaaaccgcacaccaccagcatcaggcagatcagctgcgaaatggtgctggcatgaatatatccggcatactccttgtcaggaggcacgataaagcatgaaataagagcaagtatggaagcaactacgagaatggtctcgtttttcaggattttgacgaccaatcgtcgcattcattcctccgtgaatccagtttgcaaaccgtttgcagacccgggcgatttactcaagaaacgccgtattcactttacccgaaaaatcgcgtaccacatacccttggcatactatttttccgaccattccaacgtttttcagcccatgcgccttactgttccctgactttgcaaaccggcaaaactgttttgcaattgcaaaacacgccgacggataccgtgcaccagccaagaattcgttaagtattcttcctgcgttcaccacacgttcgccggctgttcataccgcactcaggcatgtggcaaattcaggtgaacgacaaagacgttcgggggttgacgctccggcacaccaaatattcaggcgacgttattgccgaacaccctcgtctgcagatccttgcgcaacgtttccagcttggtaatctggccaagcagctcgattttctcggcaccgtccggcagttgcgccatgcgacgctggtccgcgccgattttgcgcatgatacccgtgtcaagcagtcgaatgatgagttcagacgcgtatctgcgttcgtcgtcggtcggcttgcgcaattgcacgttgccttcctgcgattgttgcgacgcacgttccgcgtcagtatcgctcggaggaagcggcaatggcatgacggcaagctcgttgatgacggattccaacatcggaccacccgctttagtgagattgtgcatccacaatccttgcggggtatcagcagacggcagtcccccggccgccgcgaccgcttggaataacgtgcggaatacgggggtcatgaagctcgacagcgtaagactggcgaacagtgtcggatcaacggcaagcggcacttgaatcagggttgccatgaactgctgttcgcaaatgaacacggcatcatcaatgcgatagtaggattgctccgccgcatcacgatgttccaacgccttccgcgcggaaggattcgcatacggattcgcgccttgttccatacgcggttccaccgcagctccggcattgcctgcaaaacgacgtttcggagcgtacgcatcttcgtcccgcacctgcagtttgcgtcgtgcgtcacgcacttcacgctgcatgatatccaagtcgacgccgatctggcgcaccgccttgcgtgaatacaaatccaacagggaacggtcacgaatctgtgcgatcaacggcgccaccgccttgactgcgcccatctgcccagtggtataagcggtgtcgaaacgcccgatcgcggttttgatcacgaaatcatacagtggttcggcatgatcgatcaacgcgcgaaccgcctcattacctcgcttgatacgcaaatcgcacgggtcgagattgtcgtcggccacagcaacgaacgcctgcgtcgaaaaagcggaatccaagccgaacgcatgaatcgcagccttctgaccggccgcatcgccatcgaaggtgaacacgatacgcgaactcaacgcctgtccttcaaccttcaacggaccaaccagctgtaccgcacccaacgaatcgtcggcgatcagacgacgcacgatcttggcatgctcggcaccgaacgcggtgccgcatgtcgcgatcgcggtatcaatgccggccaaatgcatggccatcacatccgtatacccttcgacgatcaccgcctgacgtttcttcacaatcgccgacttcgccatatcaatgccatacagcacctggtttttccgatacaactgcgtgtcgggagtattaatgtatttcgcgctaatcgaatcatcctcatacaacttgcgagcgccgaaaccaagcgtgcgtccggttgaatcgcgaatcggccatgttacgcggccacggaaatagtcatacaccccatgctggccttgacgggccaaacctgcgtccaacatttcctgctgtgtgaagcccttgcctgccaagtaccgcaccagattatcccagccttgcggagcatatccgcaaccgaatcgttggcaatcggcctggctgaaattacggccatcaagcagtttgcgcgcggcgagcgcgtctttggtcatcagctgcgagacgaaaaactcctgcgcggcctcgttggcttccaacaggcgggcacgtttcgaaccggtatgctccttcttggcgttcgactggtcataacgcaattcgatatggtatttgtcggccaaaagctcgacggcatcacgaaagtcgacgttctcctgatgctccacatagccgaacacgtctccgccaagaccgcagccgaagcaatgccacacaccgagcgccggacgcacggaaaagcttggcgttttctcgtcatgaaacgggcacagccccacgtatgtgccagttcctgaaggtttgagcgtaaccgttgcagacacaatgtcgtacaaatcggcggtggcgcgaactttttcgatatcttccttcagaatcattcctggcatagctcaccaccttaacagcaagcgcggcacgttgaccaaccatcgaacgtaccgcgcccaccatattgactttcacggcgtgcctcccatcgcacgcctgattctttataggagggttgcgggatcgagtttggcgagatcttcgaccgacagcacgtcagaggcatgctcgtacaggcgcgggatacggttgcacaggcaggtgaagatctcatagctgatggttcctgcggcacggccccaatcgtcggcggtcggctcggcataatcctctccgcgacccggtccgaacagctgcacggtgtcgccctcatgcacgccaagcttttccgcggaaccgtgcaggtcaagcataaactgatccatgcacacgcgaccggacacacggtagaggcgcggaccctccgtggtcatcacacgcaccgggcctcctggcttgaccacatgcttcgcgccttccatatcgaaaccggaagcggaacggtgaatgccgtccgcatagcctacaggcacgattgcggtggacgtgtctgtaggagtcaggtacgtgcggccataggaaatgccatgtcccgcctccacatccttgaccgtgccaagctgcgcctgcaacgtcatggccggcgtcaaaccgtatgtacctggcgtgcccatggccggatcagcctcataaccatacaggccgatacccgggcgcgtcagctcaaaatgaatctcggaacgtgaaagcgtggcagcggtattggcgagatgacgaatctccggcgcaatgcccgcctgctccatacgacgggtgaaatccttgaaattctcgatctgtctgtcggtggatgccacgaattcaggaacgtccggagcgtccgccaccgccaaatggctccactggccgacgatatgcagcacaccctccttggcgagcggcaccagcttggcgagcgccgcgtcgaacgtggcgggcgtgaacccgttgcggccgaaaccggaatcgaccttcacatgcacacgtgcggtttttccaagacgacgcgccgcagccgcaacgccgtcaatgcccggcaatgatccgacggaaatatcgatatcattgtcgatcagctcgtcaaaaggcacagccatgccgttatatacccatgtcagaatgtggcagcggtccggcccgatgcccgccttgcgcagcagcagcgcctcatgtgattgcgccgtgcccagccaggtcgcacctcccgccagtgccgcgagcgcggccggaataagaccatgcccgtacgcgtcggccttgaccacacccatcacggcggtgccggaattcgggccgccaaccacgctcaccagatgacgcatgttgtttcgcaatgcggccatatcgacgatggcctgcgccggatattgcttttgggcggcctcataattggccttgccttgttcggatgagaattgccattcacgggcagcgttgaaagtcatgactctattgttgcgctcccatatgacggcttcgaaaagacgcgcacacatggtgagacgattcacggggttttcacggttttgtccgcgccaggtttttacactctctttacataaggcgcgtatacctcccatacatgaggcgttcagcccttctttgatttctggcgtttgaggcgtgccagagtcccggaaatccgtccggtccagcccatataaaaccacttttagggaattaagaccatggatctttttcgcaaaaagtcagtggaccagctcgtatccgagtcaactccactgaaacgcacattgaaaacgtttgaccttaccatgctgggaatcggcgccatcatcggcaccggcattttcgtgctcaccggcaagggcgccctcaccgcaggtccggcattgtgcgtctccttcctcctggccgcgatctgctgcggtttcgcaggattgtgctatgcagagttcgcagcaatggcaccagtgtccggttccgcatattcgtacgcgtatttggcgttcggcgagctgatcgcatttgtgatcggctgggatttgattttggaatacgcattgcaggcggccaccgtgtccgccggatggtccggttatttcaacaaactgttggaaggtttcggcttgcatctgccagttgagctgaccgcggcatacggcaccacaccaggcgtgaccacatacttcaatctgcctggtttcgtgatcgtgctcatcatcacttgggtgctgtccatcggcatcaaccagacgaagaaaaccaacgatattatggtgatgatcaaactggccatcatcgtgctgttcatcgtgtgcaccgtctggtacatcaatcccgccaattggaagccgttctccccgtacggcatttacacgttccagccgggctcgacgcagccgtacggcatcgtgccggccgcgtcgatcgtgttcttcagcttcatcggctttgacgcggtatcctcttccgccgaggagaccatcaatccgaacaagacactgccgcgcggcattctgatctcgctggccgtgtccaccgtgctctacatcgtcatgacgctgatcatgaccggtgtggtgccatacaaggagttcgcaaacttcattgatgctccggtggccggcgtgattctcgaaaccggtctcaactggctggcgttcgttgtcaatcttggcgctctgatcggcatgaccacggtgatgctggtgcagctgtacggccagtcccgcatctgctacgccatgagccgcgacggcctgttcccgaagttcttcggcgaagtgcacccgaagtaccgcaccccgttcaaaggtacatggttcttcggtattctaacggccatcgccggcggtttcatcaacatcaacgtgctgttcgaattggtgaacatcggtacgctgtcggcattcatcatcgtgtccgcaggcattctgtggatgcgtaagacccagccggacgcacaccgcggcttccgcgctccgggcgtaccgttcacgccgatctgcgcaatcattttctgcttcattctgatttgcggtttgaattgggagacttgggtgcgtttcgcaatctggttcgcccttggtttgattgtgtatttcgtgtacagccgcaagcattccgcattgaacgagccaggactgttctaaaaaccggcaatactgttgtttttgatatatctttcgtaagatatatcaaaaacaacgcaatcggatataaaaatcccgttgaacatctgaaatacgatattcaacgggatttttgtttctcaatatcgaagattatttgcgattatttgtgatgaaatttatattgattgatatcaatccatataaatccgcaaatctcaccattcatgccgttgataagcgatacgcgtggtgtcggacggcctgtcaagcaactgaatcaagccgcagcgcgcgaaaccattcgattcgagcacatgctgcatggccttgttgttgggatgcgtatccgcgcgcacattgccgtaatgttcgatgcaccagttgatgcagtccttcgccgcacccttggcgagacccgacgaggcgatccggtggatggtcacatacggatcgtcatccagccaggcaccatcgatattcacatacgtcgggtcgatgcccggacacaatgcgaactgggcgagcacacgttcctcgccatcaaccgtatcgacaagcaacacggtgcgttgcgattcgacatcgtcacgaaccacttcctcacgagggaacttatcaccccactgcgtgggattgccattggaggccatcaacttgcgggcatgctcataaatcttcagcatggtcggcaaatcagccatagtggcgcgacggaaccgccgttcagaggtaatgacgctctcctcacccatctcgttcacctttgcatcaccttgtcttcttccgagcgtcaaaaataccatgcccacggcacagtattcgcaatatgcccgaaaaaagacgtgcaatcgcacgcaaatcagaccagacggcgctcaaacgcgtcagagctgatgcccttggcgagaatatccttgcaccattccttcgccgtgaacaggctatggtcgcggtaattgccgcagctttcgatggtggtggcaggaacgtcatcccatgtggcctcgtatgcgatgaattccaacgcctccttcaacgcgcgagccacttcttccgtggaatgctcgccccatgtcagcaggtggaaaccggtacggcagccgaacggggaacaatcgatataaccgtcgatacgttcacgcaacagcaccgcaatcgtatgttcgatggtgtgcaggccaccggtcggaatcgcattctcattcggctgcaccaaacgcaaatcataattggaaatcacatcgccattcggaccggtctgcgtgtcgatataacgcacatacggagccttcaccttggtgtggtcgagctggaagctttccacaaccggcttgtcttctgccatcatcaatcctttcttcaacaactgttcgtctctactgtcgccgttttgccggcatacatcaacctcaccgccatacatgttgccgataacgtgttacgtatcatataaaacatatggttttgcaataatcgatacgcttattcctcaagctgacacgtcacctgattcatgcaacgaaatcgcggatcacttccatgaaccgttcgccatacgcttccaatttgagcgcaccaacgccattgacttgcgagaattgctcgccggtgaccggcctgatacgcaccatatcgcgcagcgttttatcggaaaagacgatatacgggggtttaccgagttcgcgggcgatgtcaagccgcaacgcacgcagtttggcgaacaattcctcgtctccgtcgcccggcacatacgatcccatagtctgagagcctgcggacggcgattctgcacgtttcgcagcgtgcttccgttcgatcttcttgatttcataatgaaaattcggcgcgaccgtttccgccgcacgttcaccgaagcgaacgatcggcatggaaccttccgaaatggaaagaaaaccatccgtcgccatctggctgagcacgtcacgaatctgcgcctccgaagtcgcgctcaacatgccgtacgtcggcagatcggcaggatgaagatagttcaaatcctgcgctttcgatcctcgcagcactttgacgatcttccccgaaccgaccttctggttcacgtcatgcacgcagcggctgatggcccgcgcgatatccgtgacgtcaacggtttcaaacgtgttcccgcagttcgcgcatcctcccacgcatgtgccgtcatcacggacggccgctcccccggcctcaccgaaatacctggtcatatactcgtgcagacaatccgtggtacggcaataaccgatcatggcgttgagcagacgccgtttcgacgcacgcacgacctcctgctcttcggcggtcaaacgctcgttctcataatccgaatcaagcagccttcgcctcgtagcaatatcagattcgttccacagcaacgtgcaccggctcggctcgccgtcgcgccccgcacgaccggcctcctgatagtacgcttcgatcgattccggcatattatggtggatcacataacgcacgttcgacttgtcgatgcccatgccgaacgcattcgtggcaaccaccacaggcacacggtcggttacgaaatcacgttgtgcccgttccctcgtttcggccgacataccgccatgataggcgactgcgaccatgccaagtcgcgtcgcatcctcacctttcgctgcacgcagctcgcacacggcgatattcaacgattcggcaagcgactccacttccttgcgggtcgcgcaatacacgatgccggattcgtcaggatgatccgcaatatatgaagccacccacgaagccttatatttcctttccatcctgatcacatcgaaatacaggttggccctgtcgaagccggtgacggtgacggacggatcgcgcaatccgagaattccgataatatcgcgacgcacccgttccgtcgcggtcgcagtgaatgcggcaaccgtcggacgggtcggcaatgccttcagaaaatcgccgataccaagatatgacgaacggaaatcctgaccccattgcgacacgcaatgcgcttcgtcaacggcgaccagagaaatcggcacacgactggcgaacgtgcggaaacgttcggtttccaaacgttccggagccacatacagcagtctgatccgtcccgacaacgcctgtgcgaacaccagatcctgttcgtcgggactttgcgtggtattgatgaacgcggctggaatgcccacgtcgttgagcgcgtcgacctgatcgcgcatcaacgagatcaacggggaaatgacgatggtcatgcccggaagaagcgtggcgggaatctggtagcagatcgacttgccagcaccggtgggcatgacgccgagcgcatcacggccttggataatcgcattgactatgccttcttgaccaggacggaaggcgtcatatccgaagtaggtgcgtagggcgtcacgcgccgacgtaaactctgtcatacgcagcagtctagtatcaaaccgcttctactcggtgcggagggcggtggcgttaccgaccggcagcacggcggcaccaaccataatctgcacggaagtgtaagaatcaagcgcaccggtcggttcatcggcgagcacgatgtccggatcgttcacatggtaaaaccctcaccatcacctgagtgggaaaggaaaagatacgcttccagctcattcgatggcgaggatttatacatgtcgcaacaatgtgacagattacacaaaattgtcacattctcatgatggctttatcacaagctgatttttgttagatctggcgaaaagcctgttccaaatccgcgatcaaatcgtcagcatcttcaagaccgacggaaagtcgcacaagattggcgggcacttccagcgtggtaccggcgacggaagcatgggtcatggcacccggatgctcaatcagggattccacgccgcccaacgactcggccagggtaaacacttccgtggcaccggcaaacttctttgccgcttcgaatccggctgcgatctgcacggagatcatgcctccgaatccgccatgcatctgtcgtgcggcaatctcgtggcctggatgggattccagtcccgggtaccatacgcgttccacttcagggcgggtttccaaccattgcgccaccttcatggcgttacgactgtgctgcttgacgcgcagatccaacgttttaaggccacgaatgtcaagccaggagtcgaacggagatggcacagctccggccgcgttctgcaggaacgccacttcatcgcggatttccctgtcgttgagcaccaccgctccgccgaccacgtcggaatggccgccgatgtatttggtggtggaatatacgaccacgtcggcgccatccgacaacggatgctgcaataccggggatgcgaaggtgttgtccaccaccactttggtgccatgcgcatgagcgaccgctgacgtggccgcgatatcagtgatgttgagcagcggattcgacggggtttccacccaaatgtaccggtactgcttctggctgagcgccacggaaacggccgccgtgtcggtgatgtccaccacgtcaagaccgacgccccacggcacgaacaccttggaaagcaaacggtaggtgccaccatatacgtcattgcccagcagaatattgtcgcccggcttgagggtggcacgcaacagcacgtcgatggcggccagtccggaagcgaaactcagcgcgtagttcgcgccttcgaccgcggcgagctgctcgtcgaaagagttgcgggtcggattgatggaacggctgtaatcataaccgttgcgcaggccgccgacaccatcctgcttgaacgtggatgtcatataaataggagtgaccacggctccggtggtcggatcgggctcctgacctgcgtgaatggcgcgggtggcgagtgcagtggcgttcagggcttcggtgttggtcgagatggtcatgatgggaactccttgaaaatatcgaatggtttgggttgaacgaatgatgggcatgatgttgagatatgaattggcggtttacagatactgttccgcaagacttggcttggacgtgtgttccacaacgtcggcgaatccgttggcacgcatccaatcgtcgttgaagatcttttccatatagctgcgaccggaatccggcagcaacaccacgaccagctggtcttcgtccaaatcgtgctcgcgtgcgtatttaagcgctgccgtaacggccatgccggacgagcctccgaccagcagaccttcttccgcagccaaacggcgggtcatttcgaatgcttcggcatcgttgacctgcacgatttcgtcgggaagttcacggtcgaacgctttcggatagaaatcctcgcccacgccttcgatgctgtactgatgcacgtcgttcggattggaatagatggatccttccgggtcggcgccgatcacttgtactgcgccgtcggaagcttccttcaggtagcgtccggtgccggaaatggtgccgccagtgccgatgccagccacgaaatgcgtgacctgatggtcgctggcttcccagatttccggaccggtggtgcggtagtggctttccggtccgttcgggttgtcgtattggttcgggcggtatccgccgggaatcgctttggcgaggcgttccgccacctggtagtaggagcgcggatcatccggaccagcatcggtaggggttaccaccacttctgcaccgtatgcgcggagtaccgcacgcttggcttcggaaaccttgtctggcagggtgaagatggtgcggtatccgcgctgctgggccacgagggcaagtcctacgccggtgttgccggaggtcggttccacaatcacaccgcccggcttgagttcgccgctgcgttcggccgcgtcgatgatgcgttccgcaatgcggtctttggaggagccgccaggattgaaatattcgactttgactgcgatggtggctttgatgccgtcggtcacatggttgagtttgacgagcggagtgttgccgatgagctcggaaagggagttgtggatggtcatgtcgtttccttgcgaagagtgatttccgttggcttccgatgaatgatttcgttgttttgatttcgagaagctcgcgtttatcacttgcaatgatttgaaacgggacctgtgatggtgttttcgctgcggttcatccacatatgccgcgtaataccaaccacgtaaggcactggttatggggtgatttctgcgatactctggcatgcaacgcaagttgcgtatgccgaaaaagaatgccctgtctcaagttatgcttcgatgaaccacgcgcccctcgggcggttggtcagcgacagcaacaacaagagaaattgaacatggctcacacaatagcacacgtaacgacatcggcgtgtcttacctgttcatatagcggcaaaaaagcctgcaatcatgcggatttcaacatgatcgcaggctttttgcgcagtgtcacaaatcagagcgaagccgcgtccagcaatcgtttggtgtaatcgctggtcggatggtgcaacacggtttccgtaagtccgcattcctcaacgcaaccgtcgtgcaacaccataatgcgatctgcgatatgctgcaccactcccaaatcgtgtgacaccatgatcagcgccatatcaggttcgccgctacgaatcgcagcgaacgatgcgagaatctgcgttcgtgcggccacgtcgacggcgctcatcggctcgtcggcaagcaatactttcggatgatccgcaatggcacgtgcgatggccacgcgttgcgcctgaccgccagagaggtccacggggaaccgattttcatatgcggcagggtcgagactcaccatgcggaaggcttccgacacgcgttccgcaatccgttcctgcgaccaatcagggtgatgcaaccgcaatggttcggcaacggatctgccgaccctccaacgcggatccaacgagtcgaatgggctttggaacaccaatccgcagctacgccgcagttcgccggcgacttcgccttgcacaggcttgccgaaatacgtaatctcgcccgtttcagcgtgttcgagccccagcaatactcgtgtaagggtggttttgccggatccggatccgccgatcaccgcaaggcactcccccgaacgtacgtcgatatcaacatcgtgcagcacctgacgacgctgttgtttcgcaccgtagtatttgctgatgccgcgaccttgcagcattgtggttttttcgttttcgcccgtcacaaccgttctccttatttggtttcggcatcgatccgcaacgacagcgcacgtgccgaagtcaccaattgcgaagcgactttagtgtgcggcgactgcaggatatcggcggtttgtcctgattcggcaacacgtccatcagcaagtacataacagcgtgtggttgcatgattgagtaccgcgaaatcgtgggtgatgaagagcatggatgcgccggaatcgtccaccaacgatgccagcagatcgacgatctgccgttgcgtgatcgaatccagcgcggtggttggctcgtcggcgataatcaggcgcggcgacgtgaccaatgcggccgcgatgccgacgcgctgctgttgtccgccggaaagttcatgcggatatttgttcagcacatcttccggcagcctgactttggcgaacattgctttgacacggtccaaccgttcgtcacgggtcagatcgtaatgcaaacgcagtggcagcgcgacctgctgcgccacggtcatcaccggattcaatgcggcggaaggattctggaacaccatgcccacataacggccacgcagatcggcgatcgcttgatccgacgctccgacgatttcagtaccacccatgtcaatactgccggaaacctgtgcggaaagcggcagcaagcccatgatggatttggcgatcatggatttgccggaaccggacgaaccgatcaaaccgacacgttcaccgtcggcgatgtccatatcgacatcatgcacaatcggcattccattgatgacgatattgagattacggatgctgacgctcatgcgcgttcctccgattcaacatgggtggcttcaccttgccgcaatgccggattcgtcagcggatcgatggcgtcacgcaacgcatcgccaaacagattcagcgctatcaccatcaaggtgaccaccaatcccggccacaccacagccatcggataaatgctgatgaatttcacggacgtggcaagcgaatgcccccaactgggcactcccgcaccgacgccaacacccagatacgtcaatccagcctccgccaagagcgacgtgcccgcactcatcgacagctgaacgcataacaccggaaccgtattcggcacaatatgcgtgaaaaacacgcgtaacgaactcgcacccgaccacaaagccgattccacatagtcagaacgtgcggcgagcatggccgcggggcgtagaatacgcgccaaattcagcccgtatgcaagtccgcatgcggcgatgatcaccgctgccgacgcgccgaacggcacggaaagcatcaaggcgatcagcactgttggaatggaaatcaacgcatccaccacaaccaccgacgtggaagccaatgcgccatggcgagacaccatggccgccaccagcagcaggccgatggccgcggcaaccaccacggtaagcagtgcgatcgcaagattcgtacgggaaccggccatcagccagctcaacacatcagcgccaacaccatcagtacccaacatgtgagcgccggacggcgaagcccacgtgttgaatccgtcagtatcaagcagcgaatatggcgtccacaccagcgaaatagccgacacaaccagccatatcgcaagcatgatcagcgaatacttgccaccagcggtacgccatatggagggaatcacggttttcacagcgtttttcgaagtagttttctcagcagactgtttcatcatgcaagcacctcccccgacaccaatccggcatctttcagacgcggatcaagcgcacgatgcaccacatcaaccactaatccaagcaagaggaagaacgcagccaacaggaacaattcgctctgcactgcaatcagatctcgattgccaacatcggtgaccagcatggtgccaagccccggaagcgcgaacagattctcaaccaccattacaccggtgaccatctgggcgaacgtcaaaccgatcaccgacaccaattgcggtgtggcaagacgcaaagcgacgcgcaataccgcctgtttgcgggtcatgccgcatgccatggccatgtcgaccgcctgagacgaggccttgtcccccacggcggcacgcgtgtaacgcataatggacgcgcctgcggtaacgccggtggcgagcgccggaagtatcaaagaagccaacgcctgcaagggcgcgccccagccattatcgggaaaaccttgagcaggcagcaatcccaacagtcctgaaccgcgtgagaacagcagaatcaacagcaatccgccccataatgcgggaatggcgccggcaacaatcgcaataccgtgacaaagcccacgcaagcgggcattacgggtcagcacagcagcgcaaccaagcggcaggccaatcgccaatgcgatcagcaaactcacgatgatcagtggaaacgttaccgaagcacgagacgcaacctgtgccgacaccgctttgcctccgatggtggacacaccaagatcgccatgcagcaatcccagcatccaatcgccgtattgtgccacgtacgatttgtccaagccaagttcggtacgaagcgacgcgatacgttcaggggctgcgttcgttcctgcgatcaccgcagccacatcgcccggcagcatgcgcaacagcacgaacaccagaagcgacagaccgaacagggccacgacgaacagtcccagccgtttgactacaaatctcatagttgaaccaccattggtctatcgctcgatccgtgcgtttgcagcgatacgcacctattcaccgtcattaccctatccaacaatatcgcgccaacgtgtggcggtgccgcaacgatgccgctgcaaacaccgccacacatcagttttcatcacttgttttccgccgattttccatcgtttttcgtcgattcaccgcgccttggtgatctgccacaatggcagcaccgtctggctcagcttgctggggaatccctgcacgttcttgtggtatgccaccgtcacacgatagccgaacagccagtcggcgggggcatcctcgcttactgctttcgcagcctgcttcaggtagtttgcgctggattcctcatcggtggcggcgagcgccttggcatacagttcttgggcttgcttgccgtcgtagtggaagtagtagtcgggcgtggtccacttgtagaagtcgtggctttcggcgtggtccaccaacgaaagttcatagtcgccgttggcgtgcacgtcttgcagccatgtggagaattccacgtagttgatgttgagatcaatgccgattttggcgagctggctacgcagttggtcgccgagttccgtgccgtacgtgttggcgtaggtgagggtgagtttcagcggattatcggtggaatagccggcttcagccatgagttccttggctttgttcacatcatacgggtacaggtcggtcaagtcctcatagcccgggtccacggatgggatcggcccgccgagcgcatagtcgacgttaccgcgcgaagcgatgatttcctcatggttgatgccgtaacggattgcctgacgcacgcgcttgtcggcaagcttgctgttcgcgcagttgaaggcgagcacgtatttgtcgctgccgtccgccgcggacacctgatacgtgttggtgtcaagcgatttggcgagcgtggcgttcaccggggaaagcacgtcgacttcgccgcttttcagcgcgttgacggctgcgttatcgtcggtgaggaatttgatgatcacgttttcggttgcggccttgtgtgcgcttccccaatacttcgggttggctttgagcgccattttgctggcggaatcgaaggattccaccgtgtacgggcccgatccgacggcttcggttttcgcgttgtattcggcgtccttatcgaacaccaggccggggcgtccggtcaggtaccacagcaggttggaatcgggggtgctgagcgtgagcttcacggtgtcgctatcgaccgcttcggctttttcgaggctttcgacctgattggcgttgtaatactgctgttctttgagctggttaatggaccaggccacatcttcggcgtccaacgtgtctccgttggagaagttcatgttctcgttgagatggaacgtatacgttgtgccgtcgttagaaatatcccagcttttcgccagtcccggctgcactttgttgtcggaatcgcgcgacagcagtccttcgtacacattgccgatcagcacctgttcgatcgccgatccggactggtggcgaatgtcgagacttacgggggcgagtttcagtccaatggtcacggtgttggaggtgccattttccgcggtatcgctggatgcgttgttgttacggaacacgacgacgcccacaatgatggcgaccactgcgatcactgcaatgatggcgatgatccacttgttgggccccttggatttcggtgatttggcacgcgcgttcaaagttgcgtcggtgcttgccgagtttgcgggctgattgttgtgttgttcgttcttctgttcggttgcgtcggcttcgccgtacgcacctgaagattgcgacatgattgctcctgtttgattatgtgtttgttctggttgaccgcctgtacgggtcgatcaccaaagtctgattctacaatccgccatgcccgcaggattcatctgacggcaatgccgcaatgccgcatgcctcagccggttcgatatatacttgacgcagttttcgtaagtcttgccaacgtcaagggaaggacaatatcggctatggcgcatattcttctcggcgtgaccggcagcatcgccgcattcaaggcctgccatctcgcctccgactggagcaagcagggacatgaggttcgcgtggccatgaccgcggccgcgcaggagttcgtcaccccgttgacgttcagctcgctcacgcatacgcagacgcgcacgtccatgttcgcagcacagcgcaatgacggcgatgttgcgcatacgccatccgatccgctgcatatcaatcacgtggatgatgcgaaatgggcggacatgctcgtcatcgctcctgcgagcgccgatatcattgcgaaaatcgcatgcggcattgccgacgaccagctgacaagtaccgtgcttgcctatagcgagggaccgaaaatcctatgccctgccatgaacgtgcacatgtatgagaatgccgtgacgcaacgcaatctcaatgcctgccgtgaactcggatggaccattgtggagccgggatccggtatgcttgcctgccaggatgttggcaaggggcgtatggaggagcctgctgcgatcgaagctgccgtagctgatctgctgcgtgcgaaccagcccgcagaaacgttgccattgcacggattgcatgtgctcgtcaccgccggccccacacaggagccacttgatcccgtgcgctacctcaccaatcattccactggaaaaatgggctatgcgatcgccgagcaggcacgcgatatgggcgcggatgtgacgctggtatccggccctgtcacattgagcgctccccgcggcattgatacggttcacgtcaccaccgcgcagcaaatgttcaacgcggtgcaagagcatttcacgcaggccgatttgacgattatggccgctgccgtcggcgatttccgcccgattgagcagtcttcggagaaaatcaagaagaacgggcgcgtcaatatcgatctgcggctcacttcgaatcccgatattctcgcatgggcaggcgcgcataaaaccgccggtcaaaccttgtgcggtttcgccatggaaacgcaggatcttgaatcgaacgcagcgaaaaaactcacatccaagcattgttccatgctggtggccaacaatctcaacactcccggcgccggattcgcggtggatacgaatgtggtgaccgtgctgaaacccggcgaaaccaccgacgaaccgatcatcgagcattggaacaagatgagcaagcaggaattggcggaacgcatcctcaccgaattggcagcgttgcgcaataccgaatccgctgaatcgcaagcatcgtaaccatcaaccagcatcacaggaaatagcgtcaatacagcaatcgtaaggagaattcgacatgcttctggtcgcagtcgacatcggcaacaccaatgtggtgatcggctttctcgatgacgggcatatcgccggcacgtatcgcatcaccacgaaggcgaaccacacgtcggatgaatatggcctgatgatcacgcaattcctgcggctgagcggctatgcgccgggcgatgtggacgatgtgatcatcacgtcggtggtgccgaaggtcatgcattcgttccgtgccagcattgtgaaattcctcaatatcgatccgatgattgttggaccgggagtcaaaaccggcatcaatattcgcatggacaatccgcagaatatgggcgcggactgcattgccgactgtgcgggagcctactacgagtatggcgggccgattctggtggcggatttcggcacggccaccacattcaactatgtgaccgccgatgcgtcggtgatttgcgggctcatcaccaccggcattcgcacaggcgcggccgccttgtgggatgccacggcccagttgccggaagtggagatcacgcgcccctcgtcgattctggcgaaaagcaccaggccagccatgcaggccggcctgtattacaacttccttggcggcatcgaacgtacgatcgcgcaattccatcgtgaaatcgacgaggatttccgcgtggttgcgacgggcggattaagccgcgtgttcgccgacgataccgacatgatcgacatttatgaccctgatctgattttcaaaggcatgctgcatatttacgaacgcaatattcgacaataacttttcgtcaacatacaatctcaatatataaaaaataatggctgtcttgaattcaaaagaaaaacaagacagccatcattatttttacaactatagcaaataattaactatttactgaatagtaaaaccctgattggctccgtattccttcaaatccttctgccacagcgcaataccgcttttcaatttgagacgatcagcggaatcagtttccttcaacgcgtcgccgatggcggatttgtcggacactttgccaccggccgcgatgatattcagcctgtcctgctctttgcgcaaccggctcgaccatttgtaggccttgcctacggtagtgcggaagtcgcttcgcgcatacacttcaaacggcagatactggtaaccggtcgacacgttttccgcggcttgggaaagcacgcgattgtattcctgaccgccgaaatacgggatttcaatgccacgttcgtcggtcacggtggttttgcgcaggaattcccgatcagacaacgtgatgttatcggcggggaacgcaccgccgtccacacgggctttgatgccttccgcgttatggcatgcgtattcgatgaaacgatatgacgcttcgggcttgcgcgaacgctgcaacacagccagcgccgaaccgccgttttccgacgtggtataactgccatccggcgtgggcatctgtgccacacgccacaaacccgcggttccgggaaggttcgacatgagcagcgacggcagccaagcaccggagaacatggaggcgatcttcccctcccccacggcttccttccacccatcggaccatgtggtcagattggtggcgaccaaaccttcgtcgatcattttctgccagaattcggtgaaggttctcgtaccctcatcgtcggtgaggttgatcgtcacgtttttgccgtcgttggaggtggagaacggacggcctccggcaagccagatcatcgtgtcgtagaagctggcgtcacccgaatcggctgcgatgtacacgccgatgcctttcagctttttggccgcctcgtaatagtcgtcccacgtgcgaatcttggaggcatcgatgcctacctgctcgaacacgctgtcgttgtagaagaacgccattggaccggaatccatgggaaggccgtacacgcggccgttcagctgcaccgaagcccacgtaccgggcgtgtagaaatcgccgtagccttccgtacgcccggtgatcgccaccagctggccgcttaccgcgtactggcgcaacgcatagtattccaattgcaccacgtcgggaatgccgtaaccgtcttgaatggcgttgttgagattgtcgtaaccgcttgtgttcttccaaataacgtggatgtcggggttttccttttcgaagctggcaatgacctgtttcatgctcggctcccacgaccacacggtgatttcggtgcgggaatcgacgttggctccgcaagcggccgcactgactgccataatggccgcacagcagatggcgatgagtcgtttcaccagtttcaagccgattccttccgtttgacgttttcgtacgaaaacgtacgtagacatacgcattcgagtgtacgtcagtcacccgaaagccagcgtacaatcctccaatctcttcgattcagccacgcaatccactgatagctcaaaaaagcgtccgccgattgacaatccctcaatccacagacgctcatatttaccgattccactatggaatcatgcagctacttcacggtgtagccctgctgagatgcataatccttgatattcttttcccaagcctgaacaccttcagcaagggtgacggacttgtcggtatatgcaccaccggcatcatcgctatatacgccacgcgcataaacctcgaacggcaggaacttgtagccagtcgaaacattggccgcagccttggcgagctcctcattgaacttctgaccaccgaagtattcgtgcgcattgccatcggaatcagtcagagaggtcatgttcaggaagtcatcagaagcgagagtgtcgttatcggcagggaatgcgccgccagcgacgcgagtcttgatgccttcggcattgtggcacgcatattcagcgaacttgtatgcagcttcggccttggccttgtcatccgtcttgaccatcgccagcgaagaaccaccgttctcggaattggtttcagatccatccggagtcggcatctgagcaacacgccacttcccctcaccgtcaggagcaccggaaagcaagttgtagggcatccaagcaccggtcagcagcgaagcgatagagccgtcattcaaactcttgttccaatcatcactccagcctgcggtcttggtatcgataagatcatcatcaatcatcttctgccagaaatcaacaaaagtcttgaccttggaatcattgctgaggttgatggtgacggactgtccatcggaaccagtggagaacggcgtcgcgcccgccagccatgtcatggaatcgaagaagccagcatcaccagaatcggacgtaatgtaggaccctgttgcgcgaaccttcttggcagcatcgtagaactcatcccacgtcctcacccgagtcggatcgaccccggccttatcaaacacatccttgttatagaaccatgccatcggtccggaatccatcggcagtgcatacacaccgccattaagtttcacagaagcccacgtgcccggcgtatagaaatccgagaacttgtccgcaccaaactgactcaggtcttcaatctctccacgaacctgatattcgggaagtgcataatactcaatctgcaccaaatctggcgcacctttacctgcagaaagcgcattgttcaaagccgtgtattcggtgctgttcgtgccggcattggtcaccttaacagtgatgtccggattggccttttcaaaatccttcacggtacgcggcaaagtggaatcccaagaccataccgtaatttcagtcttaccaccctctgtcgcccccgaagaactcgaattcgaggaactcccgcaggctgcgacactagtcagcatcgcagcagcagcaaccagagcgattgttttcttggatgcagtgaacttcatcgttcttccttcctttaaatatggccgacctcctacatcgaccaacattatcggctatgaatcattcattgacccttccgacagtcatgaggataacacaaaagttatgtttacgcaaacaaataggcaaatcgttgattttacagtatttcttgagttacctagcatattttgtttagctacgcaaacacgatatgattgcatactagacgtatgcatatccgtcgaagctcgcgcaacgcagacatttcatcagaccactcatcgaaaggaacggcatgacttccggaaccagcacaatcacagtgcaaaaaaacagcgcaattgccgatataccaccccgcattttcggatcatttgtagaacatcttggacgttgtgtctacggaggcatttatgagccaagtcaccccacagccgacgaaaacggattccgccaagacgtcatcaatctagtcaaagaacttggtgtgacctgcgtgcgttaccccggcggcaatttcgtctctgcctacaattgggaggatggcacagggccacgggggcaacgcccaatacgacgagatctcgcatggcacagcaccgaaaccaatgaagtcggtatcgacgatttctaccgatggagcaagaagaccggtaccgaaatcatgcttgccgtcaatatgggcacccgaggattgaaggccgcactggaagagttggaatacgtcaacggagcgcccggcaccgagcttgccgatcgccgcgtacgtaacggaatcaccgaaccaatggacatcaaaatgtggtgcatcggcaatgaaatggatggcccttggcaggtgggacatatgagccctgacgagtatgccgcagccgtggaccgagtcgcacacgccatgaaactcgcggaatcaggcttggaactcgtggcctgcggctcctccagcgcccatatgtcaacgtttggatcctgggaacgcagcgtgcttaccaaagcgtacgacaatctcgatttcgtctcctgccatgcctactactacgaacgtggggcaaaatcgttgcaagattatctggcaagttcacaagacatgcaaacgttcatctccaccgtggcggcatgtgcagacgaagccaaaaatgcccacacaggcgatcatgatatagcactgtcatttgatgagtggggcgtctggtattccgacgtctggaatcagcaggaagctgaatggaaagcccaatcaggcaaggatcttcatcatgagtcatggccgaaagcaccgcgtctgctcgaagatatctacaatgcagccgatgcagtggtagaagggtcgctgatgatcactctgcttaagcactgcgaccgagtgcgttctgcctcgcgcgcgcagttggtcaatgtgattgcgccaatcatggccgaaaagaacggtcccgcatggcgtcaaactgtcttctatccgtttgccgaagccgcacaacacgcccatggcattgcctacagtccagtcatcgactctcccaacgtagagactgaatctttcggcttggtcaatgcccttgattcagtaatcacttgggacgaaacgaatcattccggtcttctgcttatggtgaatcgcgacgcatccgacgcacataaggttacggcttctctgtctcaactgccgtatttcgacatatccgacttccatatagacaaggccattattctgcatgacgacaatccatatcagcgtaattccgcagacgacccaaccgcagtgacaccccaagagcttcatgcaacaatcgacaatggatcagttcactgcactttgccagcaatcagttgggctgcagtggaattccacgcctagtttttattcgaatagtataaattaaatgggtgtcggcagattgacaatcatcagcctgccgacacccataatgttgcgattatttgcttgctgtccgcttactgcttagtgacgatcacgccgttcggtttaatcgaggccgtttcgccgtccacgtccgcgaacgaggagaccacgacttcgccttccaccggaacccggaccgtctcatgcgtgcggttgaacgagaacacgaacctcgaaccgtccgcgccctcacgttcgacgtgcagcactcggccgtcgtttccgcccgcttcggccatgccgagcgaatcaagaatttccggcaggctcaacgcgatgccgtcccgcccgaggcgcgcgcccacgtacacgctgcgaccttcgccgaacgtgtgcgcgacgatcgccggagcgccgtccatgccggtccacggatcgtccttgaacgtttccagcacggtggccgtcccgtcgaccgagccgatcacgtcggcgatatcgtgcgcgaccgcgccgttcgacaactcgaggtgatccggcacgcccgtgaaatcgtcgcccatgggcatgaattcctccacgcgcacgccgaccacgtcacggatcgagcccggatacccgccgagccacacgtggtccttctcgtccgagatgcccgtgtagtaggtcacgaccagtcgaccgccgcccacgacgtaatcgcgcaccctgcgggtcgtttcctcggaaagcaggtatacgctcggcaatacgaccatctcatagtcatcccaggcgccgtgcaccggcaccacgtcggcggtcacaccctgatcggccaaagcgcggaaccacgccaatggctcgtccacgtgatgcacgtgctgggtcggcgtggcggtgtgttcggtggcccattcggactcgtagtcgaataccacggccacacgggacttcgcgagcctcgatcccagaatgccctcgtcggacagtttgttcagatcggcgcccagctcgcacacgtcgcggaacacggcggaatcctcgcccgcgtggggcaccatcgcggaatggaacttctccgcgcctgccttggactgcctccactggaagtagcacaccgcgtccgcacccatggccacatgagccaaagagtcgcgcaccagctggccgggctccttgcggtagttgatctcacgccagttgaccgcgctggtggaatgctccatcaggaaccacggatccttgcgtgcgatgccgtcgaccaggctcgcggagaacgcgagctcgtccaagtgggcctcgcccggaatgaagtaatggtcgttcgacacgaaatcgacctcgtcgccccaatcgtcgtagtccaacaccgaaccggacgcggacaccatgaagttcgtggtcaggggcagatccggcgtgatctcggcaagcgtgtcgcgctcggcgatgtagaacgccttcaacgcgtccgagctgaaccgcttgaagtcgagcagcttgcccgggttcatgaagttgccgtcgccgatgaagcgcggaggcacgatctcactgaagtcgttcatgcgctgtgcccagaacgccgtgccccacgcgtcgttcaccgcgtcgatggtgccgtagcgttcctcgcaccactgctggaacgcatgttcggcgtcctcggaatagtcgaaacggttgtggcagccgtactcgttgctcacatgccatgcgaccacatacgggttgcccttgtaatgctcggccatcgcacggcacagcttcagcgcgtactcgcggaacaccggactggtcggcctccaatgctggcgggcgcccggctggcacacgtcgccgcggtagtccttccacagcacctcgggatgcgcctgggtgagccacatcggcggcgacgcggtggcggacgccaagtccactgcgataccggcctcgcccagcttgtcgatgatgcggtcgagccagtcgaaatcgtacacgccctcgctcgtctcgatcttcgcccacgagaagatgcccacggacacgaggttcacgccagccttcttcatcagacgaacgtcatcgtcccacacttcctcgggccactggtccgggttgtagtcacctccgtaccagatgcgttcctgctgtccagccaacggctgcggccaacgataggctctacgttgagtcatatccactcctttgtttttttgtcaactatcctaacaaattcattccttgacggcgcctgcggcaaggccggactgccagtacttctgcaggcaccgcggccgtcctgctcgtattccttggccagcgccacttcgtcgttgtacgtctggtagcggttgagcagtttttccgcggcttgtggatgcgtgcgcctcaaaatcctggcggggccgatgtccctcttctgttcgcgtacggtgtctttcggacgggtgagtatcaccacgatgcggtcgtggccgtcatcgatggccttctgtaccggaatcggatcggcgatgccgccatcgtaatagggaatgccatcgatcgcatacggttcgcaagctaccggcaccgctgatgacgccttcaggatgtcgaaattgtcgtagcccacgtcggatttgccgaaatacttcgtggagccgtcttcggcgttgcacgcaaccacggtgaaaccggtcgggttggcttcgaaagccgcgtagtcaaccggattttcgccatcatgattgctgagcgtgctatacacgtaatcgaggttggcgaaattatggttcttgacatagctgtcgaagctcgcgtattccttgcggaacgcgtactgcgtgtagaacgtgtggttgcgcccatgctgcttcgcgatgaacgaaaccatgttggcgctgccggcggaaacaccatagcagtggtcgacgctgatgccgtcctcaagcatgcggtccatcacgcccgcaccgtagatcgcacggaaaccgccgccgacgtcgatcattgccgtcctgtgagccatatgcgtcccgtcctttcgccgttcgtcccttttgcgggtttcaatcgactttacgcggtctaattgacgtatttttgcgtgttcggtcatttcttatcgaaggacgacgtaagatatctgcgaataatcaacaaaaatggagtggagaagatatcaatgaacgaagctgcactgcctcagtcgacggtccacatcgcccaagctgatccggatgggattctgctggtgattcacgcgggtgccggcaatcgtggcaaaaaggatacgccggaacgtcgtgcccaggtggagcaggatttgaacagggctcttgaagctggctatgcgctgctggagcagggggcgccggcggaggatgccgtgtgcgcggctatccgtgttatggaggatgctccggagttcaacgctggtcgtggcgctgcattgacgagcgaaggcatcgtatccatggattcctgcctgatgaccggtgtcgatggcgaggtcggttccgcgtgcggtctgaccacgtctaagaatccgatcaacgtagcgcgtgccatcaaggaaaagaccaagcatgtcatgtttgccaagcctggtaatgatttgctcaaggagtggggaatcgaactgtgcgacagtgaatatttcatcactccggcacgtcaggaatccttgcgcgaggcgcaatccaacggcgatgaatgggagaagcatggcaccatcggcgctgtcgcccgtgactcgtccggcaacatcgctgccggcacctccaccggtggcatcaccaaccagatgccgggacgcgtcggcgattcgcctctgccgggctgtggtacctatgccaacaacgattccgtcgcgatctcctgcaccggcatcggtgaggcgttcgtcaaggaagtcgctgcgcatcaggtttccgatcgtgttctgtacgccaaggaagagccggtcgaggctgcgaaggcggcgctggatggtgtcgcccgtcatcatggcgatggcggtatgatcgtcgttccggctcatggtgaaggcgcaatggtgttcaatagcgagatgatgaactgcggttggaagtctccgaagggtagctacgtgcagagttgatgctgtagtggcaaaccggcaaacaagccacaaaagtacagtggggttcgaatccatgaaggattcgaaccccactgtacttgagctccctatatggccggcgaatcgttcgtccgccggccagaaacatcacttagtgatggtgttgtaggtaggcagattggtgtaatcgaacgatacgttcttcacgttcgtcgcggacgcggcggcgacgttgtcgttccacagcggaatcaccggaagatccttggccagcacttcctgcgccttggtgaagtcctcggtccgcttctttacgtcggtctgggcaagtgcggcattcaggagcttgtcgaattccgcactcttgtaatcaccatcgttcgaaccatgaccgtcagcggagctggaggcatatagcggattgagataatcctcagcggacgggtaatccagcatccagccggcacggaacgcggttttgatggtgcggttggtcacctggttacgcacgtcgctgaacgtggcgtacggctcgccagcggcgtcgatgtcgagcgtgttcttgatctgattgcacacggcatcgacccattccttatggccgccatcggcgttataggcgattcggaagttgccggaccacggcttgatggcattggctttcttccagagttccttggccttggaagcgttgtatttcaggttgctgccgttctgttccagtttcttcacatattcggggacgagcggtgaagtgaaatcggtggccggggtcttcgtgttgttgtaaaccttcttgacgatctggtcgcggtcgatggccatggaaatggcctgacgacgcaactggccttcttcgtcgttgccgaaatgctcaagacgttccggaatgacgaaggactggaacgaggatcctgcctggctgtaggcgatcacgctggaatcctgacggaaggtcttcaccgcggactgtggaatctgatccatcacgtcgaggttgccggacagcacgtcggagtaagcggaatcctcattcgtgtagacgcggtattcgatgcctttgttggacaccttgcggctgcccttataatccttgtttggtacgacgatgatgttcttgtcgtgggaccaggacttgaacttgtacggaccattgccaatcggagcctggccgaacttcttgatgtccttaaatgccacgcttggcagcgggaacatggattggtgcgcgagcttggtcgggaatacggaatcaggcttgttcagttcgacgaccagcgtgtagtcgtccggggtggaaagaccggaaagtgtggccttcggatcgacgttcggatcctgcagttcgtcatagcccttgatggtggagaatcggcttgcggtcttctgcgcgttcttcacgttggcggcgaaactccaggtgtcggcgaaggaatgggcggttaccgcctcgccgttggtgaacttccagcctttcttcaacttgattgtgtacttggtggcatcctcgttcggggtgatactctcggcgacttcgagatgttgcttgccctttgcgtcgaagctcaccagaccttcgaacaggtatcgaataactctgccgccgcccatttcgttggtgtcgcttggaattagaccgttctgcggttcgctgttgttcactgaaatcagcgaggtgctatcggagccgttggaggctgtgtcatcgttggaagacgatccgcatgcggcgatcgacgtcagcatggcacccgccgcggccatggccagcagacgccggaatgtgttgttcttcatttcattctcctttaatgtcgacttttccgccgattatgtcgacgaaaaaacaataggacataatatgggagttttataaaattttcgtgtcatgtctcaatttgaaaacgaaccgctggcaggcgttggatatggacgttatcttcagctttctaggaatgcggggatggcctcggccgccgcatagcccgcgcggtacatgcgttccaatccttcgaacgacttgctcaacgtgatgacgggattgtgacgggattacgacgggattcgctttctgatgacgggattacggaagaaacaacttcaaaaacgagtgctgctccgaatgccgccattgcagtggttccatcccagaaagagcgtattcttgatgcgctgcgtaagaatgcgagcatttctatctctgacgccatacggatactgggtgtgcaggaaaggcaggctcaacgaatattgaagagtctggtagaggaaggcagtgcagtgaaaattggtgctgctcgtgctactcgatacgctgaagcgaagaaaaggacggaaccgtatgagtgaggatagccaggtaaccaagctgctcgccaaacgtttcagccagccaggtgaacgcgggcgcatcgtattctggcgcgacgataagaagcagtacgcggatgatgtagcaacattggtaggcgagcatgccactgatgaggtactgcgcgaggttgaactcatcaccccggaaatcggtgatgagaacgacaggcggtacattccgttcaccgtgcgctatcgcatgttccacgagcagccgaatcaaaaattccttgtatatctgacggagccggccccggcggttcaagacaactggctgttggatttggaactggcatacggccccacgttcaccatggacaaactcgccgtgacacttacggaaacgctgccggaagcctccgccgacacccgaaacgagtggttggaagtaatgaggggcgtaccaaagttcttcgacagcgaagaacgcgccaagcgtctcgcgaaacgtcttaacgcgcacgacgacgccaccgatttccaagcgaagatgattgccacgctgctgcaactgaaagatgatcggcacagcatgcaagacatctgggctgagctacttacgcaatattcgcagggtgacgcttctggcatcaccgcgattgaacgcatgggattaagcacgttccattggactggaacacgacgcatttatcgttttgatgtggatgccgatgccggcagcgagccgacggtgaaggatttcgtgctatggctgttcccgctcgcatggaacggattctccgatggcaggaacgccgtttccgcttatgcgaacattattcgcgactgggacgactggtataagaacatcgacatgcgcacggtgttgcagaatctttccgagaatgccgtggaggaactgcacctgtccactcgaatcgccgatatgagtgtggaggagcttgccgaccgggacctgttccgcgacgtggacgagatgatcgtcaacaagctgttcgaacggttgggttcgcagtccattacagacgaccaagtgcaacggatcatcaatgggcgcaagcaaaagctctggtatgcagaatataccgaccaatatgagtgcattgccgcagcaagcaggctccgtgccgttctggctgaatgcggtgaactcatcagcaccatcagctcaccggaacaagggatgaagctgtatgccgaaaagctgtacaaggccgatggcacatacagaaaatatgtgctcgcatggcatcgtgccaacccggatgcggtgagcgtggacgatgatctgcaaagcgcctacgaggcatatcagcaggatctgggtcaggcatggcaaaaacaagtcgatacgcttagccaatggaagttcatagacatggacgcgcaaaccaatttctatgaacgtgaaatcgcgccggtattgaagtccggcagaaaaatcgccgtgatcatttccgatgcgctacgttacgaggttgcgcaggaactgtccgaacgcatcgacagggaaagtcgtttcagtacgaaactgaccatgcaatacagcgttctgccatcctatacgcaacttggcatggcggcattactgccgcacggttcgctcgaattcgacagcaaagaccgtttatatgttctggcggatggacgcagcaccaaaggaatcgaagcgcgcgccgccattctttcggccgtaggcggcaaagcgattagatatgacgatttgacaaagctgaaagtcagcgaaatcaaagaactatataaatcctgcaacgtgctgtatgtgtatcacaaccatatcgacgccaccggtgatacggagaaaacggaatcggaaacagtggacgcatgcgagaagacgttcaaggaactgggcgaagtagtcaaaaaacttgctagcggcaacgtccataacatgatcatcactgcggatcacggattcctctatcaggaccgagatttggacggtacggaatggttgagcgaacagcccaagggcgatgcggtatgggtgagaaagaggcgattctccatcggatccaatcttgctccgggtcgcgcgttcgtgacattcaatgccgcgcagataggaatggacgatgctcggaatgaaggcataagcattcaagtgccgaactccatcatgcgcttgcgcatgcagggcgccggtgtgaagtatgtgcatggaggagcagcattgcaggaaatcgtcgttcctgtgctgcatgtcagtaaggggcgttccgcggccgacgatgtaaggcctgtggaattcactattctgcaacgaaccgacaggctttccagcagacagttgactgtggaattcttccagaacgagcccgttggaggaaaaatccgcgcacgtaccgtattggccggattgtgggggcgcgatacggcaggcaatgatgtgctcatctccaatgagacaccggtcgccttcgatctgctcgggcaggagaaaagcgaacgccatgtgacggctacgctcatgctgaccagtgacgcggaacgattcaatggaacgaatatcgaactgcgcctgcgtgagaagacagatgggtcaaacgtgctggtcatgcttgaccagaaggcacgatacttcttcaaacagggcgtggtggccgacgatgccggattcttcgactgaattggatgagcacagaggaaagcgaccgtaaggggtaacacaatgaatgagcagggtatgagccagaacggttggattgaaagtcctgaacacaacgcggatgggaattccctgagcgcgttggatgtcaagatcactgacctgttccccggggtcactgtccgcaaggatctggtgaacaaggtcaagggcaatgcgttggtgccctcatatgtgctggagttcctgctcagcgcatatgccacgaataccgaccaggccagtatcgagtcgggtgtggatcgagtgcgtgccattcttgcaaacaactatgtgcatcgtgaggaagccaatcttatccagtcgaaaatccgcgagaaagggagccataggattatcgaccgtgtacaggtggctcttaacgagaagaccgacctgtatgaggcgacattctccaatctcggcatcagccaggtcatcgtcgatccaagccttgtaaaggcttatccgaaactgctggtgacgggcatctggtgcatgtgccagatcggctacgcatattccggcgacccacgcgaagtgccatggcagctgctacagctcaagcctgtgcagatgtcgcgcgatgaccgcgaaaactacatgcagcaacgttcgcaattcaccgatagcgaatggatcgatctgctgatgcaatccattgggttcaatcccgatctattctccgaccgggcgaaactgctgcatctggtacgcatggtgccgtttgtggaacgaaactacaatctggtcgaactcgggccgaaaggcaccggcaaatcgcacatctactcggaattctcaccgcacggcatgcttatatccggcggggaagtgacagtggccaaactgttcgtgaataattccaacgggcatctggggcttgtgggctattgggatacggtggcgttcgacgagttcgcaggcaaggccaagaaggccggccgggacttggtggacatcatgaagaactacatggccaacaagtcgttctcccgtggcgtcgagacgttccaaggcgaggcgagcatggcgttcgtaggcaacacctcgcataacgtgccgtacatgctgaaaaactccgacctgttcgaagagctgccgaagcagtaccatgatccggcgttcctggaccgcatccacttctacctgccgggttgggagttcgaacagatccgttccgagatgttcaccagcggattcggattcgtggtcgactatctggcggagattctgcacaacctgcgcgatgccgattacagcgaccggttcgaaaagtatttcgaactgtcttccacactgtccacgcgtgacaaggatggtattaggaagacattctccggactgatgaagctcatctacccggatggcaatgccactgccgagcagatggagccgttgctgcgttgcgccattgaaggccgtaagcgagtcaaagaccagctgtgccgcatcgactccaccatggaggaggtcgagttcacctacaagcgtgtgagcgacggtgaagtagtcgccgtgcagacgttggaggagcttgactacccgcagttgtattggcgtgggcgcgtagttgagaactcggaagatgaaggcgagtcggaatcgtctgttgccggtgaagccatggcaattgcgggtaacgagaaagaggcgagttcttctgagaacgccaatgccttgcccgtagcgcggcagcaagaaacagctacgatgactccaatcgagcgtcttgcggcaaaggccgatggaaagcagcgggaactgatcgaaaaccaacgtggaatcacgtatttcggattattcggcccctacttggccggggcaaagaaaatcgttatagaagatgcatacgtgcgtatgccgtaccagctgcgtaatctggctgagttcttggagatgctgctgagatgcaaaaatcccgatgaggatgtagccgtccgtctggtgactgggcataatgagtctggattcgtggaggcgcagctaaatggtttgaacgaattggcatcgacgttcgcacagctgggcgtgaacctcacatacgaattcagagacactttgcacgaccgttccattaccgcggataccggctgggaaattcttcccggtcgtggtcttgacatcttccagaaattcgttgatggcgattggctcaacccgttgctacgtcatcaacagctccgccgtgtcaaggaatgcaaggtcacgtataggcgaattgatgagaaatgagttgatttaggtctcaggaggtaagaagaaagacaatgatgaattggacggatgcggttcaggcgatttgtgccattataagtacaattggcggcattggtgcacttggcgttagtgcatggcaaatttatttggcttcaaagcagatgagagaaacatcaaagcaatcaaaacaagagagtgaagaccgtaaccgcccatatatttcgatggatgttgttccgggtcttggcggagttggctgttgggatttaaagataagcaacacgggaggatctcccgcaagagacatatcaatttcattgttgcacgatcattttttatccgatgaagatggttcatatttaaaagataagcttgaagctttttgctccacacagtttgatttaatgccaggagcgtcccgtagaatttattggtcgatttattctgcagatgagagcagggtattagagggggctcctcttaaaggagttatttccgctaggtattcgtggaaaaatgattctaaaataatcgcagattatgaggacaacttgccatatgactgtgagaatgcaccgattcccgcaccctcgacgggctcgaagagagagggtaaatccgaagcggactcattaaaaaacatagagtatgcacttagaagtatttctcatcaaattggtgaactcgcaagataagaaaaaacgcgctaagttggtgcatgtatttcatattatggaatggatcgattttggtgcaatgattaaaatttatgttgtatttataatttgaattctggaaggaagatatgacctgtgttagatactgattttcagccgatagacaatgaagaactataattgcaaagagatgtaaattacaaatatgttatgcgatatcagtgatttcatattcagtatcaaactaaatcaacttgtcattgggaaaataccaaattattgagtatgatgtttgatgtagagtccaatgggattgccgaggttatcaaatataagtctttaggtggctgtaaatcctactgcataatcattggtatagaaaagaaacactactgatgagagaatgcatgcagaattttcagaaaaaaaggtttgtatgttgacttttgaatttggtgggaatgtcgttgtatagcttcaatatagctatgatcgtgtatacgtatgtctagaaataaagctaatgcaagaagagagtctttctgattattctcgctactttttgttgctaacaaagttagctgcttgtatttatctgaagttttaaattcattgagaattgtcttaatttcctgatcggttgctccaagtaaagggattttatcgtttttagctatttttgtgttgatggtaggaagatgagtttcctgcaaaattgaaaaaatctgttgactatttttgagatatacttgtttgctgttgatttccctgtcaattaatagctgagtgttatatatgacgctgtctcgaatatttagtatagcattcttaatgctttgggtgatcatatattttattctctgtgtctttttaagaaatgtaaaaaatactataatatatagtagtattgaaacaccatttgttattgctgttattagtgatagcaatgcattataatggaaaatgaatggaataaatatgaagagtaaagaaaacatcagaaagaaaattatactgaatgaccagtatatgtatctatctaacgagaagtctttagtcttaggtgcctctattattcttattgagaagaatgatactattgctgtataaaatacagtatatataagtacaataacgagattgttattaattatagtcgaattctttttcgagagaaggttgattactaatactatagtaaagtaaattatgcccgaaagaacaaaaaagatgtatgtgaatttctgttttttaacgtctgtatactcattcagtatatttttaaggtgatctattttttcgcaggaaatcttaatatcttggttaaagataacttgttttttcgcatattcttctagagatagaaagagaaaatcggaaaaccatacagttagtattgcaaatattatactgtaacgcgtcagttcagggaatatgacagagctgtatactgttccagcaaaacatgtgtaagagtttattttacatattcttataagaaagaattccggaagtgatgacaatgatgttgtggaaatgagaaaagaagttgcgaagcatattcctaggagggtaaataaatcactgaatcctgatccatttattgcttctttccaaaaatcagaaaaataaaggtctttatgagtaatttcccatagcaaatagcgcaaaaactgcatgggaataatcataaaaacagcgtagagagatctttttactacatcacgccattcgaattctttatatatcattttgtttcttcaattctgttgtagtttaagtagtgatagctaatgattatagtaatagttattccgctgatgcagcggggatgtgacaaatatcttaaagtcatcagtgtaataaacggcgactatttgaacatcatctaaaatgatgcagaacctccggtatatcggtagagacgagatgtacgaatatgccacaacacgagccgatttcgtcgacgtgtatggcgatccgtccggccgcaagacgaacagcgacatgtggacgagtttcggcgtaggcttgggtttctgtcacccggatggggcgttgaatattcgaggcggctatattgcggtcgatctgtacttcactgacacgttccagtacacgaaactttacgctatgagggattccgttgaacggatactagcacatctgggcgaggtgatttggaacgagccggaagctgacaagaaaaaccgacacctttgggtgcggcatgacgtggattttgccagtgacatgacggaagcctaccggtggatgacggacgggctgctcgccatgcgcaatgtgtatgagctgctcggctgatgttttggccgtttcgactgctgtgcgttcaatgcttcatacaatgaacgtagtcatccgaaaagaggccgccatgaagtacgggatgagaaaacccagctggaagaagagcctgtccgcgcgcacgaaaggccgtgccacccgcgcggtcaagaaagcgttgatccccggctgcggcaagaagggcatgggatagctgcatctcaagcgcaagctgtacaacaccatctacaagaagaccacgttcagtctgttcgacctgttcaagtaaccagggctaaaggagggaatcacatgtgttccaatccagacacatacgagttccgactttcatcagaccttcctcaacagagcgccgttcctactgatacgttttctgccttgcgggaagtccatgaatattcagcggagaacggtccgcgtttccacacggctgctgagatgtttgattctctgggaatatgacaggtcccgccatgagaacattacgtatggcgggatctagtgcttctgtagcactgttgctgaatcgcgtgcggcactcaggcgagcatggcctcgatgttgttgccttccagatcgtgcacgaaagcggcgtaataggtcggtccgtagttcggcaaccaatacacggtgaactgacggaaacgattgtagccggcgccgcctagcatgcaatatgggaaacgacgccggccgcaacgaccggccaagacggacggaacacacgaaaaggcgaatcaaacacagcatgggcaagaacggcacgcaaccaacaacgaaaaacgtcacaccagcggtcaccccatggggtaagaaccgtgtgaagaacaccgaaaccggcaatcacgtgctcatcatgccgggcattggatacaccgtagaccgaccgctgctgtactgggcagcgcaggcacttgcggccaacggatggttcgtggaccggctcgacctgaaactgacggaaagcgtcgagtttccggaaatgatcgcctgcatggaacgcgtggtcgacgaatggcgcaaggcggcgctcgaacatgctgccgaatcgggtgaggagccgcatttgctggtcgtcaccaaatcgctctccacactctcatatccgcattccgcaaaactaggattacgcgtggtgctgctcaccccggtgctcaacccgccgccattcgacaagcacaagtcggtcattcccgcgccgctaccgggaactgccggcagcccgatgccgctaatctgcgcaggtgacgccgacccatactacgatgacgccaaagcgcatctgctcaccgaccatgtgcgcacgtacgctggtgccaaccattccatcgaagtgccggacgattggcagacgtcgctcgactacctgaaacaggtcacgcaagccatcgtcgactacgccggctgaaaagaacgggacggaatatgcgcatcgtattgcagaaggtcagcgaaggatccgtcgacgtggtcgacgagacaagcggagaagtcgacaccacattcgaaccatagcatataggcatcggctatgtgctgctcgtcggagtggaagacacggacggagcgaaacaaatcgactggctcgcccgcaaaatcgccaacctacgcgtcttcgaggacgagaacggcaaaatgaaccgttccatccacgacgtgaacggcagtgtgctgtccatctcccaattcacgctatacgcgaacgtgcgcaaaggcaaccgcccaagcttcgtgaaagccggagcgcccgcgcacgccgaacagacatggcacggattcaacgacgccctgcgagcacaaggattcgaagtaaaagaaggacgattcggctcccacatgcgcgtgcggctcgccaacgacggtccggtcaccatcatctttgacaccgacgaactcggcgtctgacccagaacccaacgtgaaaccctatatccgacgattgtcatagggtaaaacgcatgggaatatggaacgaccgcaaattgatcgtcaactgcctgccgttgaccgaatccgaacgtgcgcaattcatacgtgctgcgaaagacataccacaggaattcgtcggcgattcgacccaacggggaagcatgagctggaccgccgcagtaccggaggagctcaaagccaaagccaccgcggtcatcggcaacatcgcgcccgaggaatgcgcgcagtgccccaaactcgaatggcttcaaacttggagcgccggcgtcgacaaataccagcgacccggcatcctgcagcccggatccatgctcaccaatgccaccggagcctacggacaaagcgtctccgaacacatgttcgccatgatgtgggccatcatgaagaacctgcacatctacgcggcaagcaacccgaacgccatgtggcaagacgcgggccgcgccgtcagccccaacggaaaaacggcgctcgtcatcggaaccggcgacatcggatcacacttcgcacgactctgcaaaaacgtcggaatgacaaccatcggcattcgccgtaatcccgccgtcgaagcaccgggcgtcgatcatatggtcggtttcgattccctcggcgacgtcctgcaatacgccgatgtgatcgccatgtgcgtaccatccaccccggcaacacgccatctgctcaatgcggaacgcatcgcatctctcaaacctgacgccatcatcatcaacgcgggccgcggcgacgccattgaaagtcaggcgcttgccgacgcgctcgcggaaggacgaatccatggcgccgcgctcgatgtgaccgaaccggaaccgctgccggccaactcgcagctgtggcgcgagccgaaatgcctcatcacaccacatgtggcgggaggcaaccatcttgagatcaccgagcgccgcatcatcgccatcgcattgggcaatgtacgctgctacgccaacggtcagtcgctcgacaatcgcatgcccatcaaaagctgacggtcgcgcgtgcggggagacccgtatgatggcagtcgggaagaaaggaaagggtatgacattgaacaaatggcgtcgtgcgacggaatggttcatgacggcattggcgttggtgttcctgttcgcgtattcgtgggaagttctggcgaggacgcatatcctgttgtgtgaaatggtgatcaacatcatctggatggtgttcatcgccgactgcgtcgtttcgatcctgctggcagaagataagaaaacttggttcaaagacaatctgctgatgctggtgtccatcgcattgcccgtcttcaggccgttgagactgctgcgtctggtggcagtgctcaacgtgctcaatcgtaccggtggcatggcggtgcgtggtcgcatcacactgtacacatgctgcagcgtgacactactgatgtatatcggcgcccttgccgaattggatgtggaacgtggggttccgggcgcttccatcaccgatttcggtgaagcgatatggtggtcgttcgtgaccgtcaccacagtcggctatggcgatttgtccccggtgacatggcagggaagatgcatcgccatcggactgatgataaccggcgttgccctgatcggcatcgtcaccgcgacgctggcttcatggattgtcgaccgtgttcgtgacgagaccgacaagcgcgcggatgaggcggaatcggaaacggaacagttgcgccacaatgtgcgggaactgacggacaccgtcaaccagctgcgcgatgatatcgcgcagcttcgcaggctatagcggttctcatgcctgcaccggtattatcggtcggttccacggtcaacgcgacggtatctgtgggcgtgctcgaagataccaccgattacaagggtcagcgctcgctgccgcgtgacttctccatagaactgaagcagggctccattaccaaccagcgtagatcgggccgctgctggaatccgaaccggtggaactcgatccatggcagccgctcaccaagcgttgccgctgatataacctgtatggagcgaagccgtggctgggattgcagccacggctttcctgttccgctgtgctgatactctttcataagaacaaatgtgcgaacgattggggttcagttggcggatactttgtcatggctttctgacgaactacgcagcgaatgtagtcagcctgtattgcagcgtgcccgtggaatcgccaaccagtggcgtgcgaaaatgtcggatctgcattgcctgaacgactccgattccgaccgcatcaccctgcatgccaatatgcggggcaccacctcaccgtccagccgatacgaagtgcaggccacgcttgatttgcatgatgagcttttcttggccaggtattgctcgtgccccgcgttcaacggttcgcagcacggttatggcacgtattcgtcggcatattcgcccagctaccgcaacaatccaaaatatcgcagtttcgatgatgatgacgatgaatacgattatgtcgatgattatgatgatttcggttcaggatcgacgttcggtcatgtgcaggacgatgacgagttcgattcggatccggctgggggacgccgctatacgggcatgtgcaagcatgtcgccgcaatgctgctgctgtttcttgaccagcccgaacggttccgcggattcaggcgaagtggcgtgacttcgcctatcctctccgactacatgcgtgcgctggatgcgaagaatgacaataccggtcaaagcgcgcagcttgacgtgctcaagcgcatcgttgacgcgaaaagccgtctcgccgacgcgcaacgaggcgtcattacgcaaggggccacgaaaacaaaacgcaagagcggttccatcatagtgaaaccgggaagcgtgcgtctggagcccacgctgatcatgaaccgtgagctgtggagcctgacgttgaaaatcggctgcggcgacgtaagctatatcatcaaaagcatttccaaattcgtagccgacatgcacgacggggcatacgtgtcatacgggcagaaactctcgttcacccacactccggatatgctcgaaccgttctcgctgcggctgttccgattcctgcaaggcgttgttggttcacgtgttgctgcacagctgcagaacaactactattacgcgccagacgtgcgtatcgaacgtgaaatcatgcttaccgatggggaattgtgcgatctgctgaacctgttcggagcggaatcgcaacaggactacatcgaagacgtgctgatagcacgtgggctgggggaagctcccaagcatgaggaacgtgagagggcgcggcagctcactccggatgatttcgcccatacggatgacaccgctccggactacgtcgaagtgaccacgccaggggagtccagatcgcatactatcgccatatttgatggcaatccgcaatttcggttcatcgccgaatatgtgaaggaaggcgcttcgtcgggcgtgcgtatcacgtcgaaccgtaccatcacggatcggattgtcgggcagcggggcgtgtatctcatgagtgccgaacataacggcactccgacggattcccatatgatgccagtgagcggattcttccgttgcaccgacagcatccttcccgcagtggacgcgttgatgacgttgtgcgcgtcgaacgttagcgatggtgtgttcattgcggaaaacgactggcccatgttcgcacgaacaatactgccaaaacttaccgaggcgggcattggtttcgacattccgcaggaagtcgccgaacggatgggagtcgactgccagatcgaattctacttggaccgtgatctgcagggcatcacctgcgaggctgtggcacgatacggcgatttcgtgttccagttggtgccgaccgccaaagcgctacgaggcgtgattaatccggactcgcggtcgaaagcggcgctcatcagacgagatacggctcgcgaatcattcgcggtgcaggtggttcgccagcttttcccgacatggagttccattgacatggcgcggattcgtgaggaagacgaacagactattctgctcttgctcaccgaaggcgtggatatcttgcgttcggtcgggcaggtgttctccacggccgcgttcgacggcatgatgatgccaggcagccctacggtgaaggtcggactgtccatcgactcgaatctggttgagatttcgccgatagccgacgaagtgccgatgaacgaggtcggcgcgttgctgaattcctaccgcaggaaccgccgctaccatcgattcaaggacggtacgttcgttgatctgaagaatgccgatctgcatgaacttgatcagattgccacagatcttgaccttgatgagcaacagattgattccgggagaatcaccattcccggatatcgggcgttcctcttggatgctcaagttgatgacgacggcaaaagcgaatcgttcgtcgactatgtcaacgatgtgaaaatcatcgacccaaaacgatacgaagtgccccgcaacctcaaaaacgtactgcgcccataccaggtggaaggcttccaatggctttccaccttgtgggacaaaggcttcggcggcattctcgccgacgaaatgggtttgggcaaatccgtgcaattgctgtcactggtggaagctcgcaagggcagtggtcccgcgttgatcgtctgcccggcgtccttggtatacaactgggccgccgaatgcgaaaaattcacgcaagatctgaccatcgaagtcgtggccggcacgaaagcgcaacggcgcaagctcatcgcagccgtggcacagcaatggaagaacccctcggaatccaacgatatgcagcgtaccgatgtggtgatcacctcatacgatttattgcgccgcgacgtggatgattacgccgcctgccggttcgcattgatggcgctcgatgaggcgcaatacatcaaaaaccatgccacgaagttggcgaaagccgtcaaacagatcaccgccgaacaccggttcgcattgacgggaacccccatcgaaaaccggttgagcgaactgtggagcatcttcgacttcctcatgcccggattgctgggaacctacacgaagttccgagaaaaatacgagcagccgatcatggcacccggttctgaacattccgtcatggctgacaaactgcaggctttggtcggactgttcattaaacgacgtctgaaaaaagacgtgctgaccgatctgcctgacaagttcgaaaacgtgctcaccgtcaaactggaaggcgaacagcgcaaactctatgcggcgcacgagcaacggttgcgcgccacccttaccaaaaccaaggacgccgacttcaatacgaagaagattcgaatccttgcggaattcacactgttgcgcgaaatctgttgcgatccgagactcgtctatgcggatgcgaaaaacgcttccgccaaacttgacgccatctgcgaactcgtatccacgtgcatggacgaaagcaagaaagtgctcgtattctcgcagttcacttcattccttgacctgattggtacacgtttggctgaacagggcgtggacttctacaccatcaccggcgagacaccgaagaaacgccgtgtggaactggtggacgaattcaatggcaacgatgttcccgtgttcctcatctcgctcaaagcgggcaatacggggctgaaccttgtgggtgcgtccgtagtggtgcacgccgacccgtggtggaacgcggccgcgcagaaccaggccaccgatcgtgcgcaccgcatcggacagacgcaggatgtgaacgtgtaccagatcgtagccaaagacaccattgaggaacgcatcctcaaactgcaggagaagaaaagcgagcttgcccaacagttcaccgacggcaccgcatctggaggcgtcggcacactcagcaaagacgacttgctcgacctgctggcataacaatcaacgtacctgccgcttgcttgaacgcacacgatacgaaagcaacaggcaaagcgcacactgcggcaacacaccatgaggcgacgttcatgccataggcaaaaggcatatgaggctaagatcatggtttccggattaaagattgatgcctgctgataatagacgccagtgagacgcggtttgcatatttccgacgataggcgtatatataatcgtgcaagtttcagggaaggtgaaaatccttactggcggtaacggtacgactgacgttcataacggtcccatgccgaagcccgcgacccgcgaaagcggctgatccggtgagaatccggagccaacggtcaaagtccggatggaagaaacggggctcaacatgagtgtatcctcaccaaacaatacccaaaacaacgacgccgaaatcgccagcgaaagcatgacgcgccccgacaacgcgcattccacaggcgtggctgactctggacgctggtccaccaaacgcatcgccatgtatgcgctgttcgtggcgctgtcgatggccgtcagctttgtggaatttcccattgtgccaggcgttgaatggctgaaatatgatccatccggcattgtcagcctggtggcaggtttcgcctacgggccagcggcggcggtaatcgtcagcgtgcttggtttcctgccgcacctgtttaccaacccatggggcacgcttatggccgtgctcgtggctttggcattatccgtgccggcagcactgatctatcgcaggaacaagacccgcaaaggcgcggtcatcggcatcatcgtcggtgcgatcgcagccttggcgatggcgattgtgggcaatataatcgtcacaccgttctacgcgcacatgaccaccgcacaggtcgtggcattaatcgtgccggcgcttctgccgttcaacgcgttgaaattcaccatccatggcgtggtcaccttcctgatctacaagccgatctccaacctgttgaaccgctgagcctcgttcaccatatcgattccgcatattgatgaataggaaggaacctttcgacgtatggaaggttccttccgtttatgaaagacgattccatgaaccctgacagcgacacgaacaccattgcggtcgaattacgtgatattcgtttcacatatgactccggcgcgacctgggcgctcgacggcgtgaacctgaccatccgccaaggcgaacgtgtatgcttggcaggaccaaacggatcgggcaaatccacactttcacgcatcatcgcaggacttgccgcacccgatgccggacatgccacgctgttgggaaacaacgtattcgatgactccggcgcgcacgctgacgcttaccgcagcgcccggcatggtatcggggcggttttccaacatccggaagatcagatcgtcaccaccattaccgaggatgatgttgccttcggtccggaaaacctcgccattgcgcatgatgatatcgatatgcgcatcgccatgtcacttgacgcagtcgacatgagcggacaacgagaagccgatcccacgcgaatgagcggaggccaacagcagcgcgtcgccatcgccggcatgcttgccatgaatcccgaaatcctcgtgctcgacgagcctaccgccatgctcgatccgcaaggccgcgccgacatcatgcatattcttgacgaattgcagcagcacggcacaaccatcattctcgtcacccaccatcgtgacgaattcgtcaatgccgaccgcatcattcgcctggataacgggcgtatcgtgcaaagcgctcgcggtaatactgcaagtattccggaaatggacgaatcaggcacagcgcaagaagacaacccaattgccaaatccaatattgcaaatggcgcatcgaagccaacatcagctgtaccaatcattgaaatccataatctgatatatcaatatccaaacagtagcaagcctgtgctcgataagctttccataaccatcaatgagggtgaaaccgtggccatcacagggcataacggtgcaggcaaaaccaccctcgcgcgtcttctctgcgcgctggaacagccgcaatctggcagcattaccgtcaacaccattcccgtcgcacgccaacgcgccaacggcaatatgcagtcgctcaagcgtgcggaccgcgagaaactgcgcgccaccatcggctacgtcatgcaacatcccgaacgtcagcttttcgccgaaaccgtagccgaggatatcgcctacggaccacgcaaccaacatcttgacgaaacgcaggtatccgaacgcgtcaatcaagccatgacgctgctgcatatcgaacatcttgccgatcgttcgccattcgatctttccggcggacaacaacgacttgccgccatagcgggcatcatcgcatgccaaccgcagatccttattatggacgagccgaccgcaggacttgacgaggcagccacaacctgcgtgcacaatctcatccaaaccctccacgcacaaggcatcaccatactcatcatttctcattcgcaaacggaaatcgacgtgctcgcagatcgagtgattgcgcttgatcgcagacaaaacggtaatgtcgctactcgaaatatcgaagccaatggcacttccgaaacggcatattcgaagaatccgcacgcgattgactccggacgcgcaaagggagacgtccgtgaaaaccgcagttttatggaacggcttgacccgcgcgtgaagatggtgagtgcgttggcgatcatgttctccgcgttcgccatcagatccttctggcagttgcttgtggccgcactgctgaccggcatgatcgttgcgatatcgggcatcggcgtgaaacaactgttcaaatcggttcacgtgttcctcgcattgttcgtgttctgcggactgctcaatatgttctttgtgagatccggcaacgttcttacgaacatcgggccgattccaatcaccgacgacggtgtgcgtatcgccatactgtacgcctgcagattcgttgcggtcattatcgtcggagcggtattccttgccacgaccactcccacggccattaccgacgcattcgaagcgttgctcaaacctttcgcaaaattcggcatacatgcgcaggagatcgcgttggtgatgagcctcgcattgcggttcctgcccacgttaggaggcgaagcgaaagccattgtggatgcgcaatcagctcgaggtggcagcatcgaaacgggaacgttcgtgcagcgtatcaaggcgatggtttccatcatcattccggtgttcgcaggggcgatacgccatgccgacaatctcagtctcgcacttgacgcgcgatgctacgaggaaggcatcatgcgcacgcactggcgaatcatgcgaatcgccaaacatgacatcgccgtagtcggtgtgagtgtgtcgtacattgccgcattgaccctgatcgctggactatgctgagcattccggacgggcatggcgctccactgatcgcattggaaagcgaaaccgccgaagaagcacgtctgaacacgcgcaagaacatcgaaaacggtgtgaacgccatcaaaggcgcgggggagtgatatgcaaattttactgccctcacgctactcttgagcaagcatcatagataggaatggaacaagttatggcattaaccaagaagcaggtcaagcagctgcgtggcttggccaccaagctcaatccgctcatccaggtcggcaagaacgatctgagcgaaaacgccatcaagcaggcggacgaaaccatcgaaaagcgtgagctcatcaagtgctccgtgctcgacggatccggtctgaccgccaaggaagcaggcgaggggctggctgaagaactgaacgcggaactcgtgcaggtcatcggcaaccgtttcgtgctctaccgccgctcccatcgcgacgacgtggaacatatccgcctcgtgcgcgagtaaagcgggaaactgacgcgaccaaacataacagggcgggtgctttctgaaaaccaatcagaaggcacccgccttgctgcaatgaaaataaacaatcgaaagtcaggaaaccccatgaaggagtgctatcagcgcgcctgattccattcgggcttccacgtgtactgcatgtcgtacgcgctggcccagaacatgtattcgttctccacgccggtcacgaaaatgtcgatcagctcgcgcttgcgctcctcgctcgcgtcggctaccagtttctcgatatgttcgagcagccatacggaatcctgccagaactcgtcggtcttatacatgtcgacccagctcttgtacggattgtcgtcgagcgtgtccgcaaactcggcggcaagacggtagccataatccgcatacacccaggcgcacggcagcacggccacgagaatgtcgaggatatccttgccataggcgatggaaaggatattcgacgtgtaggcacgcgcgaaggccgactggcgcacattgttcatctgctcttcggtgatgccatagctggccaagtaggagcggtgtacttcggtctcgacctgcagggcgccgttctgcaccttgagcatgaacgccatgatttcagggtcggcggccttggctaatcccaaagcgtgcactctggcgtaatcgttcacataacgaaaatcctgcagcagatagaaggcgaaacgctcgcgttgcagtgtgccttcgccaagctcgcggatgaacggctgctggtagccttcctcccaaaccaggtcggcggccttgcgcatgcgctgcgcgaacggaggaagattgttgcgttggatgcctttggcggcgtcgaactcataatcgaaattggttgttgatgtcacagcagtcattagacatgcctccctacgctggtattaaccatcaggttcaaagggttcaggcctcacttggcccatctcaacccgacaaacacgggttcccctgcattacgccgtacattatggcaaagccgcacgaaatgtgcaagagcccgtccgtcgaatggaatcgtgccgcatgatgcgaacacaggcgatgttcggttgagggcgagtgcaagaatagaacgtatgactgaaaagcaagttgcgaagaacaccatcgaaaagctggctatcgtcgtggtgacgtacaagcgtcagcagctgctcgccaccctgttcgaatccatcgaaaaactcactgtggcgccatggcgtatcgtcgtcgttgacaacgagcacagcgaggcgacccaaggcatggtcgacgatttccgtgaagcggtcaccgcgcagtggggcaataccatcgccgaccagtcgggcaacgaaagccgtgtggtgtacgcgccgcaatccgacaacctcggcggcgcaggcggcttctccgcaggtgtgaagaaggcatatgagctgggtgcggagtggttctgggtgatggacgacgatgtggccgtgatgcctgaggccatcgaaaggctcgccaagtggactggcagccatgatgtgatccagggcagccgatacgactatgacggcggcccgttctactggcaatacgatttcatcgtgcctcttggcattcccaatccgatcgctccggccgcgttcgggcgtcccggctatcgtgtgatggacaccctgtgcttcgaggggggtctgttccgccgcaatatcgtggaacagatcggtttgccggatccccgcttcttcatctactgggacgatacgatgtacggctatcgcgccagcaaggtcaccaatccgatcgtggtgcctgacgtgatcctgcgacgtacgcgcgagatcggcaattgggatatcgccggcgtgcgtcagctcaactccacttccgacatgaaccgttaccacatcatgcgcaaccgtggctacatggcgcgctatttcatgtcgttcggcgattaccgtccgctgatgttcggctttggcacgttactgaccgccgccaaggaggtcattcgcttggtgatggtggaccgtgagcatgccaagaccggcttggtgcagattgccaagggttggtgggattcgcgcaagctgctgcatgatccggattggaagccgatgccgccgctcaagtaatgttgtcgcgccgtttttcagacggctgtttccttacgattcgccccatgccaacgcgtcgcgttggcatggggcgaatcgtttgcagaaaacaatcgcaaatatttgcgtttcattgcgacagattatgcaatcgtattcaccaattgtgtattgtcggcgcgttttggggcatggggcgagttactatggcgtttaccggttcgatatacccactatgtaccttgataggagaggtcgaagatgattgaaactgcacaggcatttggcgttgacattggcggctccggcattaaggcagccccggttaacctcgagaagggcgaatttgctgaaccgcgtctgaagatcctcaccccggaggtttccactccgaaggccgttagagcgccgccctgtcacggcggaggtcaccggttcaagtccggccggggtcgctttttatttttttttaattcttttcaaatatctttttgagatcgccgtattgcggttgccacacaagtgtatatctcatacaaaaaagcccggttcaaataaaccgagctttttcaatcgcctcgaatggcacattcaacataggttcagagccgctgctcgacccaatcgacgatgaacggagccacttcctcaatctgatcgattgccacttcgaattcgtgggcgccaccataccatggatcgaccagatcaatctcgctttcgtagcctgcagcaggcttggcaagattcggatcgaaactacggtacatgtgcacgttctcacgcttggcctgcggaagctgacgcaacaacgcacgcatgtgggaagcggtcataggcaagaacaggtcggtgcgctcgatctcatcacgagtgatgcggtgcgcgaaatggtgcgccggaagctcatatccacgctcacgcaacaccttgacggcgcgacgatcgatcggattgccgtattcctcatcgctgacaccgctggattcgacattgaccttgtcggcgagcccacgacgctcgaattcggtgcgcagaatgatctcggccatgggagagcggcagatgttgccggtgcacacggtcatcacggtatacatgggtttactcctcgtgatttctttcaaaggttatgaaacggaatccggcgatgtcgtcggaacctttcgtcgtgccctgccatacgccttcctcggccaccttccatgccccggattccaccaggcctttgatgtcaggcgcataggtgtcggcgtcaacgtgcatgctgatctgcgtcacatacgccttgtccgcaaacggcatcgcctcgtggaacagctgaccgccaccgatgatccagatttcgctgcggtcgagaccatcatccggaatggcttcctgacgggccagatcaagcgcatcatccaaactgtcgaccacggtcgctccaggcgccctataagacggatcgtgcgaaaccacgatattgtcgcgattcggcaacggacgatacttcggactcagggattcccacgtcttacgccccatgatgaccggatgcgagacggtaagctccttgaaacgcttcatatcttcgggcagatgccacggcataccaccctcgaatccgatggcgccgtcatgaccttccttgtcacaggcctgcgcccaaatcagattcaccgagaacgtcttggggaaatcatcaccccaatcctcctcgttctcaagcccggcaagtccgggctcgggttcgtgatagccactgcggctactgtcatgctccatttcactcactccttgaagtcgaactagggtcagtagtctaacgtctggcgacgactctcagaccgccaccggcgccttgatggttggatggtgctggtagccgacgatttcaaaatcactgtaatcgtaatcgaacagagaagaggctttgttaatgcggatctgcggatacggatatggatcacggctcaactgctccagaacctgatcgatgtgattgtcgtacacatggcagtcaccgcccgtccacacgaatttccccggctgcagtccggcctgctgggcgatcatcagcgtcagcaacgaataggacgcaatattgaacggcacgccaaggaacatgtcgcaggaacgctggtacagctggcatgaaagcttgccgtccgccacgtagaactgaaacagcgcgtggcatggcggcaacgccatattctccacttcggccggattccaagcggacacgaccatacggcgagaatccggatggttcttgaccagatcgagcacattgctgatctgatcgatggtgcgattgggatcatcaggcgtaggcgccggccagctgcgccactgcgcaccatacacggggcccaaatcgccgttctcatcggcccattcatcccaaatatgcacattgtgttcctgcagccaacgcacgttcgtggaccccttcaggaaccacagcagctcataggcgagtcccttgaaaaacaccgttttcgtggtgagcagcggaaaatactcgctcaggtcgaatcgcatctgctgaccgaacaggctgatggtgcccgtgcccgtgcgatcggacttcaacgtgccctccgtcagaatacgacgtaccaaatcctcataaggcatgggaatgtcggtttccgggcgtgccggaatgcgagtacgaatatcagcaagttgttcaggtgtcaaagccatgcttgcaagcttaacagcacaaaatcgcaggtcaagcacatacgcccgcgcgttgatggttcctgcgcttttcggaatgcttcactgtgaatgaacatcgatggattacattaggtatgtaggcgaggagcgaatggcgctcccggcaagacgatgaggagttcaccatgggcaagaggctgtgggtcgagcgcaacaaagacggttcctgggatgcgttcagcgaggatggcgcgcatatcaagttcggcaaaggccgtggccagttcacgcctggcgacctgatgaaaatcgctttggccggctgtgccgcactgtcgagccagttcgccgtcgagcatacgctgggcgagggcaagggtgcgaaaatcgttgtggatggcacctatgacgccgacaacgacgcttatatcggtttcgacgaacaggtggtcatcgacgcttccgacgccggtctgagcgacgaggatgccgagaaattcaaggaacgtgtcacccgtcatattgacaagggctgcacggtgaagcatacgtacgtggagaagactccggtccgtatgaacgtcaccatcaagcactaacgttttttgtaagagtttttttaaaaaataaatggcgattgcagcgccgtgaaaagcgccgcaatcgccattttttacatatttattaaatatttactgacgttccgggtcaatcttggtttcgatggcttcgaccacttccggctcggccttggcgaccggcacctcttcgacacccttgatatcgtcgagcgccttcggcttgacctcggccggcgaactcggaaccgtgtcaagacgggtttccgcagcctcgacatacttgcggggcaccacatacaccgggccgaccgcatgctgcagcaagccttggctggtggagccgagcagtagaccagtgaagccgccacgaccacgggaaccgaccacgacgacgtcgtgatcgtagctggccttggtcagcgcgccaaccgccgggccaggcacgatctgcttgttgatcttcaaatccggatgggcttcctcaagcggcttgatacgcacttcaagatcatccttgaacgaagccatcacgccttcatcgtcggaacccttcatattcggcaccgcggaaatgacgtcaagctcggcatcccatgcggcggcgaaatcagccgcgatctcaagagccttcaagccccacttggattcgtcggaaccgacggccaccttggtgatggtgttgttcaaatgcatcagattgccatcatcgtcggtatacggcaccaccacgatcgggcagtacgcatatgccggcaaactcgaactggtcgtgcccagcaggcgttccgccaagccacctttgccacgattgccgatgacgatgagattgtagttgcgggacagttccacgaacacggacgccggatcgcccgtaacgatgagagtcgtcgcctcaacgccctgctcatcggcgatggccttggccttcgacagaatctcctgagcgtcgttatgggccgcattgtcatcccccatggcggtgtacgtcgcatcaaaggagacagcggcatagctcggcaacgagtacgcacatacgatttgcaacgtcaatcccgcatgcttcgcataattcgcagcccaccacgtggccttgtagctggcgtgggatccatcaacaccaacgaggattgccttgtcattaatcatgggacgacctccttgaatcgcctcggcaacgccaccatgcattgcctctaggatccaccataccgcgcgacatgcgcttttgtcagcaacgactcgatcttttccatacaaaaaggcgtatccccgaaaggatacgccctaaaaagtcaaccgtatgctcgctcagagcacacgacgaatcgcatagccacctgagaacacggccagcgaagtgacctgcgttccctgagccggattcagcgcgttgatcaccataccattgccaatatagatcgcggcatgctgagcattgacgatgatatcccccggagctgcttcggcaatgcttccgacagccgttccagcactcatctgggcgccagaataatgaggcaggctcacaccaaactgggcgaacacccactgcacgaaaccagagcaatcccagccggacggagtattgcctccagccacatacggatagccttggaactgcagagcatagtcggccaatgcctgaccagtggcactcgcaggagccgtaggaacgctgatgttggcacgttcggaagaacggctggcagcctgagcttcagccttagcttgctcctgagccttctgatccttttccgcctgagactcggtctggggaacatccaagctttcgatgccaccccaatcggcgttggactcaatatccgtggatgtgtgctcggcgaggaaatcacgcttggccgtggtggtcttcgggaaagaacgtgtagcggttaccgtggtaccagccacagcattgcctgcgcttgcggccggaaccgccgcacccaacatggcagacacagtaacaacagcgaagatactcgtgaaacgtctaacaatactcatcgtgtccgaagttaccataaacattccccttcaatagaacagcaagacaaccggaacagtgtcatatcatgcgacacgccgacgtgattatgttatgcaaaaaacgggatggcaaacgcaaattaacggaaaacagtgaaatctttgccacaatgtcaagtgatgaattcaaaaaataaaaaaatcgcccgaacggtcaaaaaccattcgagcgaaatacgcaaagtcatcgaaattgggtagcattgagttatctgaaagattgctttgttttgtttgcaattttcaccagcgtcagcataactggcacctccgtcagtacgccgaccgttgttgcaagtgccgccgggctggtagtaccgaacagagcgacagcaaccgcaactgataactcaaagaaattagacgcaccaatcatacccgcaggggcggaaatatcgtgcggtaactttaacaacttgcaggctccataggcaataaagaaaatcaaaaatgtctgtaaaatcaacggcactgcgatcagtatgatgtgcagcgggttttctaaaatgacttcgctttgccccatgaaaatcagcaccagcgtaagcagcagaccaatcgtagtaatggaatcaaatttgtgaataaacacattttcaaaatactctgttcccttactgcgggttacaaatacacgggtcaaaataccgcctgccagtggaataaccacaaacagtattacacttaaaatcagcgtatcaaagggaacactaacattggaaacgcccaacaaaaattttacgataggcacaaaagcaatcagaatgatgaggtcattggtcgccacctgcaccaccgtataagctggatttccttttgtcaacgtactccatacaaacaccatcgccgtacaaggcgcagcccccaaaagcactgctccggcgaggtattctaccgcaaggtcaggcgtaataaatgccttgaaaatcacgaagaaaaacaagctggcaatgccatacattgtaaaaggttttataagccagttgacaatccatgtcacaaacaaccccttcggattttttcctacatttcgtacactgttgaagtccactttcagcatcatgggatatatcattacccaaatcagaatagccatcgggatagagacacgggcatattccagccgagccagtaatgcagggactactggggcaaaatgccccagcaatacgcctaccaccatacacaggaatacccatattgtcagataccgttgaaaaaaattgatccccggatcagcttcttttttcaaccataaacacctccttcaattcgtatttttaaccgtataatgtgcccctcaatttgactgattatttcccggaacgcttcatccgggcagcctgtcgggtcatttagtccccagttatcgtcaaaagctctgccaatatagggacaacccacatcacagcccatcgaaatcgcaatatccggttccgggatgctgtcaaaggttttactgtattgggactgttccatatcaatcccatacagctctttcatcaagcggacagcatcctgattgatctggggcttggtttcgcttccagcagaatagctttcaaacacatcggaagcaaaatgcttccctaatgcctctgctatctggctccggcaggaattgtggacgcatataaaagcaactctctttttctccacttttagtaccccaacttatggatcagtttttccacatcagcagctttcagcacctttcccatagacaccactttttcattgaccaccaacgcaggcatagacattacaccgtaggccatagagcgccgccctgtcacggcggaggtcaccggttcaagtccggccggggtcgctcgaacagattcctgttcatggctctgtagctcagttggtagagcgaacgactgaaaatcgttaggtcagcggatcgatgccgctcggagccaccatggctttgaaacctcggaaacatccgaggtttctttgtttttgcccacacgtatgacgattgcggccgtatgtctagcgccaagccactgatgccggctgttggttgaatacgcgctcgcattgcgggtaagccccctaaaatggtcgacgcaagtcatgttgacttgcgagttactgagaaatgactaagaaaacctccgttagagggggagtctgtctgctgtttggctacactggaacaccgtaaggcagtaacaatgggggtttgtgggcagagttatgccgtaaccccgttaagggagtattcgctggggtggcggcatggaagtgcttctggtcggcaacaccgacttcattaccaagcagtggattcagcattcctttccccgagaccatgtggtgatagcggaacgagaaggcaccgtagacggcaatgaccgtctcagaatcgtcaacatgtctgacgccaacacccttgccgaaactcttaccacatacgaattcgatcgcatcgtattcttttccgaaggcctcaccccgcgaagtgagcgtgacggcgatctcggatatcttcgcagattgctgcacgccatacgtaacagatccacgcaaatgctgatggtatgcggaccggaatccgaattcacctatccggaaaacgccgacgtacgtgataccagcaaaagtctgatgtctcgagcgtcggaagaactctgcctgtattacgcgcgcacctaccgtctggaagcgaaaatcattcgctgtccatacttgtatgcacccgagcgcaatggagcaaccgcatatttcggcagactgttcgaacaggcatcggcagggtcgatctcattctgcgaacgcaaacagcaacagacatgctttctctgcgccgacgatcttgccgaactgatctaccgcatgttcgacgattggaccgccgaaagcgaaatcttccatgtgcccaacgtgttcgacttcacatacggtgatttggctgatgcgatcagcgcggcatttcccggattatcggtgacttttggcaaagacagaccccaacattacccagcagacgatcatgtgctgcgattgcgctatggctggtcgccgcgatattcgctcaaacaggatcttccccctgtgcttcagcgctggaaagaagcgcgtgctcaggaacaatccaagaagcacccggtctgggattttctacgcaaccattcaaaaccatggatcgcaatcgaaatcttcatcgcgttcatattggaagaactgcttcgcaccgcggtacaaggcaacagccagttgggaaccgtggatttgcgcctgtttttcgtggtgatcgtcggcacgatgcacggactgaacgcaggcgtgttcgcggccgcgctcgcatgtgtcggcatggcgttgtcgtatgcatcgaagggcgcttcattcgctccgctgttttacgacacgtcgaactggcttgcgtttgtggtgtatttcgttgccggcgcagtatgcgggtatgtgcagctgcgtaatcgcgaaaacctgcgattcatgcgtgacgaaaacagtttgctgcgtgaacgacttgcgttcctgcgtgacctgtaccacgatgtgctcgatgatcgtcgtatgctgcgcgggcagattatcggcaggcgtgacagtttcggcaaaatgtatgcgatgacacgtgaattggacgaagtgcagccgcaaaagctgtatcacacgaccattcgcattatgcaagacacattgggcggcgatagtttcggtgtttaccgcattgacagcggcggtcgattcgcgcgtttgatggctgcgagtccgcaaaccgaatccctgttcagcaagtcggcgctgcttgagaattatgccaacattattacagctttggatcatggtggattgtgggtgaaccgcaatctcgaaccggaccttccgatgtatgcggcaggcgtgcatgccgatggcaagctggccgtggtgattgtgcttgccaaagcgcagcccgaccaaatgaatctgtacttccagaacctgttcaccatcatgtgcggcttggtggaatccgcgatggtgcgtgcgttcgactatgagaatgtggcgcgtcaggcgatgctggtgccgggcaccgaattcctgaacactcgggcgtttctacccaaagtgcttgccgccaacgaactcaagcacgaccatatgggcgatcacctgctgctgcgtgtggatgatgcttggcaagacaatggcagccgtctcatgggggccattcgtcagacggacgaggcgggtgtactgcaagacggcaacgtgtatgtgttgatgaaccaggccggcaagcatgagctgcctatcatcaacaagcgtttggcccaagctggattgcatgtgacacgcgtttccgggcaagaggaagacgcgctgctggatgaggcttcggaacaagtggccgccgaatcgcacgaaggcggcacggcatgaacacaacggtagtgacgatgctgcttatcgtcatacatgtgctggtatgcgtgctgatgtgcgtattgtctcgttttggcgtgcttcgtgtggaagggcgtctgcttccttttatgctgttggtgccgctgtgggggccgttatgcgtgctcttgctgcatgtgcgtacgctgattcgtgcgggcgagcatacggctccagatctcgaacagatgcgcgtggacgatgaggaacgtcgaagcattctcgttgaggaacgagccgatttcgccaataccgtgccgctggaagaggcgttgatcgtcaacgattcgagtcagcgtcgcagtctggtgatgtccattctcaacgacaatcccagccattatatcgatgtgctgtcgcaggcccgactgaatgaggatgtggaggtcgtgcattacgcggctaccgccatggcacagatcagtgccaaggaagatcttgcattgcagcgctgccgcaacgattatctgcagcatcgaaattccgaaacgatgttggaacgctattgcgatgcgctggaacgatatatcaattccggtattgcgcaaggatacgcattgcagttgcagaagcagcgatatgccgaagtattgcaggaacgacttcgccaacatggcgattattacgttgcgtgccgtcttgcgcaaatgcaaatcgatcttggactctttgatgatgccgcgcacaccattgacggcgctatggaacagtggccggatcaaggcgatgtatggctgatgcgtctacgactcgatgccgcacgcaatgatggcgatgcgttgcgccacactgttcagcagatcgaaagcaagcatatttatctcggtggccaaggaagacgtgtgctgcggttctggaccggaaccaaggaggctgaacgcgcatgatcagaggattcctgtcagacgtgttggccaagtggaaacgattccgctggcaaggtttggtcaaagtgtgggccgtgttcatggccatcgcattggtgttgctggtggaaagcttgggcgtgcattacggtgtcacgcggttcgacatcacgtatttggatcgaaacaaagccattcctgcagccaatgccatcgctggcgaaaaagctacgaatctgttggtggtcgacagttcgcaggagggcgtcagcgatgccgaagccatgctcgaccagattctgcttgatatgaaagtccccaccactgtggttgacgtggctgacgaaaacgctgaatttccagcgttgactcactacagcaccatagtggtggccatgcctaatctcgaccgtctgggcgagcatgtgctgcaaatcatgcaatgggccaaaaaaggcggaggagtcatgtttgccatgactcccgaaaaaaccggctatttggatgtgatcggcccgcagatcggcattgaatcgtccgcatacgaatatgtgctgactaagggcattacaccctccaaggatttcatgttgggcggcggccagacatacacgttcagcgatccgtttgaatcgtcgctgagtgtcgcattgaatgatcgcgcacaggtcaaggccgtcagcagtaatgggcgcacaccgttgatttggagcacgttcgtgaattcaggttcggcggtggtgtgcaatatcggtatttacggcaaggtgtttcgaggattttacgcttcggcgttcagcctgctcggttctgccacggcctatccggtgatcaacagcgcggcgttctacttggatgattttccctctccggtaccgtccggcaatggcaaatacatcaaacgtgactacaacatgagtattgctgaattctattctcaagtatggtggccggatttggtgcgtcttgcggaacggtacggtattcgtttcaccggtgtgatgattgagaattacggcgatgacaccaaggatgatccggtacggcagacggacggcgcacaattcgagtattacggaggattgctgcttcggcaaaacggcgaaatcggatatcacgggtacaaccatcagccgttggtgttgccgaatacggattacggtaaggaatacgcgtatgtgcagtggccgaatcgcaaagccatcgtcgattcgttgaacgaactgatcgcattccagaaagacgtattgcctgccgcaacatcgtcggtatacgtgccgccgtcgaatatcctctcccaagaaggacgaaagatcataggcgaggatgtgtcgcagattcgcgccatcgccagtacgtacatgccttccgacagttccttgacgtacgtgcaggagttcggtgttgcggccgatggcgtggtggaggctccacgtatcgtgtccggcggcatggtgggtgacatgtacatgcgtcttgccgcggtttccgaactgaacatgcactatgtgagcacgcacttcatgcatcccgacgatttgcttgatgaagatcgtggagcgaaagaaggatggaagaagtactaccagggattggaaaactatcttgactggctggaatcgtcggcaccgtccattcgtatgcggacaggcacggaatgtgccgcagccatccaacgtttttcgggattgaccgtttcgatggaaacgtccgacgatggttgggatctgaaacttggcaacctcaccgatcaagggtggctcatgttccgtgccaacaatggcacgcctggcagggttcgtggcggaagcctcaccaagctgaccggcaacttgtatctgctcaaagccacgaacgccacggttcatatcgaacgcaagactgggggagaggcatgagaatctgcctggttttggaaggatgctacccgtatgtgcatggtggcgtgtccacgtggatgcacagttatatcgaagcgatgaaagagcacgagttcgtattgtgggtgatcggcgccaaagccgaagaccgcggcaaattcgtatatgacctgcccgacaatgtggtggaagtgcatgaggtgttcctcgacgacgccttgcgtctgagcggtgaacgcgcgcaagtgtcgttcaccgaagaggaattgcggtcattgcgcgaactggtgaatcttggcagcccggattgggatgtgctgttcaacctgttccacaccagaggcgtgcatccgctgtcgttcctgcaaagccgtgaattcatcgacttgtttacgcaaatctgcatggaagaatatccgtatgtggcctatgccgacgctttccataccgtgcgctccatgttgctgccggtgttgtacttgatgggctgcgaagtgccggaagcgcagatctaccatgcgatttccactggatatggcggattgttggcttgtttggggggggggtatcaaccatgcgccggtattgcttacggaacatggcatttatacgcgtgaacgcgaagaggaaatcatttccgccgaatgggtgtcgccagcgttccggccgcgttggatccgcttcttctacatgctttcggaacagatctaccatcgtgcgtggcgcatcaccagcttgttcggtcgtgcccgtcttatccaaattggcatgggtgcgcccgccgatgcctgccaagtgattcccaatggcattcaatacgaacgtttctgcgatattcccctgaagcccgacgacggttgggttgatatcggcgcggtggtgcgcatggcgcccatcaaagatgtgaaaaccctgattcacgcgttccatgagctttcctctcgcgttgacaatgtgcgcttgcatattctcggcggtgttgacgatcaggagtatgccgacgaatgctatgagcttgtggaacagttgggtgtgcgcaatcttgagttcaccggccgtgtgaacgtggtcgaatacatgcgcaagcttgatttcaccgtgttgaccagcatttccgaaggccagccgctgtcggtgctggaatcgttcgcagccgcacgcccctgcgtgaccactgacgtcggctgctgccgtgagcttttggaaggcgaggaaggcgacgatttcggcacggcaggcttctacgtgcccccgatgtaccgcgagggcctgagccgagccatggaacgcatgtgttccagtcgcacgctgcgtgagaccatggggcagattggccgtaaccgtgtgaacgcctattaccggcatgagcgcatgcttgacgattatcgcaagctgtatagcgataccgcggatcagttcggattgaatcagttcggattggagcgctgatatggccggtattggatttgaactgaagaaactgttccaccgtagaggcttgatggcgatgctgcgagcctacggctatgccggcgtgatttgcgctggtccgatgctgttgggtgtactcctgcagttcggcgtgctgatcgtgagcagctggtggcaggtgggccgccccgaccgcgatctgctcgtatgcatgatcacctacacgctgcttgcctcgttggtgttgacgagttttctgtcgatgccggtcacccgttttctggcggatatgttgtttgatcacgatgagaagatgattctgccgtcgttctggggttctactggcatcatgctggtggtgggcgcggtgttgtacacggttttcctgctgttttccggtgccacgttgatgcagggcgcgttgtgtttgtggctgtttcttgaaatgatcgtcaactggaatgcgatgagctatttgacggccatcaaggattacaaaagcattctgtattctttcgtggctgcggtgttggtggcgttcgttacgtcatgcgtgttgcttgcgttggcctgccctcctgtggagtcgctgttgttcgcagtggtgcttggctatggtgtgatgctggtgtgggatgtgctcttgttgcatcgttattttccgcaaagtcgtaagcatccgtggctgtttttgcagtgggtcgatcagtttctgccgttggcgttgaccggattgctgaccaccatcggcctgttcgcccatttggtgatcacatggtgcggtccgctcggcatcaaggtgaagggcctgttttatggcgcgccatattacgatgtgcccgccatgctggcgtttttgacgattctgatcaccacggtgaattttgtggtgtcggtggaggtcaatttctacccaacatatcggtcgtattacagtctgttgaatgatggaggcacggtcaaagacattaccgttgccgaaaacgaaatgttggctgtgctcaatcgagaattgcattacacggcgttgaagcaattgttggtgaccgctgccgtgatttcattggaaaaaacagtgctgaacgcgcttcctttaggattcagcgatgtgatgcacggatatttccgtgtgctctgcgtggggtatgccctttatgcggtcggcaacaccgtgatgctgattctgctgtattttaccgattattccggtgcattgacggcgtcggcattgtttgcgggttcgacggttgtgttcacagtaatcggacagttcttcactacgtcgctgttcggtttcggttttctgatgggggcatcgctgttcgccatatatgcgacattccggctcgcctcatacaccgacaatctgccataccgagtgctggggcagcagccgattgtggcgcaaacgaaacgtggacgtttcaccgaactgggcatactgcttgaacatggcgaacagcgggtcgaccaatcattgcatcgctcagggcatgcacggtcttctgacaaggcgaatattgcagaaacggatgtcataatcgggaggaatcgtaaatcatgacatggtggaaccgacgcaacacaaaagccattaccatgcttgtcaagcaaatagcggcattgacggcaatgctgacggtgctttcctgcgccggatgtgcgacttcgtcacccaacgataatgaacaatcgcaatcatcggattcgtcacagacgcatgagcaagtcaagaaaagcgctgaacaaagcatcgacggcgcacacttgcgcgacaacgaatcgttatacaaggtgtatgacgacagcggtgtcgaaaccatgtatttgacggtatcgcgcggtaattcgtcggaaggcaccgaccatagctggagcgaaatcaaccagtattccgttgatgactatgcggccatgggcgttgaccgctacaaggtcaatggtttgctgcaggtcggcgacgaacaaggaccggtttccggggagcttggttttggtgaaagcgcgccgaacgccaccgtgcagatacgtggccagtcatcgagtaaaaacgagcagaagaactacaagatcgagttgaaaagcggcaaaggcaagtggcgtgggcagcgtaccatcgcattgaacaagcatatgggcgaaggtctgcgtttccgtaacaaaatggcgtacgatctcatcaaaggcatcgaccagatgatgggactgcgcacgcaattcgtgcacttgtacgtgaaagacgagaccagcggatcggattccttcgacgattacggtctgtacacgcaagtcgaacagctcaacaaaaccgcattgcaggtgcacggactcgataaaaacggccagctgtacaaagtcaattatttcgaattctatcgagacgaagacgtgatcaaactcgccgatgatcctgactacgatcaagcgaaattcgaagaaaaactggaaatcaaaggcgacaacgaccataccaaactgatcgccatgctgaacgatctcaatgattattcagtgccgatgggcgaaatcctcggcaaatatttcgataccgaaaatctcgcatattggatggcattccaattgctgaccggcaatatcgatacgcaaagccgcaatatgtacctgtatagtcccacgaattcggatacgttttacctgctcgactgggataacgatggtatgctcatgcgcaaggaatacgagatcaggcaacgttccgagggccaaagctgggagaacggtgtcagcaactattggggcaacatactgttccgacgttgtctgcaaaccaagtcgttccgaaccgcgctcggcaaggccgtgaaagacgaatacaagtatatgagcgccgatcgcatcaattccatggtgcggcggtaccgttccatcgttgaaccatacgtacggaagatgcccgactccatgcatgagcctctgacgtcaagccaatacgacacggtggcaaaccaattgcatagcgaaatcgaacagaactaccagacgtaccgaaccgggttcaataagcccatgccgttctatatcggcaagccgactcctaccaacggcaagctcaaactcagctgggatgtctcctatgatttcaacgatgaggatctgcgctatagcgttaccgtggccaaggattacgaaggcaaagacgtggtgttcacacagagcgacctcgtattgccggaagccgtgatggatatgcctggtgaaggccagtacttcatcaaggtgagcgtgcgcaatgcatcaggcgagacgcaggacgcgtttgactattacgtcaccgacggcaacaagatctacggcaccaagtgtttctatgtgaaagccgacggcagcattgtggaggatgccaatgtgcagtgatggtggcaatcgcggaacgtcgctgctgcaacgtatcaaacatcgcgtcggcgaggaattatccgttccaccgcgcacagccaaggaacggttccgtcatgagctcaaatatctgatctcatacgcgcaaaaagccgacttgaacgtgcgtatggcgccgctgcttggcctcgacaagcatgtgaaaaacggcggctatatgattcgcagcctgtatttcgacgattattggaacaccgcatatcaggaaaaagtcgacggtgtgctgctgcgtaggaaataccgtattcgcatctacgattacagcgatcgtgtgatcaaactggaacgcaaacgcaaaagcgacagttggatctacaaggaggatgcaccgctcacgcacgagcagttcgaccgtattcttgccggcgattacgaatttctgcgtgacagcgagtatcagttgtgccgcgagttttatgtggaatgcatgtgcaatgtgatgcgccctcgcgtgatcgtcgattatgagcgcgaaccgtggattcttgacgccggaaccgtacgcatcaccttcgatatgaacgtgcgtgcggcggtcggcggattcgatattttcgactccacactgccggtactgcccgtgcttgagccgggcaagctggtgatggaggtcaaattcaccgagttcctgccgcaagtggtgcgtgatctgctgcccggcaaggcgcaggagttgacatcggcttcgaaatacgtgctctgctacgacaaagcctcgtatttgcggggattcgactactggcaggaaggctggagcgtgccaagcctgtaaagccaagcctgtaatcggctggcatgttgactggcattccagcaaaaacaaacgttacgaatcaaggaagcaggagagaaagaaaccatatgagtgtcaatgacatgatcaaaaagtcggtgctgaaatccttcggccaatacaatgtgcccaaaatggcgctggcgttgctggtggcgttgatcgtcggcatcgtcatttactgcgtgtaccgccgtttctacacgggtgtggtgtattcgcgcagttttgccgttacgttggtgggcatgtgcgtgctcacctgcatggtcacgctggccatcagtacgaatattgtgatttcgcttggtatggtcggtgcattatcgattgtgcgctaccgtaccgcggtcaaggatccgatggatctgttgtatttgttctgggcgatcacgtctggtattgcggcgggcgccggcatgtatgtgctggtgattgttgccggattggtgatgatcggcatgctggctctgttttactcgcgtcaagacaaggggcgcgtgtacattgcggtgatccactatgtgggcgatgtagtgggagatgagatcacgcgcgcgttcggacgcaccgaattcttcgtaaagtccaaaaccatgcgtggcgaacgcacggaaatggcggttgaagtattctgtgatgataaggacatgacgttcacggaacgcgttcgcgccattgagggtgtcgaagacgtgacgctgatacagtacaacggtgagtatcatgggtaatcaattcgatgttgccgcaggcgcgcggctggaatccacgggcagggcgcccagcaacgacgaaatcgtacccagattctctcttgacgacatcaaccaggcgtttgacaacaacgaattctgcttctacctgcaacccaaatgcaatgctgaaaccggcgcaatcgtgggtgcggaggcgttggtgcgttggaatcatccggaatatggcttggtgtctcccggcgaattcattcctctgcttgaacgtgagtcaatggtcacgcggttcgatttgttcatctggcgttccgtgtgtgaaatgctgtcgcgttgggatggggaggggcgcaatctggtgccggtgtccgtcaacgtgtcgatgacggatatcgaggcgatcgatgtggcgcgagtgcttggcgacctgctcgatcggttcagcatcgatgctcgcctgctgcaggtggagatcacagaaagtgcgatcgcacataacatggatgtggtcgaagagaccattcgggacctgcatgcgcgaggcattgccgtgctgatggacgattttgggtcggcgtattcgtcactcaacatgttgaaggacatcaacgtcgatgccatcaaactcgacatgaaattcgttgacctgaatgctgacaatgcggcgaaaggtttgaaaatcatcgaatccgtgatcgacatggcctaccagctgagactgtcgatcattgcggagggtgcgcagaccgccgaacaggtgagcaagctgcgtgagctgggatgcatgtacatccaaggatattatttctaccgtccgctcactgtgggaaagatggaggatttgctggaacaccgcccggatgaccagcatttctggaatatctccaaagatctgatgcatcgcgactaccgcatgtcgacgaacggccgcagcatgctcgaatcgtcgtcattgtcggcgcatatttttgaaatccttaacaagggcgttgcggaactgtcccgactgaatctcatcacgggagaatatcgcaccatcaaacgcgatccgaaacttccggacgtgtatgcggatgattttcatgatttctgccatgcattggtttcaaaacggatcattcatccagatgatgccggagaattcctgaaacacacgcgattgtctgatttgcgcgaccaactattcagtaagaaaaaatcggaattcacgtattttagaagcgaggtcgaggcgaaaaccagcgtgatcgcattcggtatgctggtaccccctgattgcagcgaggccaatccgtgggccgtggtgctgatcggattcgacctgtcgctcgacctaatcgccaagaacatgaaggaaatctatcggcaggactccttgacgggattgctcaaccgcaatgcatacgacagcgatgtggagcagctgcggagcgccgacatcggggcggtggtgtgcgtgtatgcggatatgatcggcctgcacgaggtgaacaaccatctcgggcataagcagggcaaccgcatgttgtgtgagttcgcggacgcggcgcgcgcgttcttcggcgatgaccggttgtatcgcatcggcggcgacgaattcgtgataatcagttccgcgcatacggaagcgcagacacgcaagcagctgaactacatgcgtgagcgcttgcatacgcaaggctgcgagatatcagtgggcgtagcgtcgagcgagtcgacttccgatctgccgaaaatcgtcgaacaggccgaaaacgagatgcgccgcgaaaagaaggaatactacgtgcgaggcggcagcaaacgccagctgcgcgggctcaacaaaaaacttgaggacattctggtgcgtaatcaggatatggaatcgttgctgcggcatttgaacggacgctattcaatcgcatgcatggtgaatctgcgtactgactcacagcgtgcgatcatggtgcccgactatttccagaagatgcttgacgcgcatgacggttcgttcaaaagcgcgctgcatgactattgcgaacgattggtggcgccgttctgcaaagacagtttctccctgcttatggattacgacttcattcatgcccgcgtcgagtcggtcggcgtgttgcagtacgggtacacgcgaaacgacggagagaagttcctgcttacgattttcgccgatcgacgttccaaagacgagaccatgtgggtgttctccaaggatgatctgccgcaggtcgagctggaattattcgagtcataaggccgtattgtctggttttatgcgtttttgtgtgatgcgttcgcatattttgtgagaacgctcacagaaaaggttgtgtcgatttccagccgaatcgcaaaatggggtctatgatgagaatcgttggtcatggcaacggttgctatgacacggcgaacaagcacagtcgcttaaaggagacatctatggtctatcgcatgattttcaaccagactgcatacttcggtcgcggcgccatcaaggagatcccgggcgttgccaagtcccatggcttcaccaaggcgttcatcgtcaccgatccggtactgttggaaaccggcaccgtcaagaaggtcaccgatgtgcttgatgaggcaggcatgccgtacgaggtcttcgacaacgtcaagccgaacccgccggtcgaatgcattcaggatggcgttgccaagttcgccgcatccggtgctgatttcctgatcggtctgggcggcggctccccgcaagacacctgcaagggcatcggcatcatcaccgccaacccggagtttgccgatgtgctctccctggaaggcgttgccgacaccaagaacccgtccgtgccgatcttcggcgtgccgaccaccgcaggcaccgcttcggaaaccaccatcaactatgtggtcaccgataccgccaacaagcgtaagttcgtggccgtcgacccgcacgacattccgatcgtcgccttcgtcgatcctgatctgaccgactccatgccgcgcggcctcaaggtcgccaccggtcttgacgccctgacccacgccattgaaggctacatcactccgggcgcctggagcctgtccgactgcctgagcatgcagaccatccgcatgattgccaagaaccttgccaagagcgctgacggcgacgttcctgcaggcgagcagatggcctacgcctcctacatcaccggcatggcctactccaacgtcggcctcggtctggtgcatggcatggcccacccgctgggcggccgcctcggcgttgcccacggcgttgccaacggcattctgctggcaccggtcatggaatacaacaaggacttcaccggcgagaagtatcgcgacatcgccgacgccttcggtgtcgaagatgcctacaccggcgatctcgagacggttcgcgaagaagccgtccaggccgtgcacaagctcaccgtcgacctgaagaacccgaccaccatctccgaagtcggcgcaaccgaagccgatctggaagcactggcccacgacgccttcaacgacgtgtgcaccccgggcaacccgcgtcaggccaccgaagaagacatcctcgccatctacaagagcctgatgtaatgcgaaaactctcacgaatcggcaatcgcatgcagcgaatctgcagtgaaacccgattgtgagagaacatcgctgaaagcattaaaaatcgtggtgcgaaacttcacaaagcattcgcaccacgatttttatatctgcacataaattacggattaatcgaaataatgtaaacaataatccgtgattatcaatcgcaagtattggaattactcgtgcttttcgctccactcctcatcggtgggagtgtcatcgtaccattcgcggccttcctgctcggccaattccatctgctcgttgatccacgccgcctccgcaggattgatatcggcggtgtcaagcaccttctgccataccggatacagcagatgcatcaccggatatagcgcggtgagcagaatctccggcttatgtttgcgcgaatgctgtggatgcgcgtcgaacgtgttcttgaaacgacgcatgtaattgttgaacgacgtgagcgacgtgtccatacggcgggcgctgatgccggcgatcatacgcgggcagtacacggttttcagatccttgcccagcagatgcagcgaaatatcgatatcctcatgcatcacatcggccttgtctcggcacacttcgtcagaaatttcgcgccaagctgaagcgcggaccgccatattcgagccaaacagcaacggctggccgccatcggccttgtaaatacgcttgcgtgtggaattatccccacgcaaaccaaaatggcggctcggcagatcgtaatacatcaccggaccagtggcacccatggcctccgggtcctcagtgaaaatgccggacaccacttcgacccaatccgggcgaatcatgcaatcggcgtcgaaacggcccagaatgtcgccggtggcgtggttcaaaccataatcgcgcgtcggaatcagcccctgctcctcatcctgatgcagcagacggatgggtgcttccgggtggtctttgatgaactgctccaccatggccaccgtcgaatcggtggaacgattgtcgacaacgatcacttcatggggcatcacggtctgcctagtggcattcaacaggcaatcgttgatacgctcctcttcattccaagcggggatgacaattgaaacgttcagcataactaccacaatagctcagcctgtacacgacgcctatcgctacaatagggagccatgagcgacagcgaacagcgaatgaacaatacgcagagcgaaaacggtgcgaacaccagcgaacagcgatgggacctcggcaccctgtttccagccaaaggagatccccgaaaaccaccggaatggctgggacgtgcgctgctatacatcgccatagccattgtggggtttactttctgctggcgcagctggggcaaaatcgaatacctggtgatcgacatcatcgtctcgctgttcatcgcgctcgcggtggagccggtggtggtgccgctggtcaagcatggctggaaacgttcgttcgcgtcgctgttctcgctgctgatgctggccgtgatgctcggcgtgctgttcacactgttcggcaacctgttcgtgcagcagatgatcgccttggtgaacggtctgcccgacctgtatgagcagatgtgccagttcgccagtcagtacgcgaatttccagcttcctgagatcaataatctcggcaatgagattctgaagaacattcaaacgtcgtgggtcactgatttcgcgggtaccgcgctgaatacggtgtcgggattgttttcgttcctgattaacctcatgacgataatcatgaccacgtattacatttcagcggctggtccgaaactgcgtcgtgccgcatgccagtggatggctccggcggctcagcggcgattcctgttcgtatggacggtgagccagagccagatctcgtcgttcctgttctcccgcgccattctcgcgttgctgaacgcgttcttcacaggaatctgtctgatgctgctgcacgtgccctattggctaccgttggcgctgttctgcggtgtggtttcgcagttcattcctatgttgggtacgtatatcggcggcgcgttgccagtgctgttcgcatggggtagctgcggattgtggcaggccgtggcggtgctggtgtttatctgcgtgtatcagcagatcgagaatctgattttcgcgccgaagatctcccagcgcaccatggatgtgaacgatgccgtggcgttcctcgcggtgctggcgttcacctcgctgttcggcgcgttgggcgcgttcctcgcattgccggtggtcgcatccgtgcagacgatcttccgcacctatacaaagcggtacgagctggtcgattccccgctgatggacgatccggtgcctgaaaagaagtcgaagctggtggaaggtgccgaagtactcagcgagcatctgcacaatatgcctcgcgcggtgcagggatccagtgcgcatgtgcctattcccgacgaagtgcggcagttgcaggagcaggcgtacaatatcacccgttccgaggaatcgctggaatcggacgaaaccgtcgccatcccgaagcacgtgttggacaaaacggaacgcaagccattgcagggtcttgagagtgaaaacacatctcaggaatccaacgaaaatccggaatccggcaatgaacggaagaacggcgagtcgcgggaagctgaaggaagtacgaaaaacgcggatgacaatccaagaagtaggtggcgttaatggtactgctgagcgtacttgacattctgctggtcatcgtcggtggcgcaggggtggtctatcaggcggtgtgcattctcatctccctgttcaccaagccgatcaaatttcccgacgcgccgatggacaagcgttacgcggtgctgatttccgcacgaaacgaggcgaacgtcatcggcaacctcattacctgcatccaaacgcagacctacccgaccgaactggtcgacatttggcttgtcgccgacaattgcaccgacaataccgccgaagtggcgcgcaatatgggctgccatgtgatcgaacgcttcaacaaggagcttgtgggcaaaggctacgcgctgacgtatctgctcgatcagatgaacgattccggtgcatccgacccgtacgatgcgttcttcgtgttcgacgccgacaacaagctcgacaagcattacgtcgaagagatgaacaaggcgtttcagtcgggattcaagattctcaccagctaccgcaattccgtgaatttgtctgacaattgggtctcttccggttctgcattgtggttcatccgtgaatctcgattcctgtcggcctcgcgcatgtggctcggcaacagctgtcatgtagggggtactggcttcatgttctcgcaggagatcatgcgtcgcaataatggttggaaattccaccttttgaccgaggatttggaattcaccatggattccttgctgcacggcgaccgcatcggctactgcggtaccgcgattctgtatgacgagcagcctgtcaccttcgcgcagagctggcgtcagcgtttgcgttggagcaagggcttcctgcaagtgttccgttattacgggccggctttggtcaaacgcgccatcagggaacgcgatttttccgccgttgatttcacgctgctgttgtgtccgttcacggtgatcggtattgcgcgcgttctgctgggactgttgttcgcgacctgcggattcgtgacatggcagagccagttgagctcgttgaccggttggacgtccggcattgtgacgtcggtgatcggcatgatggcgttggccgcgttgacgattattgtggaacgcgatcagattggcgccaccaacaaggagctgttcgcgtatgtgctgagcttcccgatctacatgttcagttatgtgccgatctcgttccaggcgatgttcgccaagtccgaatggaagccgatcgagcataagggatgacgttcgttcgctggcttgcgcgttcctgccttttcgttttcatttcgatttcctcttatgactggagtgttgttgttccatggatgattcggctgaataccggcatgtgaaacgccgtcgatacatcacggtggcgctttccgtgtcgctcaccacagtgttgtgcgtcggctatgtcgtggccgacattttcgacaagttgccgggtgttctcacattgcaggaagtcgagcatgccacggccaaaacgccgggcaatgccattgcggccgcgacgatggtcggagggcttgacgcttcgaaaaccgtggatgccgttgcggcaaaggctctgatcagccagtttgagacggctgcctccgattttggcggtgaatacgccatcgccatcgccgacgcggctggcaatgtggtggccgagcagaatctcgacacgccgtatacgccggcgtccaccatgaaaacgctgacggcgtatgcggctgcggccacgctcgacatggggtcgacgttggagacgcagacctatttggagcagcgcgaagatggcacttcgcgattggtgctcaaaggcaacggcgacatgctgctcggcgtcgacgaatctgattcggcgcacatcaatgggcgtgccgggctgggaacgcttgcggcaaacacggcccaagcgttgcggcagcggggcatcacttccgtgacgctcgtctacgatgattccctgttcggcaacgaccgttggcccaacggcatcgccgaactcgatccggaccacgtgtactacgcgccgaccgcatccatggccgtggatggcgggcgaaactggaacggtgctaatcctacggatcccgatacgttcagcacatatcccgttttgagcacgcagccggctcgcgaggccgcgctggtgttcgcgcaacgcctgactgagcggggcattgcggtgaacggttccgtggaacagggagccgttcccgacgggaccagccccattgcgacggtgagctccgcatcgctgaacgagatcatggcgttcatgcttcggcattccgacaattcgctggccgaggaattcggcagactgctggctttgcaccttaacgccggcaattcaccggccggagcggtgcagtcggttgaacaggtactggctcagcgggggatttccaccgaaggcctcaccatggttaactgctcgggactggctgaggattccaaactcaccgcgcataccctgcttgacgtgcagcagcgtaatctgacgagcgggtccggttccgccgccgctgaggggctgtcgattgtaggatttgtgggcactgctgcgaatcgtttgaacgatgctgacgaagctggtcttatccgtgccaaaaccggcagtttgggagatgtgacttccatgaccggcaatgtgtcgcgccataatggcggtgcgttgagttttgccgtgatcgtcaacgatcctgatgattccgaagccgcgaaatccgctatcgacacatttgtggcagcactaccgaagttgtgacgccatggtgtattcgtcacgtttgcgcaagggaatcggcgaactgcgcgccgcgttggaatcggccggtttgggattgcaggatgcccgtttcgcccgtcatggcgagcacgcgcccgatgtggacgctccgctgattatggtgtcctgttccggtgggcgcgattcgatggcgttggctgcggttgctgcgaaaacgtgcgcttcattgggattgcgatgcggggcgattatcatcgaccaccagttgcagcaaggctctgccggtgttgcgcgggcaaccgccgatcgttgcgttgcgttgggtcttgacccagttcgtgttcgtgcgattgacgtacccgactcccgcggcatcggtgttgaggcagcggcgcgtgaagcgcgctatcatgcgattgtcgacgcatgctccgacgcttcggccgtgcttctggctcatacgaaaaacgatcaggcggaaaccgtgatcatcggtttgttgcgttccgcgggcctcgatgcggtttgcggtatgaacggttccttcatacgagacggggtgcgttttctacgcccatggctgaatgtgacccgcgaagaaaccaccggcatctgcgaggatctgcggcttgcctggtgggacgatcccacaaatgggccggatgtgggagattcgggtggaaatgagcctcttcccgcgaactatccgctgcgatcccgaatccggcacgatctcatgccatatcttgcatcattcgcgggaagtgacgtcgtgtcgaaacttgcgcttggagcgaggcttgccgaagacgatcgcgcatatcttgacgatgtggcgcaacgcgtgtgcgagcaaggcgtaaccgtgaacaacggcgagataatcatcgacgtgcgtgcgttgcaatcgcaagacattgccatcagaagacgggtgattgtgcgctcgcttgcagaagcaggcatttcgtgcatggcacggcaggttgaagggatcgacaggctgatctgcgactggcacggccagaaaggtgtgaatcttcccagcggatattcagcatatcgccagaaacacgtcattcgcgtgtgccaagatggtgggcatgcgaatcgctgacgtacaagaagatattgatcacgagctgatcagtaaagaagagattgccgacatcatcaaccatgctgcagcccaggccagtgaagactaccgtggcaagaacccgctgctggtttgcgtgctcaagggtgcggtgaacacgcttgcggcgttctcgcaggccatgagcatccacgcggagatggatttcatgagcttgtcgagctacggttccggcactcaatcgagcggcaagatcaccgtgcggcaggatctgtcgaccgatgttcgcggtcgtcacgtgcttattgtggaagacatcatcgattcgggcgtcacgttggcgtggctcgtcgatgagctcaaaagccgtggtgccgcttccgtggagatttttgcgctgttggaaaagccggcgcgccgtaaggtggatgttcctgtgaaatataagggacgtgagattcccgatgaattcgtggtcggtttcggcttggattatgacgagcgataccgcaatcttgattcgatcgcggtgctgaagccggaagtgtatgaaggaggtcaggcatgagttttcctggtccgggccagtcgccgaataacaacggcggcggcaataacccgttcaccaatccgtttggacgcaataataacgccggcaatggcaacgattccaacggcaagggtgacaagtccaacggcaacggatccaatggcggtccgcgtccgttctggcagtccccatggctgtgggttgtggttgtggcattgcttgccgtgaccatgttccagattttcgccggaaccggttcccagaccatcgacaccaaggacggtctgcagattctcaacggcaacaatgttgaatacgcacagatcgtagacaacacccagcaggtcaagctcaagcttaagagcgactactccgctacagaccctgataccgggcgtatgaagaactacggcaaaaacgtgcagttctactacacgtacgcgcagtccgcaaccgtggtcaaggccgtacagaaggctgatccggtcaagggctggacggcgaccatgcagcagagcagcatttggacgtatctgctgacctcgctgctgccgttcctcattatctttggtctgttctggttcatgatgagccgtatgggcggtgctggcggcatgttcggtatgggcggcaagaagaacagcggcaagctgctcgaaggccagaccccgaccaccaagttcgccgacgtggccggcgaagaggctgccgtgcaggaagtcgaggaaatcaaggacttcctgaaggatccgtctcgttacaaggctttgggtgcccgcattccgcgtggcgtattgctctacggccctccaggtaccggtaagacgttgctggcacgagccatcgcaggcgaagccggtgtgcctttctactccatggcaggctccgacttcgtggaaatgttcgtgggtcttggcgcctcccgtgtgcgcgatctgttcgatgaggccaagaagaacgctccggccatcatcttcatcgatgagatcgatgccgtcggtcgtaagcgtggcggttccggtatgagcggcggccacgacgaacgtgagcagacgctgaaccagctgctcgttgagatggacggcttcaataacgacaccaatctgatcatcatcgccgcgaccaaccgccccgacgtgcttgatccggcactgcttcgcccgggccgtttcgaccgtcaggtagccgtcgaagcgcctgatttggaaggccgcgaggctattttgaaggtgcatgccaagggcaagccgttcgtgcctgatgtcgatctgcgtatgatcgccgtgcgtacgccgggctttaccggcgctgatctggccaatgtgttgaacgaagccgcattgttgtgcgcccgcgccggtgcgcagctgatcgacaaccgcgccatcgacgaggccatcgaccgcgtgcaggcgggcccgaagcgccgttccaagggcatggcgctcgacgaactgcgcaacaccgcataccacgagggtggtcacgcgctggtggcggctgccatgaacgataccgatccggtcaccaaggtcaccattctgccgcgtggccgcgcacttggctacaccgcggtgatgccgactgaagatcgctattccatgtctcgcaaccagctgctcgaccagatggcgtacgccatgggtggtcgcaccgcggaggaagtcgtgttccacgatccgaccaccggcgcttccaacgacatcgaaaaggcgacgaacatcgcacgtcagatggtgctcgactacggcttctccgacaagctgggtgccatcaagtggtccgatgatgaacagagcgaccttggatcgctgaaccacaagtattccgcacgcaccgccgaaatcatcgacgaggaagtgctcaaactggtggaaaccgcgcataccgaagcgtggaacgtcatcaacgagaatcgtgagattcttgacgagctcgtacgtcagctgctcgtcaaggaaacactcaacgaaaaggaacttgcggaaatcttcgctaatgtcaagaaggcgccgaagcgtgaagtgtggctgagcgacagcaagcgcccggattccgacattccgccggttccgattcccgaatccctgaagaaaagcgcaggattgaccaactgatgagcgataccgaagcattcgataccctcttcgacgacaaggcccgtgccgcccatgcggccgggcctgtcggctatgacgaggaaggcgtgcgccaggcagtacgcctgtttctgaaatccattggcgaagacccggaccgtgaaggcctgctcgacacccccgaccgtattgggcgtgcctgcaaggagctgttcgcaggccttggacacggccccgaggaagtgctcaaaaccaagttcaaagtcgataccgacgaaatggtgctggtacgcgatattgaactcttctcggtatgcgaacaccacctgctgccgttccatggcgtggcccacgtcggctatattccgtcgaacggccaagtggcgggcttaagcaagcttgcacgactggtggaactgtatgcccgacgtccgcaagtgcaggagcgcctcacccaacaggtggccgacgcgttgatggaaggtatcgaagcacgtggcgtgatcgtagtcaccgaatgcgatcacatgtgcatggccatgcgtggcgtaaagaaggcgcaatcgcgtacggttacatcggcggtgcgtggctgcatgcgagacgcgacgacgcgagccgaagccatgagcctgatcctgtcgcagcatgcgtgatcggcgcgactgcagcaagtcgaatcgtaaataccaataaccggatataggaggggaaaccggatgaccattgatatgaaatcgattcatgatagtgaccgtacgctggtgatgggcgtgctcaacattacggaggattcgttctccgatggtgggttatggctcgatcctgcgaatgcgaaagcgcacggcgaagcgatgatgaaagatggggctgacatcatcgatatcggcgccgaatccactcgccccggagccaaacgtgtcagtgaggaagacgagcagacccgcgtgctaggtgctgtggatgcgctgattccggaaggcgcggtgctgtccatcgacactacgcacgcatcggtggctcgcatggcgttggagcacggcgcgcagatcatcaacgacgtgtccggcgggcagttggaccgcgaagtgccccatgtggtggccgaacacgcggaaagcctttacattgtgcagcattggcgcggttggcttgccggctccgcaggcgacgtgcctgacgctaatacgtccgtgtacgccaatggcgtggtgaacgacgtgtatgacgaactcatgaagcaggtcgacgacgtgcttcaggcaggcgtctcgacgtcacagatcatcatcgatccgggtcttggattctccaaaccgagcgtcgaacataacttcccgctgatggtggcgttggagcggttcaacgccaccgggtatccggtgctgatcggagcctcgcgcaaacgattcgtcggcgcggcgcttgccgatgccggtatcgacgagccaagcatgggcagcaaagacaatgcgaccgccgccatcagcgccctgtgcgccgaatatggagcgtgggccgtgcgcgtgcatgacgtggagaaaagccgtgacgcggtggcgatcggcaacgcgtggcgtgctttcgccaacgtctgatacgcgcggtgggcgcatacgttcgtatgctcttgactgcgtaggcacggcaacgcctcacatcactaaaaccttgagatatgcaaagaaaggctggcatggatcagattcgattgactggcgttcgcgcggtcggcaaacacggtgtgcttgatttcgaacatgagcgtgcgcagacgttcgtcgtcgacgccacgctgtttctggatcttgcgccagccgggcattccgacgatctgcacgacaccgtcgattacggtgccatcgccaaaggaatagtcgccattatcgaaggcgatcatgtcgatctcatcgaaaaactggccgatcgcattgccagcatgattcttgaatatcctgccgtggcgcgaacgcaagtgaccgtgcataagccgagtgcgccaatcgtcgtaccattcgacgatgtgagcgtaaccgtggaacgttctcgtgaaacaacttcggctgcatcgcaagtgcatcatgccatcattgccatgggtggcaatcagggcgatgtagtggccaccttgcgtgacgcggtgcgttcgatcgacggactggcgtccactcaggttacgggcatttcgccgctgtaccgtaccgatgcgtggggcatgcccgatggtacccccgacttttacaatgcggttgtttccgtgaccaccaagctatcggcaatggagctgttgcgaggattgcagcgcatcgaagccgaacatggtcgagtgcgtaccgaccattggacttcgcgcacacttgatctggacatcatcgattttgacggtcagagcagcgacgatccggacctgacgctgcctcacccccgtgcatggcagcgtgcgttcgtgctggggccgtggctggcactcgaacccgatgccgaactgccgggcgaacatgccggttccgtggctcaactcctccatgaatcgaccgatcgcgaccatatcgacgaaatcgcagatgattggatggtggaaagcccgaccggctacggtaccgacgaccttgcctgcgatgccaataatgcgggcgatgcggatgatatgggcgaagcgtatgatgcgatcgattccagcgatttgccggaaggaaccgccgcagccaaagtggccgcactcgcttctgcacagctagaacccgcatcgaaacgtgcggtgatctcactggacagcccagcaaccgatgccgaacagcagttccgcatggccatcgtcacattggacggcattcccggcaaccaagtcgagggcatctcacccctctaccatgtgagccaactcgacggactccccgacaaaatggccgcggtaatccagatttccacgcgcatgggcgcccatgatctgatcgaagcattaagcaatgtggaagcctccgtcggcgaagacttcgatctcgacctgatcgacatggaaggcgtgacatgcgatgagcctgactgcaaggtgccgtggcccaccgcacgcaaccatgccgcagtgcttgcgccatggctcgacatggatcccgatgcgcgactgggcaaggatccggtatcattcctgctggccatggcccccgataccgcgcaagtgggactgctgaccgacaattggatcatcggaggtacgctatgaaagcgcgcagaaccccttggtggtgctatgttctcgctgccgcattaggattgctggccggtatgggattggcgaaatatggcgagatttcaggtttgccattggtcggcgctccatggatcgtgcccgtggtgttggcgattctgggattcgtcgtgctgtatatggcattgcagatccacaaatacaccaccacggatcccgaaaaacgcgcgcagctgaaacctttggacccgcagaaggcgttcgccacactggtgtcatgcaaagcgttgggcgtggcaggagcggcgttggccggctggtatggtggacagctcatcatgagcctgccacatggtgaggcgacgttctacagtcaggccatcctcgaatgcgcgatcgcggcaatcgtatgcatcgctgacatgatcatcggcattgtgggggagtggttgtgtcaaatcccaccaatcgacggtccggaaagcccgaaaatgaaaacggccacgcaacgaaaccgttacgcggccgcggcaaccaaatcggcaacccaaacgaaagcctgattgtccttacttcttcaaatcctcctcaggaacacggatcatcgcctcctgagtcatgcaggcaacaagctcgccatcctgcgtgtataccttcgcctgccccaagccacggccgtgagccgcggtaggcgtatcctgcacatacaaatgccactgattgatgtcgatatcgcgataccaccacatcgaatgatcgatcgaagcgaacgaaatgccaggcgtggcaatacttaacccggcacgacgcaacaccggctccagcatcacctgatcgcaacccatagccaacatcgcacgatgcatgacctgcggaacgtcaaccgtgccgtcggccttcatccacaccagctgcttgccggaatcgttactggcgctcttcttatcggcacccagcatgatcgtgcgcgtcacatgacgaatgtcgaacggcgacttttccgcatagtatttggcatacgaagacttttcggcaaacggctccatcagctgcttcgcactggtcaacgtttccggttccggcacgccttccggcatgggatcggcgaactcaatgccatcctgaccctgctcctggaagctggcgatggccgtcagaatcgaaccctgagcctgcgtgacattcacgcgacgagcggaaaacgagcggccatcacgcagattctccacatcaaacagcaaatcctgacgaatatcgccggcggaaatgaaatagccatgaatcgaattcggcagacgagatggcggaaccgttttggatgcggccatcatggcctgcgcgatcacctgaccgccgtacacgcggccagtggggaaatacaggctttcgccattcacatatgtgtggctgcggtacgtggaaggcgtgcccagctgaagcaccttcgccaaccgttgtaacggagttattgctgtctgcgctgtctgtgtcataacgggcctcgattctttgagtcgcatacgataaacgcttcgttctggaaacgagtctacgcaagggcggtaaatttcgccggattgttttgtaacgaatgcgtgagaagcgtgaacggcaggtaatcgtcaaacgattcacatacggcaaagcgccgcacttcgtaacgaagcacggcgctttgctgaaatttgcgagtaacgttcgcaattatggtcttgtttcgcaaggctcattgttgccttcgttcggctgtcgcctcactcaggctaagcctacagacagtccacaggactgtctgcttaacggctagcctgtggccctgcaattatggtcttgcttcgcaaggctcattgttgccttcgttcggctgtcgcctcactcaggccaagcctacagacagtccacaggactgtctgcttaacggcttagcgcgttagcttgcgatggagacggtgggggcgagccgcgtcttcgccgagacgagcgacacggttctcctgataggcctggaagttgccttcgaaccagtaccacttggccggattctcatcatcgccttcccacgcgagaatatgcgtggccacacggtcgaggaaccagcggtcgtgagagatcaccacagcgcagcccgggaagccgagcagtgcgttttcaagcgattcaagggtttcaacatcaagatcgttggtcggttcgtcgagcagcagcaggttgccgccctgcttcagagtcaaagcaagattcagacgattgcgttcaccaccggacagcacgccggtgagcttctgctggtcggaacccttgaaaccgaaggacgccacatatgcgcgggtcggcacttcaacgccggcaacctcgatgaagtcaagaccgtcagacacggcctcccacaggtttttattcgggtcaagaccagcacgattctgatcgacatagctgatctgcacggtctcaccgatcttcagtgagccagacgtcaacggttcaaggccgacaatggtcttgaacagggtggacttacccacgccgttcgggccgatcacgccgacaatgccgttacgcggcagcgtgaagctcaaatcgtcgatgagcacgcggtcgccgaacgccttgtgaatatgctcggcttccagcacagtagagcccagacgcggaccagccggaatctgaatctcggagaagtcaagcttcttattgttacgagcctcctgctccatctggtcgtaacgttccagacgagccttgttcttagcctgacgggccttcggcgaagaacgcacccaatcaagttcgctcttcaaacgcttggcgagcttggcgtccttggcgccctggatctccatacgcttggccttcgtctccaagtacgtggtgtagttgcccttatacgggtacagctgaccacggtcgacctcgcagatccactcagccacgttatccatgaagtaacgatcatgggtaacggcgatgacggcacccttgtactggtgcaggaactgctccaaccacagaatcgattcggcatcaagatggttggtaggctcgtcaagcagcagcagatcaggagcttccagcagcagcttgcacaatgccacacgacggcgttcgccaccggagcacaccgtcaccggagtatccggatccgggcactgcagagcatccatagcctgctcaagctgagaatcaagatcccaaccgtttgcagcatcgatatcgttctgcagcttgcccatctcatccatcaaagcatcgaaatcggcatccggattggccatctcttcgccaatctgattgaaacgagccaccttttcagcgatctcaccgaacgccatcttgatgttctcgccaacagtcttggtgtcatccagcggcggttcctgctgcagaatgccgacggtataacccggagtcaaagaagcctcgccattagacacggtgtcgagtccggccatgatcttcagcagcgtggacttacccatgccgttcgggccaacaacgccaatcttcgcgcctggcaggaagctcaaagtcacgtcatcgagaatcacacggtcgccgaaggccttgcgggccttgatcatctggtaaatgaattcagccaatgttgtgttccatccttaagaaacgttggaattccagcgtgttgcatgagcggtcaacggaaactcaatcaaggattccggaacgcaacccacgcacaataccgtgcataattatcccataccccatctacacggcggtatgggcgaaagtcgtgcgctcaggcagtaagcggaagcagcagatgctcatgcaacgcaggacgaacgacattgtcgaaatcgccagattccgggcattgaatcgcaacaaccaaaccctgcttcggcaaaaccgtagtgatctgaccgtacgcaccatccgcacgatatgccccctcataaggcgacatccagaactgatagccataaccgcacgtccaaatattgctatacggagtgtcgatctgcttaccggaagcctgcttgacccacgattcgctgacaatgcgcgtgccatgccaagtgccatcattcaaatagacctggccaagtttcaacatattcgcaagcgacatgtagatcccgccgcctgcaatcggatgaccttgcgggtcacattcccaaacaggccaaccctgatccaacttggaaaaaatcatgccatacaaatactcgccaagacgcatgccggcagcctgctccaacatgcggcccgctaaatcagaatccgcagacgaatagcagaacgtgctgccgggctctacctcaaccctgcgagagaacatgtaccgtaaataatcaggcgcaccaacaccactgcgccggtcagggttcatcaaatacgcatgattgaaaccgctcgacatggtcagcaagtgcctcagcgtgatctgacccaactccagttgcgcatcggagggaacatactcagggaatgagtcgaccaatcgcgaatcgagcgacagcaagccatcttcaattgcaatgccgatagccgtcgaaacataacttttcgtatgggaataaatattgcgatcctggtcgggaacgaaatgacgttccgcgataatgtcgtcgccatccgcaatcgcaacggcttcgacgggcagggactcgctttcaatgagtttgacgaaatcgttgaacatatcgatggcacccatgaaatctcctttgatactgccttacggtgcattacggaaactgtaacgtaaggcggttacgtatgattgttacatcaaacgatttttcctaagcctgtcgctagatggagcgcccgaaaagccgctaggtgccatgcctgaaaaagtcgttaaatgataatgccttcgcaatgatcgatctcgtgctggatgatctgcgcggtgaaaccagtgaatgtggcatgacgctcgcggaacttgcgatccgcatacgagacctcgatgcgctggaagcggaccgtgcggcgctcgcctttgagagacaggcagccttcggaggcgtcgtaggcgccgtctttcgcagtgatcgtcgggttgaacattacgaagatgcgaccgccgaaatcctcgtccacgaatgcaatgatgcgcttcgagacgccgatcatgtttgcggccatgccgacgcagccgttgcggtgtgcgtcgagtgtgtctttgagatcctgcgcgacggcaagatcctcgggcgtattgagcgcctccgccgacggctggctcaaaaatggaatggacgtcatgatttcgcgctgcatgtgatgtttcctctcgctggttcctttgctggtctgccaacattgtatggcgttattgtgcgacgccgtacggcgatgggacggatgaccggttcgtgcctatccatttacggaatgtctcgtggcgattttgaaatgtgggaccgcaatcgacgcaatatgcttggaaccatggatgacatgcctcaatatcggaaatacatgacgcaggcgctggaactggcccataagggagccggttgggtgaatccgaatccgttggtcggcacggtggtggtccgcgacggcgagattctcgcagccggataccacgaccgctaccgcggaccgcatgcggaacgcatggccttcgactatgccgacgagcatggtgccgacatgcatggagccacggtcatcgacactctcgaaccttgctgccatgtcggatcgcagccggcatgcaccgatctaattctttcgcacggcataacgcgcgtcgtggtcggttcgatcgatccgaatcccatcgtggccggcaaaggactttgcattcttgaggaaaacggtgtggaagtggtatatgacgtgatgcgggcggaatgcgacgccatcaatcgccatttcttccactacatcaccacaggaatgccgtacattgtggacggcagaaaacatgcggaggaatctgatgccgaatacgctgtacgtcgacgcgggctatatgacacgtatgcggcggtgttgggcatatgtccgattggtggccgtgcgggtgccccgggtaattcgaacggtacggaaggatcggtgggaagtgccgcacgccttccgggtcggacggatcggctggatgtttcagatggtgcctttgcccatttcgacggaccggtccaagctgtggatgctaacgaggtggtggtcggaaggcacaagccgttgcatctcgacatccgttcgctcgccgatacggaacccgacgaatggctgcgcgaactcggccgccgcaaaatcgatagcctcgtcgtcgatgatgatgacgttttcgaaatactgtcttcgatctgacgaaaaagggatatgcctatgccgtgttttcagtttgaaatgtcctatatgtggcagtttttggcatttcagaaaaatgatttccgttatatgtggcagtctcccaaggaaaatctcgtctagggggtactgattggggtcttttgaggcttgaaaccggtctggtctgccacatatagcggttttggtttttctggggatgacaaatctgccacatatagtggctttcagatgagaatctttctgcttccattggcgagagacgttatacggatgtgtatcctccctgaggacattctttgacagagcatgacgggcttgcttaatcgttggctcatccggtcggccacacgttgcgcgagtgcccgttcctcgaagtcgttcataaggttttcggcggtcacttgaatgtatgcccaaccgtcgtcttccaaggcttcacgtctcttgctgtcggcgagccattggctggcgtgatgtctcccgtcgtattcgatggccacttttatatctggataggccatatccaaaagcacgattttcccattgttcagtcgaaccttccagttgacttgcggacatggtagcccattgcgaatcagagcgatcctgcaacggctttcctgcgaggaatccgtgccttcgcgcatgaactgtaacgcatgttgcatttttctgattcctcggatgggacgttgtccattcgcattcgaaaaacagtggataagtggataaccgaggttatgcgcgaaaaaatgtggacaaacagtcggccgccggcatgtctgattgagacgaacgtgcgctgctgcgctgctgcgggataccatggcacgggtagaacatcacgttgaaatgaggatgtatgggcgagccgtgtgtgattgaaaacgtgtgtttcgtaggttcggataagccggtcgacattgctgtcggtcacgggcgaatagcttcggtgcgaccttcggaaaggacaacggatgctgcttcgaagatatgggtgattcccggattgtgggactgccacacgcatttcacgcagtggtcgtacacgttgggacgactcgatctgattgatgcacgcagtgccagcgaagcgctcgacatgttgcgtcggcacttggaggagcgtcgtgaaagcggcgcactcgacccgaaccaatatgtggtcggcatgcgcttccggcattccctgtggtccgatgacgcccagccgaccctggccgcgatcgatgcggtggcgggagaccagccggtggcgctgtcaagtgccgacatgcattgcggttgggtgaactctgccgccgcgcgcaagcttggcgtagatgtggacgaatccggactcgtcggcgagcttgagtggttcgacgcctactgcaagctggacaaaggacctggtgcggccaatgagctgatgcatctgttgcgcaacgccgaacgcgacgctgcgagcaaaggcgtggtcggcgtgcgcgactatgagatggcggagaacatcgacacgtggattagccgattctcgcaagggcttgatggtctgcgtgtcgaggctggcatatatcccgagagactccggcaagccatcgatgacggctggcacaccggagacgaattgcccggaagtcatggtttgggccacgtcggcgcgatgaagatgatctccgacggctcgctcaacacccgttccgcttactgttccatgccatattcgggcatcagaccggaaacctacggcacattgagctatgcccctgagcaaatcgagtcgtacatgcgactcgccgtcgaacatggcttcgacatcgcctgtcatgccatcggcgatgaagcgaacaccattgtgcttgattgtgtcgaacgcacccatgcgcatggttccattgagcatgcccaaatgctcaaggagcgcgacattccgcgactcgcgcagctgggacttgccgcaagcatccaaccgcagcacgccatggacgatcgtgacgtcatcgcgcgattctggggtacccccgccggaatcccttatgcattcaatagcctgcataaggcggggaccaaactgctcatgggttcggatgcgccggttgcgccgctggacccatggatggccatctccgcggcggtattcggtacggaaagttccgaccgcgagcctttccaacctgagcagtgccttgattttgaaacggcgctcgcttcgtccaccgcggtcggacgcgtggctttgcgggacgcagacgcggccgatttggtgcttctggactgtgatccgagcataatcgattctccggaggccatgcgtgccatgcccgagcatgtgcttggcactatgcttgccggtcgctggacgtaccaacaggctgaatgaaaaccgttatgtgtggcatattccacggtgctggaaaagtcaaaatcgctatatgtggcagacctgagatttcttaacgggattttttctatagatttataccctcgaatgtagtgtgaatctgccacatatagcgcaaatcggattttgaagatgccttaatctgccacacataagggatttcagatgattggcgcgcccgtgcaagatgagtatgacgtgcgagtctactcggataggaggaagaccgcacctctgagtgggggatacggccttcctgatgtgattttgagtgagaatcactgcacggcggcgagtgcctggtcgaggtcggcgatgatgtcgtcggcgttttcgatgccgcaactcaaacgtaccaggtcaatgcctacgcccgcctcaatgagctgttcctcggtaagctgacggtgcgtggtgcctgccgggtacagggtgcagctgcgggcgtcggccacgtgcgtggcgatggacaccatcttcaaatggtcgaggaacgcggacactttttcgcgtccgccaggcacgccgaaggagatgacgccgcaagtgccgttcggcatgtacttttcggccagcgcatggtatttgtctccctcaaggcccggaaagctcacccagctgacgcgcgggtcagcgctcagccactgtgccaccttgagcgcgttcgcgcagtggcgctccatgcgtactcccagggactccaaatgcatgcccatgatccacgagttgattggtgccggtgttgagccgaaatcgcgcataagctgtgcggtggctttggtgatgtaggcggccttgccaaaatctttggcgtaggtcacgccatggtaggagtcgtctggtgtggtgagtccggggaatttctccgcatgagccatccaatcgaagttgccggaatccacgattgcgccgcccacgcaggagccgtgaccgtccatatatttggtggtggcgtgcgtgacgatgtccacgccatactggaatggacgacagttgactggtgtggggaacgtgttatcgacgatcagtggcacgccgtggcggtgcgctgcgttcgcgaacttttcgaaatcaagaacgatgagcgccggattggagatggattcgccgaagaccgccttggtgttcggctggaatgccgcttcgagttcttcctcggtgcagtccgggcttacgaacgtgcattcgatgcccattttgcgcatggtcacgttgatgaggttgaacgtgcctccgtagattgcggaggatgcaacgatgtggtcaccgttgttgcagatgttgaagagtgcgaaaaagtttgccgcctgcccggatgaggtcagcattgcggccgcgccgccttccatttcgcagattttcgctgcgatggtgtcgttggttgggttctgcagtcgggtgtagaagtatccggattcggataggtcgaacagtcggctcatctgttcgcttgacttgtatttgaaggttgtcgcctgaatgatcgggggtgtgcgggattcgccgttgccgggctggtaacctccctgcacgcagatggtgtcgacgtttttgctcatggatttccttctttcgattgggtgcttcgttgcgtagcgctgcggtgcaacaaacatgctcaccttatcactgagttgataattggctattcttcaatggaaacgccgaatagttcactgaattgacaaacttaggaaattgattttattatatacatcaaggcaggcgggaatccgcttgacgggaaaacaatgtcttgcgaaagtaaaatcaatagcaaaggagcaacccatgggtctgtgggatatcgaaaagattccgtatgtcggtcgtgaaaagggaccgcaggagggtctggctttccattactacgatgccgacaaggttgttgccggcaagaagatgaaggattggctgcgttttggcgtcgcttggtggcacactttcgatcaggagctggtcgatccgttcggcaccggcaccgcccagcgtccgtggtacggcaagtactccaatgctgaggatgaggctctggccaaggtcgactacgccttcgagttcttccagaagctcggcgtcgagtacttctgcttccatgatcgtgatatcgctccggaaggcgataccctgcgcgagaccgacaagaacctggacaaggtcgtcgacaagatcgaagagaacatgaagtccaccggcatcaagctgctgtggaacacctcctccctgttcaccaacccgcgcttcgtttccggtgcttccacctccccgttcgccgacatctatgcttacgccggtggccagctgaagcattccctggagattgccaagcgcctgggagccgagaactacgtgttctggggtggacgtgaaggctacgagaacctgtggaacacgcagatgaagcgcgaacaggcgcacatggccaagttcttccacatgtgccacgagtatgctcaggagatcggcctggacgctcagttcctgatcgagccgaaggccaaggagccgacgatgcaccagtatgacttcgatgcatccacagccatcgccttccttaagacctacgacatcgacttcatgaagctgaacctcgaaggcaaccacgccaacctggccggtcatacctaccagcacgagatccgcaccgcccgcgaggccggtgtgctcggctccctcgatgccaaccagggcgacaagctcatcggctgggatatggatgagttcccgaccgacctgtacgagacttccaccgtcatgtgggaggtcctcgccgagggtcagatcggccctcacggcggcctgaacttcgatgccaagccgcgccgtacctccttcgccgccgaggatctgttccgctcccacatcgccggcatggattccttcgcggccggcctgctggtcgcggccaagatgcacgaggacaaggtcatcgagaacctgcaggccgagcgctacagctccttcgattccggcatcggcgcgaccgtcgagaacggcaccgcctcgctggcttccctcgaagagtacgctctggatatcccgcagtccaagctcatcgaggccaccaagtccgatcacctcgagtccgtcaaggccacgatcaacaactacatgatcgacgccctggccgaggcgtgagccgaaatcgagcagtggttgggtgcgcgtagcgctccgaaattgccggggcgggcgtggcccaacaaggagttttctctaggactctgatttatcgctggattaaacagcgaggctcggttgcaacaaagccgaatatggtgtgtcgaagcgttggtgctccggcacaccatatattttcacctcatccttccttaaatttccttcgcatacaagtcgtctgccggctatgtcgtcggtggacgacttacatgtgttatgaaagcaagtcgaaaatttcaactattcgcaatgatacgatgtggaaaagcgtttctgaataaggtgtatttatgaccgcgactattaccattaccaatcccattcttagtggaatgaatcctgatccgagttggatttgggatgatgagttccagcgaattgtgttggtgacttctacttttgagcttgtcccaggtcttcccatttacgtttccgaggatatgacgtgctggaagcatgtgtcgaatgtgatagatgctgacctggcaaggcgcctgcttattcccttcgtggatgattcgggcggtgtctatgcgccgacgctgcgcaggattcatggcaaatatgtgattgcatgcaccattgcccgtcttgatgatcgccgtgctatggaaggtggttgcacagaaagcgagctgatgcggttccacgccgcggagggcaattttatccttgaagcggattctatcgaagggccatggcatggcccgttctggattgagggcgctgaaggcatcgatccagacatattcgaggacggggatggcaacgtgtactggacccagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcgccgcatggactgcttcgggcgttcgaagcttacgaacgggaagtatccgaattgggtgagtgcattccgcaggttcgtgacggggaacgctgctatcttggcgccgcaatccgtgccttccacgcggataagaagaatccgattctcacccaccgacatctgggtttgtcggaaccgctgcaatgcgtgggacatgcggacctgttgcttcatccggaactgggatggtggctggtgtgtctcggcgtgagagagacacggggaaagcgtgacggcgaattattgagctacttgggaagggagagctttgtcgctccggtatcctgggaacataatccggccgattggaagctggacggcaacggtgcatcatatacgcatgagggtgaccccggatggccagtgacttgcgctggtcttggccgcttggccgacgagatcacggttactactgaagacgatggcatcgccatcgagcctagggtgaaatcctcgctcgccggtgacgtggaacctgcgctggtggatgtggctgatggctcgacgagcgatgtggtggtgcgcgatgagcgtgatgtcagctaccgcagaatagcgaaactgccgacgctcatgccgattcccatgtccggttctttagtgatccggcagaattccacacattacgcggtgttttcgatgcatggcacggatgtgcgctacgagatggtgaatggagacgattcgcaagctgggtctgttgccgtacaggctgacggagtgcgtccggcggtacttttcgacgacaaccgcttgtcggtcatcgtgactggcatgcatggtttggttgattctgcgacgttcgtgcgtcaggggcaggtcctgctgagtgtcgatgctcgtttcctcagcaccgaatgggccggtgggttcgtcggttgcatggccggcttcatggcatagtttctacggaatttcaggatggttcactgctggtgttccgacgggccgtcttagaacgagttgaaaacgggtcgaaaggctaggagcgctgtgttctccctccggttgtgcctgtgaggtttgccccgctgattaaccttcgagttgctgtgtgctgttgcgtaccactagcgatgtcggcatgatgatgtgcggttggatcacgtcggtggacagcgcttcgaccagcatgcgtacggcggcccttgccatgtcttggagcggctgtcgtacggtggtcagcgccgggccaaggaatgcggcagtctgcacatcgtcgaatccgaccacggataaatcctcgggaatacgtaatcccagctgccttgccgcctcgtagacgcccatggcctgcagatcgctgccggcgaagattgcggtcggacgattcggtcgtttcaacagggagatggactgtgcgtaaccgccggaagtggtgaaatcgccttcggtgataagttcgggatcggcttcgatcccatgttccgcaagcgctgatgtatatccgtccagacgtgctttggaacacatcatctcctccggtccggtgatgatgcctatgcgggtatgtccgagtgcgagcagatgcctggtggcgattacacctccggtccagttgtccgcttgcaccgacagcgtgtctggatctggattaccgaatggatcgaacaagacgaagggaatacctctggaatgcagtttgttccgctcgatacgtgtcagactggagaagacaagaatggcgccatccgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggctttttgcacctgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcttttcatcatatccgaaaatgcgaacgaaagtttcggtttacgtttttcgaaactttcgatatgttggcaatgcttaaaaacgttgtaaaatcaacgaaaaatagttagttttctgattttacaaaaaacttgactttgtgtgatttgtttcggtagtctgtaggtacaacgaaaacgaaatggagactttcgaagggagtcaaaggctgattctctgtctgctaggggagctgcagcagcattcgttgcggtcatgcttcccgattcgacccactcgagagaagtcgttcctgtcgttgccatcattttgtcgatgatgatttggtcaataaggagaagacaatgaagttcaaaaccattgcagctgccactcttgcggtggcgaccatgttgggcatgggtgcctgcggctccagcgctggcgccaaagacgataagactattacgttctggcataacgccacagctggtgacggcaagcagtattgggaggatctggccaaagcgtttgagaagaagaccggtgtcaaggttcagattcaggccatccagaacgaggatttcgaaggcaagctgaccaccgctatgcaggatcccgcctccggcccggatgtgtacatgacccttggtggtgccaagaccaaggacatggttgatgccggccaggtaatggatatttctgataagattagcgataccgtcaaaaagcaaatgtcttcctcattggaatccgtgtcttatgacggtaaggtctatgccgttccggtcactgtccagcctggtggcatctggtattccaaggatttgttcaagcaggctggcatcgatgccgtgccgaccactttcagcgagctgaagaccgatgtgcagaagcttcgcagcgctggcatcgagccgattgcactcggtggcaaggatgcttggccggtcggtcactggtactactggttgtccatgcgcgaatgctctccgaaggcctacgccaagggcgttaatgacaaggacttctccgactcctgctgggtcaaagccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaggctatcctcgaagctatgaaaaagtctgatggcatgcagctgtggatggataccgctctcggcggcaacatcggcaacgcgctcaactccggagtggtgaacttgctctcgggccagggcacttccgccgatatcgtcaaggcgatgaaggacgcagcgtccaagggctgatagtgaacatggctggttgacggccaaaggagggtggatagacagatcttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggctacggacttccctccaagacaggtaaattcgttggtttccagaactacatcacagcgcttaaggatcccgcgttccaggcggcgattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctacagaagaagggcgccatcaatgagattctggccaacttcggcatcaatggtcccgattggctggccgacccgaaaatcgccatctggacgctgctgttgctgatcagctggaaatacgtcggtttcgccgtaattctgatgctcgccggcatgcaatccattcccgatgaactgtatgaagcagccaaagtggatggggcgagtttctggcagatgcaaaggagcatcacgttgccgttgcttgctccgacgttgcggatctgggtgttcctttccatgattggctctctgcagctttttgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaggaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgtatcactccggtgttgtacattatcttcggcggtttccgtaccaattcgcagatcaccaaccatccgtccgggatgccgaacccatgggtccccgacaactacaagacggtcgtcaaaagtgatattttctggacggaactgaagaattctaccatcgtgggtatcgccaccatggtaggcgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcattatcttggtgccgttcctacagtcgattcctaatgagcttgaggaggcctgtcttctcgatggatgctcccgccttggcttcttctggcgcatggtcattccgctgtccatgcctggcgtggccaccactggaatccttaccttcgtgggaagctggaatgcctacatgctgccgctgttcgtgcttagtgatgccagcaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacggaatgtgacaacccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggatggcagattctggttgatctacactgatgtcaaggtggtcaatggtgcattcaaggattgcactaattatttggtcaccgccgaggacatccacgggccatggagcgagccgattcgcatcaacggggtcggttttgacgccagcctgttccatgacgacgacggccgcaaatacttggtgcagcagacatgggatttccgtgaataccaccaccagttcgacggtatcacattgacggaattcgacgtcgacaccatgaagctcaagccagaaacggcccgcaccatctgggatggcactgcggtgaagatcaccgaaggtccccacctatacaagaaggatggttggtactacctgtttgccgcagaaggcggcacggtgtatgaacatcaggaatctgtggcgcgttcccatacccttgacgagtactccttcgaagttatgccgaatggcccgttcatcggtaacttcgacactcctgacacctatttgcagaagcagggccatggagcgttggtggacaccccgtccggcgagtggtattacgcctccctatgcggtcgtccgtggcgtcatgataccgaaccggctcatggcacccgcggatggtgcacactcggacgcgagacctccatccagaaagtcgaatgggatgaggacggctggccgcgcgtgatcggaggtcacggcggacagcgttacgttgatgctccgaaagatgccatcgagactttggccccaacgacgcgtgacgaacatgatgagttcgattccggcgagctcggtccgaattggaacacgctacgcgtcccgttcaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctatgctggtcatgggcgtttatcacttgggatgagaaacgtcacgcaagggtcatcgaagtggctcagaacgatttcaaccaatatacgtcgttcctcaaggataacgccatcgtagtgcccgaagaggctgaggcggtatggctgcgcaccaaggtccgcacggaatactattcctacgaatattcctttgacggagaacatttcaccgagattccagtcaggctcgatgcgaagatcctgtccgacgattacgtgaaccaacgttacggcggcttcttcaccggcgcgttcgtgggacttgcctgcgtcgatctgtccggctacgacgcgcaggccgaattcgactacttcgactatcgggagctttccgataaccagtagacagtgccggctggcgacagagcgtccgccgtcagccggcatactcgacgggattgaattctatgggcaatgaggagcggacgagcatggttttgcaattgccgaaactgcttgacgacggttgcgtgctgcaggccggtgcgaccatacatatctggggtgccggcgaccctggacgcggcgtgctggtacgcctcgatgacaaggatcggactacgcgggtgggggacgacggctcatggagtgtgccgtacggtccgatcaaagcaggcggaccgtacgatttgacggtgcgttatgaggacggaaccgaatgcatctcgcgccaatgctatgcgggagaagtgttcctgtgttcgggacagtcgaacatggaactgcccatggcttgggtgcgtgcggactatccgctggagtggaatcgtgagcctgacccattgctgcggcaatacaaagcgattcccgattgtgacttcaacggtccccgcagcgatcatgaccatgcgttctggcaggggtgcgatgcggaaacccttggagatttctccgcgctcgcctatttcttcggacgcaggatccgtcaatggctgaatgtgcccgtcggcctgttgaacgtttcattgggtggatcgccgattgaatcctggatggatgccgacgcattgcgggcgttccccgaagcgctcgctgaccttgagccgtatcttggcgatggcgtggcgtcgaagaaaatccgcgattccgttgccgaacgggaccggtggtaccaagcgcttggatacgaggctgtggccgatgcccaccatgaatggctgccattgatcgcgtgggactgtccggaatccaagaacatcgagccgcgcgacgtggcatggcatggcatacgcctgccgggatggtacaaggatcgcggacttgccggtttccgcggcgagattaccatgagaaaaaccgtgttcctgccttcgtcggatgcgggcaagcccgctctattgcgtctgggcaccatgaatgatgccgaccatacgtgggtcaatggtgtgttggtcggtgggcgtagcaatgtgtatgagccgcgggactatccggtcgcagccggcgtgttgcgcgccggcgcgaacgaaatccgcatgcgtctggtcgttgaacggcccggcggtcgtgtgacgcccggcaaacggatgacactgaccatcggagacgatatcttcgacctgtccggcatttggcagtatgccgtgaccgccgaagctgaccgcgattgcccattcgaggatttcgtcagatggaagccgaccggcctgtacaatgccatgctcgccccgtgttttccatatgcggtgcgcgctgtgttgtggtatcaaggcgaatcgaacaccggcgaccgcgccatgcgatatggcgacgagctgaaggccatgattcaattgtggcgcgtcaaatggcatcagccggatatgccgtttctgatcgtccagcttccaaaattcgacatcgacgccattgaggatggaggctggccactcgtccgcgaacaggaatggaacgtcgcgaacgaacttgaaaacgttgcgacggtggtgacgcttgacgccggcgagggcaacgatctgcatccgtatgacaagaagctcgtcgcggatcgcgtgttcaatgccgcgatggatttggtatacggtcgccaggctcagcctcaaccggccgtggaaaccatcgaggtctgcggagatctgttgcggatgcactgtgtgtggcggagtcgctcggacgagcggatccgatcggagggccgccggctgatgacgttggacggtgacgctccccaggaaatcgaatttctatggcgcgactgcgccacatccgcgcgggccgaggcatggctagacggctgtgatatcgtggcgcgcatgacggcgcgcaggccagatgaggtgcggtacgcgtggagcaacaatccggaatccggactcatatgcgacggcgacggcatgctgattccgccgttccgcctgacattgcccacggacgatgataaggggattcatgcgtagacaggtcgcgcttcgacaaggactcgtcgatggattctccgatacggactctgtaattaccgtgtttcgtggcatcccctatgccaagccttcccgttggcgcattacgatttgtctcgtgtcatgattcggtattggacgaatttcgcggcgacgggcgatccgaacggttccggattgcccgaatgtccggcgtgcggacccaatggccaacgatacatgctgctcggcggatgccacgatacatcggatagtatgtcgtatgccaggtcaagtagatgaatatagtatagtgtgagcgttcactatagcgtggtggaaatcgtgacgaaggagacgggcatgacgaaggagacggagacgcagatcgcgtccgacgaggatctgactaggctgttcgccggcaagccgacgcaataccgcaaatcgaagtcgctgccgaagtttactggcgaggccatgcgtacctgcgccacgatcaaccgcatcttcttcgatgatcctgacgaggcctaccgcctgttccacgagctcgttcccgacgcgggggagggcgtacaattcacgccgccgttcaatgtggattatggcatcggcctgaccattggccgaggcacgttcttgaacaaggatttcatggtgtgcggcggcggatatgtaacgcttggcgaggattgcctgatcggcccgcgttgtaccattgccacgccgaatcatgccttggatgcggcaacgcgactggctggctgggaacatgcttcgccggtgacgattggtgacaacgtgtggtttggtgcgaacgttacggtcacgcctggcgtcacgattggctcgaattccattatcggcgcgggttctgtggttacacgagacattcccgccaattcgatcgcagtcggcaatccggcgcatgtaatccgcgagattcccgaacgcgatcccgccttcgccgatgtcgagggtatcgtctgacgttgggttacggtgttccctcagatcgaattcgcgtgttgccctactgctagacgtgttgtcgcacgatttcagttttgacctcacgatttgatcggaatatcgcacgattttgtttgagacgaaaatgggtgccgttgcggttggttgtgacggcacccattttgcgttgttttagtgcgatttatgctgattgatcagccgcgggcctttgcataggcctcgtacacggcttcagtcggttcgccggtttccacgccatcgatggtgagcggccatgcgggcggttccgtttcgccggacagcacccaggcggcctgacgggcggcgccgatggcaacatactcgtcggtggtcgggcgggtcacgtccatgccgaacacgctcggcgcgagcgtgcggattgccttggacttcgcgccgccgccgataagcagaatgcgggaaatctcagcgccaagcgaacggataagctctaggcagtcgcgctgggagcacagcaagccctcgacgaacgcgcgggccatgttctcgcgtgtggtgttggccagcgtcatgccggaaagggttgcggtcgcgtccggacggttcggcgtgcgttcgccgtcgaaatacggcaccagcgtaataccgccggcgcccggttcggaagcgaatgccagggatgcgagttcgtcgtagtcgacgccgagggctgcacggccggcgtcaagaatgcgcgatccgttgatggtgcaggccagtggcaggtagtggccggtgcagtcggcgaagccggaaacggcaccggtcaaatcgtaggtcggattttcggaaatggctgctgccacgccggaagtgcccaatgaaacggaaacgtcacccacgctcatgccaagtccgagggacgccatggcgttgtcgccgccgcccggtgcgatgatgcaaccaccctcaacgttcttgccggcgatttccgggcttgccttgactgcggcggcatcgtgcggtccaagcacggtcggcagcatgattgcgttggcatgctcgcgtgccgcttcggcaccttccgctggctcaagcaccatggcgatcagatcgcggcggtattcgttggaagcggcatcgtaatagatggtgccggaagcgtcggaacggtcggtgaacagcgcttccaagtgtgcgtcctcgccttctgcgaccgggccgtagccggcgatacgccagctcagccaatcgtgcggcaggcagatcgcggcgatcttcttggcgttttccggttcgttttcagccacccacgccaccttggttagcgtgaaggaagcaacgggggaggagccaacggccttgacccaacgctgcttaccacgtgcaatcacatcttccggttcgccttcttcggcgggagcctcgcccatcttttcgatgagggccgcggcctgcggcgccgagcttatatcgttccacagcatggcgtcgcgaatcacgttgccttgctggtcgagaatcaccatgccgtgctgctgaccgccaacggccagtgcctcaacgtcgtcaagtccgccggcctgctgggctgcctcgaggaacgcgtcccaccagaatttcgggtcaatagacgtgccattggggtgtttggcctggccaaagcgcaccatttcaccggtttcggcgtcggtcacgcgcactttgcaggactgggtcgaggtgtcgacgccggccacgagagttcgagtcattgtgcctccttgcagtgagctggcgcaacacgatgcaaggaaaatgcaccgttcgccacctcatttagttagatgaatgaactataatgtctagtgtaccatcataaagtgatttaactattgaggcggtgcgctttttcggcaaagacgcgtcaaagaggagggaaccatggcttcactgcggagcatcaatcaagacgatttgcgaaaccataatctttccgtggtgctcgactcgctgttgcgtgccaccgaaccaatgagtcgcgccgatcttgccaagaaaaccggattgaccaaagcggccatgtcggtattggtgtcgttgatgctcgacaatgagattctggtggaaggcgcgccttccggccaatcgctgtatgggcgccccagcattccgcttgaaatcaaaggtggacgcctgtgcggcatgggattgcaggccaacaccgacggctatggtgtggtggtgctcgatcttgacggttccgttgtgggggagcagtgggtcgacgccgacatggccaacgccgacgagcgggcgattttcgcccgtctcgacgaactggctttgcagcaggaagaagcgcttgccaagaaaggttatgtgcttgccggtaccggtttggcattgccgggtctcgtcaccgatgatatgcgattgcttggcgcgcgcaatctcggttgggaacgtttggatctcaagcagttcgatgtggtcaagcgacttgatcctgttgcctgcaacgaggccaatgccgccgcgttggcacaggttcccggctatgccacgcagcgtaaggattctgggcggatcaagccgacggattcgtttctttacatgtcgaccgacgtgggtatcggcggtgcagtgatccgcgaagggcgtgtggtgagcggtgatcacggtttcggtggcgaattgggccatgtttccgtcgacatgcgcggtcccgtctgccgttgcggccgtcgcggctgccttgaagtgtatgcgggcaggcgttccatggtgagcgcggccggaatcgccagcagcgatgccgccgcgacccgcagcgccatcgacgaattgatcgaccgctggcaccagcgcgatgcgcagaccgtggccgttgtggaaaaagcattggaggccatggcttccgtaatcgcatcgaccatcaatgtctgtgacgtcgacgtggtgatgctcggcggcttgtgggcgcgtttcgaacctgaactgattcgcagaatcgaacgcatggtacgcccgcaagtgctggcgtatccggaagtcgaggcaagcgtgcttgtggcggatatcgtcgatcgtccggccttgatgggcgctgcggaaatcggtttgcgacgctttatcgacaatccgctgcgtttcatgaagcaaaactagtccacccatttgctaaacttgctaagttggcatgttcgcatgttgcaacgtggggcgttagctcagtcggttagagcatcggactcataatccgccggtccacggttcaagcccgtgacgccccactctttcacaaagtcaaggcttctgatatactctgcaaggttatccggttcacgctctgccataggggctcagcgacccgggtcccccgaatctctaggagacaaactatgaagcagggtatccatcctgattaccacgcagtgcaggtcacctgctcttgcggcaacaccttcgtcacccgttccacctacagcggcgatcacatgaccgtcgacgtgtgctccagctgccacccgttctacaccggcaagcagaagatcctcgacactggtggtcgcgtggcacgcttcgagaagcgttacggcaagaaggccaagtgagtcttattgcttaggcaatgaaaaacgccagtccgattatgggctggcgtttttcattatgcgacggatgcgcatgcgctggcgtgcatgcgatcgggatattcgtaagatgcgtgggatgcctgcgaaataccgcgcttcggcagcgtttccaaggcaccttatatgatggacaggttgagtggagttcagcgaagcgttcacgctgaagcgcagatttataggcagatagaaaaggcgtacattggcagacgagcagttccccgcggcagttaccgcacttgaggaatatcataatatcgaacagcagatggccgagccggaagtcgcgtcggatccggataagatgcgtaagctgggacgtcgtcacgccgagttgggcgtcatcgtttccgcatacaccgcatacaagcaggtgaaagacgatctggaggcagccaaggaaatggcttccgaagatccggatttcgcggaagaggcgaaacgtttggagagcgagcttccagcggcggaagagaagctgcgtaccacgttgattccgcgcgatcccgatgatgcgcgtgacacgatcatggaaatcaaggcgggcaccggcggcgaggaagccgcgttgttcgccggcgatctgctacgcatgtacatgcgatatgcggaaaagcgcggttggaccgtcaccctgcaaagcgaaaacaccaccgaactgggcggcgtcaaagacgtgcagctcgccatccgcgccaagggcactcccgctccggaagacggcgtatgggcatccctcaaatacgagggtggcgtgcatcgcgtgcagcgtatccccgtcaccgaatcgcagggtcgtattcagacgtccgcagcgggcgtcattgtattcccggaagccgatgaagatgacgatgagatcgaaatcgatcagaaagatctgaaaatcgacatcttcatgagctctggcccgggcggccagtccgtgaacaccacatattccgcagttcgtatgacccacattccgactggcatcgtggtgagcatgcaggatgagaagagccagatccagaatcgtgcggccgcactgcgcgtgttgaagagccgcctgctcgccatgaagcacgaggaggaagccgcacaggccgcagacatgcgtcactcccaggtgcgttcgctggatcgttccgaacgaatccgcacctacaatttcccggagaaccgtatcgtcgatcatcgcacgaactacaaggcgtacaaccttgacgccgtgcttgacggcgatctgcaggctgtgatcgacagcgacattcaggctgacgaagccgatcgcttggcccatcagaagtaaaggcggccgatggctaccgtattcgaactcgtgcgatccgcttcggccatgttgcgtgcgtccggtgttgacactccggagcacgatgccaaattattggccgccgaagtattcggcgtcgacctgcagaccgtcgacaaggccatgctgatgggaagcgaaacatccgaactggcgaagcaaggcgcgaagcagagcggtgaagacgctgcgttgaagcgattccacaccatggtggatcgcaggtccaagcgtgaaccgctgcaacatatcaccggccacgcgcccttccgctacctcgatctgaaggttggtccgggcgtgttcattccgcgtcaggaaaccgaactcgtggtgcaggaaggtgtcgactggatcaccaagcacggcatgtattcggcgaaagtggtcgatctgtgcgcgggaagcggcgcaatcggcctgtcattcgtgacggaagtgcccggcagcgaggtgtgggcggtcgaaaaaagcgagcaaaccgcgcaatggacccgcgtcaatctcaacgaaaccgcaaaaaagtaccccagcatcgccagcaactatcatctggaaatcgctgatgccacgcaaacgccgacgctgaaccagctggacggcacgatcgatatcgtgctcaccaatcctccgtatgtgcctcttgcggatattccgcagcaaccggaagtacgcgactacgatcccgatcttgcgctatacggcggttccgcagatggcacgcttattccggaacgcattatcgcccgtgccgcaaaactgctgaaaaacggcggtttgctggtaatggaacacgatattacgcaaggtgaacgattgtctgcattcgcgctgtcatatggattcagcaatgtgatggtgcataacgattacacaggtcgcccgcgatacatgaccgcgaaaaagcagtgatgcaacgcgtctcagaataagagatttttccaggggaacgtggtttttctgttgcaatagagttccagttggaagtccgaccattgcattagaccagttcagcggtaagcataccggttgcggaagcatccacaagatgaggcgtccggttgcgctgacaggaagagaaggaacggcagtgaaaatcaagaatgccgaaaaactggccgcactctgtcttgcggcggttatgggagtgagtgttacagcctgttcgggcggcaacatgtacgccaccagtaatgagagcgccaccatcgcggataacgatgtgatcaccatcggctcggtcaccaccaattccggtgcagccgcagcctatggcgaagccgaagtgaacgggttcaaactggcggtcaaggaaatcaacgccgatgggggaatcttcggcaaacagatcaaactggaatccatggacgacaagggtgatgtgatcgaggcatccaacgcctttaaccgtctggccggcgacaagaacgtgatcgccgtgctcggaccgaccatttcgtcaacctccggtgccgtcgcgccgctcgccgaccagaaccagatgccgaccatcgctccggccgcaaccgccgattccgtggaaacgggcggatacctgttccgcacctgcttcaaggactcctaccagggcgagatcgccgccaagtatgcggccgaaacattgaaggtcaagaaagtggccgtgctgtatggcacgggcgatccgtattcgtctggtgtgggcaaggcttttgttgcggcggcgaagaagaacggactcgacgtggtggcggaagagaattcctctagcgccgacgataccgaatactcgtcgcagctgcagaaaatcgaagcttctggtgcggaattcctatatgcgccgtactactattccacggttggcccgtacattgtgccacagacgcgagcggtcggctatgagggctacatcatgggccccgacggctacgacggcctcaaaaccacgggaaacaaagcgaactacaacaaggtgctgtacaccacgcattattcgccggatgacaagtccaacacgaaggtgcagcagttcatcacctcatacaagaaggccaataacggcgaatcgccgaacaccttcaccgcgctcggttacgattccgtctacatgttcaagcgggccatcgaacaagccggtgaaaacgccactcgtgccgatattcgcaacgccatcgcaggtatgagcttctccggcgtgaccggcgcattcacgctcgacaagcatggttctccgaagaaatcggtgattgtgctggaaatgagcgacggcgaaccgacatacaaagacaccatccagccggcgaaatagcgaaaaaacgcgaggaatcaagaaaaacaagacttcaactgacgaaacaacaagaaaggagggatgatgagcgattcggtcattatgttcatcggtcagatcttcaacggtctgaaaatcggcagcgtgtattcgcttgtggccctcggctacaccatggtgtacggcatcatccgactgatcaatttcgcgcacggcgacttcatcatggtcggctcctacgcgctgatgcttaccattccgttcattatcgcctgcggtctgcccgcatggttcgccgtgattccggcggtgcttgtgtgcgtggcggtgggtattatcgtggaaagggccgcgtacaagccggtgcgtgaaaaaggcaataatatgacggcgctgatcactgcgatcgccatgagcctgctgcttgaaaacggctcccaggcgctgttcggcgctgattatcagaccgtgccaaccatcgttgaaattctaacgctggtgcttggcaaactcaaaatcgacggagcgaccatcataacggtgctgctcggcatcgccatcatggtcgcgttgcagctgttcgtctccctcaccaagcagggcaaggccatgcgtgcggtgtccgaagacaaggaagcgtcgattctgatgggcatcaacgtgaactccaccatcacgttgaccttcgccatcggctccggcctggctgcggtggcggcgcttatgtactgcatttcctacccgcaggtctctccgatgatgggtgccatgctgggcttgaaagcgttcgtcgccgcggtgcttggcggcatcggttccattccgggcgctatggtcggtggtttgctgatcggcgtggccgagagtcttaccaaggcgtatatcggtacgattacggccggtgtgatcacgtcggcgttctccgacgccattgtgttcggcattctcatcatcgtgctgctggtcaagccgtccggtctgatgggcgagccggaaagcgagaaggtgtgattatgaagaaatcaatgctttccacgaagcaatcgtatgcattgtgtgccattggcgtgcttgtgctgttcggcattcttgttgcggtatgtgaaacaggcgctatttccctgtatgtcaagggtattctcatgacttgctgcattgcggtgatcatgaccacgtcgttgaatctgacgatcggtgtgctcggacagcttacgctcggctgctgcggtttcgaggcgatcggcgcatattccgccgcgttgatgagcaagctgctggttgccaacggcgttcagatggatgatacggtgcgtttcctgctggtcacgttcgtcggcggtgtggtggcatgtgtgttcggtgtgctcgtcggcattccggcattgcgtttgcacggcgattatcttgcgattatcacgcttggtttcggtgagatcattcgtgtgatcatccagaatctgaaagtggccggcggcaagggacttgcggacggccagcaggggcaggcactgatcggcatcgaccgtctcgccaatctgtatgtggtgttctgtatcaccgtcgtgaccgtggtgctgttgttcatgttcgcgcgttcccgttatggtcgtgcggtcaaggcgattcgtgatgatgagatcgcggctggcgcttccggcatcaacatcacctatatgaaagtgctcgtttttgcgatttccgcgttcttcgcgggtattgcgggtggtattttcgcgcaatatatcggtgcgctcacgccaagcatggccggttggctgcagtcgatcaattacgtgatcatggtggtgttcggcggtatgggttcgctgacgggttccattgtcgccgcggttggtctgacgattttgccggaattgctgcgtgcgttctccgcataccgcatgctcgtgtattcggtggtgctggtgatcatcatggtgttccgtccgcagggattgttcggcaattgggagttctcgctgccgaaattcgtcaacaagtggttctatccggtacgcgtgaagatgcacggcaaatcgggtgcgtctcaatcggcatctaagaaaaccaaggaaaccggcgagactaccgcatctagcgaaatcaacacatccagcgaagacaaggaggtgcaggcatgagcgagccgattctgaaggccgagcatctcggcatcaccttcggaggcctcaaagccgtatccgacttcaacatgaccatcaatgcgggcgaacttgtcggtctgatcgggccgaacggcgcaggcaagaccactgtgttcaacctgctgaccggcgtttaccagcccacggaaggtgagttcttcctcgacggcaaacgcatgaacggcaagaaaacgtatctggtcgtgcgtgcgggaatcgcaagaaccttccaaaacattcgactgttcgatcaaatgacggtcgaagagaacgtgcttgtggcgttcaacgaatccttcacctaccggctgggcggtgcgatcttccgcacgccgaccttctggaagcaggaacgcgacatgcatgccaaagccatagacctgctgcgtattttcggactggaaggattggccgaaaccgaagccgcgaatctgccgtatggagcgcaacgtaagctggaaatcgcacgagcgttggcgaccggcatgaaactgctgttgcttgacgagcctgcggcaggcatgaatcctacggaaaccgaggatctgctgaactgcatcaacacgatccgcgaccgtttcggcatcgccattctgctgatcgaacatgatatgagcctggtgatgaacgtgtgccagcgtattcaagtgcttgattacgggcgtaccatcgcctccggaacgccagaggaaatcgccaacaatccgcaggtcatctccgcatatcttggtgcggacgatgctgaaaacaatgccgtcgaaacgtctgaaacgaccgaaaggaaggacgcctgatgctgcagatcaagaatctttccgtctcctacggtgccatcgaagcggtcaaaaacatcagtctgacggtgaacgacggcgagatcgtgtcgctgatcggtgcgaacggtgctggcaaaaccacgacattgcataccatcacaggtcttactccggcggtttccggcgaggtgctgttcaacggcgtggacctgctgaaaacgccgaacaataagatcgtgaccctcggcatggcgcatattcccgaaggacgccacgtgttcacgcgcatgagcgtgcaggaaaaccttgaaatgggcgcgttcagtctcaaagaccggtctcacatggcggacgatcttgccatggtgttcgacatgttcccacgcctgaaggaacgccgcaaccagaaggcgggcacgctttccggcggcgaacagcagatgctggcgatgggccgcgccctgatgagccacccgaacacgattctgatggacgagccgtcgatgggtctgtctccgaaactcgtcaaagagatcttcgccattattcgcaagctgcacgatcagggcattaccgtactgctggtcgaacagaacgcgaatatggccctgtcgatcgccgatcgtgcgtatgtgctcgaaaccgggcgcatcaccatggaaggcgacgccaaggagctgatggacaacgagcaggtgcgcaaggcgtatctgggcgcataaggtcagtttcaacgcagttgaagaatcctgccttacaatggtggggtcagcaagccgaaaagggaggtgtcatgagcgagattcgcgctatttcagacgaatcccttgcccaggctgtcgaaatcgtacgtgacggcggattgattgtgattcctacggacacggtctacggcgttgcgtgcgatccgcgcaacattgaggcgatccgcaaggtgttcgcggcgaagcaacgcccgaaatacaagtcgttgcaagtgctattgccgtctattgaaagcatggagaagctgcatttggatctgccggtgccgctgaaccgcctgtccgccatgttcatgccgggcgcgttctctccgatcgccgtggctatccgcaatatcagggcggatttatttgggatttcatcgaccaggcgattctcgacagcaacggtcgcatgtgctacggcggtgatttcggcgaccgtccgagcgactacgaattctccggcgacggcctgctattcgccgaccgcacgccgtcgccgaaggcgcaggacgtcaagcagctgtacgcgaacgtgcatatgaccgtcgatgcttccggcattacgatcaccaacgacaatctgtttgtttcgacggctgattccacgtttgtgttgcgtattttggctgatggcaagcccgtttggtcttcttcgcgccgcttcgacgttgccgcaggtacaagcgagcatgttgagatcgattggccgatcgacgattaccgcgcaggtgcgcaggaactggttttggaggcgtcccagcagttgacttccgcttgcgattgggctccggctgggtatgagctttcgttcggccagtgcgtggttgcgggtggcaagattgccgatactgttacggccgcttccgccgcttccgatggagcgatcaccttgggccgctggaatatcggcgcacgcagtgcgggccgtgaagccctgttctcccttgcacagggtggcatggtgtcgtacaagcttggcgagcgcgaattcgtgttgcgtaagccgctgatcaccacgttccgtgcgctgaccgacaatgatcgcggcgcgggccatgcgttcgagcgtgcgcagtgggcggttgccggaaagtatgcgcgttgcgttgatacgaaggttgagccgctcggcgaaaccgcagtttccgtcacttacacgtatgagcttgcgattgcgcagcgcacgaaggtcaccattcgttacgttgccgatgtgcttggccacgtcgatctgcatgttgcatatccgggtgaaaaggacggcgatctgccgacgattccggcgttcggcattgaatggatgctgccggtcgagtattcgaatctgcgattctatggcgtaggcccggaggaaacgtatgccgaccgcaagcatgcgaagctgggcatttggaatacgaacgccttccgcgatcgcgcgccgtatctgctgccgcaggaaaccggcaaccatgaggacgtgcgttgggctgagattacggacgattctggtcatggcttgcgcgtgagccagactgcgaatactgaaaccggcgttacgaagccgtttgcgatgagcctgctgccgtattcgagcacgatgcttgaggaggcgctgcatcaggacgagctgccggagccgaagcacatgttcctgcgcgtgctcgccgctcagatgggtgtcggcggcgacgattcctggatgagcccggtgcacgagcagtatcagctgcccgccgaccagccgctcaacctcgacgtagccctcgacctgttctagtttcaaggattcagtcgattcctacgtgcgaaatgtctcccgattcttgatttcaaggatcgggaggcattcgttgtgccgcaagttgactttcggcctcacgattcgcagttctgtctcacgatttcgcaagatcgtgcgacaattcggaaaaaacatgcgatcagaccatcaaaatggacgatgagagggattttgttgatggcttaaattagacggattgcctagaatgagggcagaacttccgaaacgttcgagcgcaggcgggcaaattcgcgcgcgtccgagcgtcacgaagcacgctcttccaggaaaggggccatcatgagcgacgcaatgaacaacccgtatgcgaacaatccgaatcaaaatggcagcaacgaacagcagccgcaaggccagccggaatacggggcatacgcaccaaaccagcaatcgcaatcccagcagcagggcggcaatcccaacaattcgggcaatccgtatcaaagcgagcctcagaccccatgctacttcgacggtcccaacgccaacccgaatcccaaccagaacggcttcttctacgcgagctacaccaccggtcagccgtacggccaaccatacggacagcagaacagccaatccgacgctgacaacggcaccaacaattggcagccgatcagcccgttcaagctcatggaggaatggctcccgaagaaggcaaagaacgcgatccgcggcacgtatgcggtactcggcatcgccgccgtcattctcggcctggcactgctgatttggcccggtgccacactgaaggtcgccgcaatcgcgctcggcgcatacttcgtggtttccggtgtggtccgcattgtgaccgcaatcgtggaactcgggcttccgggaggatggcgcgtgcttgacattctgatcggcctgatgctgtctgtcggcggtgtggtcatgctgaaaaacgcggcgctttccggagccacactcgccgtgctcatcaccatggtggtcggtctcggctggatgctggaaggcgtgatggcgctcgtggaatcgtggcgcatgccaagctccgcatgggccgtaatctacgcactgctgtcgatcgtcgccggcttcatcgtgctgttctcccccgtcagctccacgacctggctgatcctgttcggcggatgcgcgcttgtggcgatcggcatcgtcgcgatcgtacgtgcgttcaccttcggcaagtccaagcgcaagtaattttttgcggcgcgggccgtaaagtctgattatctctgttttcccaggggcaccaagcaacagctcggtgccctttccatagcgaaatcgctttttataccaagattcaaagtcgcacaaccatgaatcttggtattaatactggtatataattgggtatgaaattcggttttaagaaaggtttatcatggcaagcgcacttgacatactcgatgaccttgctccaatcagcgagctcagcaatggtcgtacttccgcattgttgcagcgggccgaccacaatccagtcattctgatcaaacgaaacaagccgtcctacgttctcatgaatatcgaaaactatcgcgctctcatggaacgaatcgaagacaacgaagacttgcttcttgccgaaaaaagactcgccaacagtactggcacaactatcagcaacgaagaggtcatgctcgatctcggcatttccccaagcgacctcgccgaggcacctgagccggaactcgcatgaactggcaagttgaatggcttgacgaagccaagaaagacatgcgcaaactcggcaaagccgagcaaatccaagtactcaagggaatcgagaaagttcgcacaaacccactgcccacctcgcaaggcgggtatggcaaaccgttacgcaatgccgaacgaacgaaactttccaggctttgcaaaatcaaattcagggatatcggcattcgcgttgtttacaaaccgttactgcgaaatggaatcatgaccatcatcgtcgttggcattcgttccgatagtgacgcttacatcaaagccaacaagagacgcaaagaatatggactataagatgcgtccgccaattttcagcgaacgttactttttcttcaagattagccgatgattttacaaaagaagtgacgatcgtcgcatgacattgtcgacttgcccgacgtaagatgaaggcacaacagaagaacgaagaaaagaaaatagacaacaaacacagacttacggcagcggccagaggaatggacaagaaaacagatacgcgccgccaagccgaacgaaaggaaacatcatgaagaacaacactttcaaccaggtcatcaacgccaacctcgcttccatcgatccgggcttcggccagttcgcactcgccaaggcttcctccgacctcttcaagaaggtcctcaacaagtaagaccgcttcctagacgggaggcaaggcgcaggcgccacagcacctcgcccctcttctttccaatccttaaatcacatagcgggaggccgcggttccaaacggaatcgcggcctcccgcttttcacgtacgccggctacccctcctcaacagcgagattgcgggcggcggcgcgttcgcgtgggccgcgcgtcacgtagaagccgattgccacgatgacgaacatcaccgtgcagcagatccacagcacacggctgccgaacgcgttgagaatccagcctccgaccaacggcgagaacgcgttcgacagcgaccacaccaggttgtataacccttggtaggtgccgcgcacatcctttggcgcgatgttcgccaccgttgtggcggcaatcgggaacgtgcccagctcgccaagcgtccacagcacggtcgcgattgcgaacgccacccacgaattcgcgccgatctggaacgcgtatccgaccgccgtgatggacatgccgagcaccagcactcgggtgttgctcatccgctggaacagaccgatcgcgggaatctgcagcagacacagcagaccgccgttgatggtcagcagactggaatattcatccgtgccaaggccgatctgcgtcatggaaatcggcaggccgctgacgatctggtaatacgccagcgtgtacaggaacatcagcaccaccatcgacatcagcgcgccgtcggcgcatgcgcgacgatagctgcgccatacggagaaccgctgcggccgctgcgattcgccggtttgtttcacagcatgttccacggcatttcccgcagctgattccgcggcttgcgacgcccgcgccggcgcgacctcgccccgcgggcgcttgcccagcccgacttccttgaagaacacgatcatcaagatcgtggcgaacaccagcaccgcggcttccgcgtagaacatcagcgcataggagatcttcaccaactggttggcgatgatcgggccgatcgcgaagccgaaattcgcggcccacgtctgcagcgaatacgcgcgcttctgtttgcggaacggcaccacgtcggacacgtacgccgcgaccgcgggcgtcggcatggatgagatggcgccgtaggccagtagcgcgatcgccatgatccacggattgccgatgaacgccagcaggaccagcatcgcggcggagccgagattgccgatgacgatcatcgccgggcggccgaagcggtcggacagcgcgccgccatacaggcagccgaagatgccgccgaaaccgtacatggagacgatggtgccggccacgcccgcgctgacatgcatgtcagacaccagatacatggaaaggaatgacgtgacgaagcggcccatccacaggataagcagcgtgacccacaagccccagaacatgaggggcaatccgaaaatctctttgttcttctccattcttgccatcatatcgagcaatatcgagcggacgcgacgccagtagccttttcccggggtgctgggagaatggacaactatggcaatgaaaaaaggaccgaccaaggggtcgggtggaaagcatcgtaacgcgctgaggggcaagggaccgacccccaaggccgaagatcgcgtatatcacaaggcttacaaggaaaagcaggctaccaatcgtcgtaagatggctgatccgcgactggcggcacgccgtcgcgcggcaaagttcagctcagaatccgacgatctcgtcatcggtcgcaacgccgttctcgaagcgttgcgctgcggcgtgcccgcgagcacgctgtatgtggccgcacgcatcgagcacgacgatcgcacgcgcgaaatcattcgtctcgccggtattcacggactgaacctcatggaagccgaccgactggaaatggaccgtatcgcacgctcctccaaccatcagggcgtggtgatgaaggcgcagccgttccagtattcctcgctcgccgagctggtggaacgcgcggacaagaagtctcgtgccatggaagcggccaactccgcaagcgcacgcattgcggcacgtccgctgttcatcgcgcttgacggcgtcaccgatccgcagaatctgggcgcagtcatccgttccgcagccgcattcggcgccaacggcgtgatcctgccggaacgtcgttccgcttcggtcaccgcagccgcatggaaggtgtccgcaggcgcagccgcacacatgccggtcgcccgcgtggtgaacctcaccaaagccattgaaagcctgaaggaacgcggatactacagcgtcggccttgacggtggcggcgacgccctcgttggcgaaaccggtttcgaaaccgatccgctggttgtggtgctcggttccgaaggcaacggcctgagccgtctcgtacgcgagacatgcgattccatcgccggcatcccaatgtcgaacatggtcgaatcgctgaacgcttccgtcgcagcgggcatcacgctgtattccgtcgcacgcgcccgccgcgaggccggtgccgccgctgacgcgaagtaatcaacacgaagcgacaggaagtaagcacaacaaggcagcaagtccgaagtacatatgagcggatagtccatacggattatccgctcattttgttgcgcaaatctgtacttggattgattttgcgcttaccgcagacccactcccccgccaacgatctctcgcaacacgttctctcactttcaaaagtcaaaatttttttgagttttgaaagtgaggggtgtgaagggataacaaaaagcggaggattattagtggtcctccgcttaacggctcggccctgcaatttttgactgcggctacgccgcaggctcaatactgccttcggcgcggctatcgcctcgtctcagggcgcattgatagaaaaagctccagtggggctttttctatcaatgtgcccatacagctgcgtcgggatcgtcgtcggggttgtagccgtcgtcgggatcgtcgtaggtgtattcgtcgtcgatcacaccggaatcggcttcggcgttcaacgcgtccacatccttcgtggtgagcttgtactgcggaagcaccttctccacatagctttgcaccgcctcggccatcggcacatcatgacccgccttctcggccaggaaccaacggtggtcaagcacctcatggaagaactgtgccggttcgatctgcgaacggtattcgcgcggaatcatgcgcacggtcggttcgaacacttcacgcatccaatcggtggcaacaatctcaagatcctcaccctcacgccatgtggaagcgcggtaggcatccaaatcgttcaacagtcgacgagcctgattctcctgcacatcaagaccagtcaatcgcagcaacttacgattcgcatagccggcatcgaccacacgcggacgcaccagcacacgcttgccatcttcggcggtcttcatctccagctcatccacatcaaaaccaagctcattgagcttgttgacgcgcttctcgatcttccacatttcgtccggaccgaacttgtcggtatcagtcagcgcactccacagcgaatggtaacgatccaccaaacggttgccgatcgcaatttcgtcaacaccgctcggcagcagcgaaccggacgaaagatccatcaattcgccaataatgttcgtacgagccaaatcaacgtcgtactcgcgctggccttccgtcagattaatctgcagatcaccggtttccgcatcaaccaaaaatgcggagaacgcgtaggcgtcgcgcaggaacaacacgttcgacagtgacacatcgccccaatagaagccagccaaatgcaaacgcaccatcagcacggccaacgcgtcgatcagtcgttccgcggtatcagggcgcagattacgcgcgaacagcgcacgatacggcagtgagaacttcaaatgcttggtgacaaggatcgcttccagcggctcgccttcacggctatgacggcctgtgaccacggcgatcggctgcacggtcggcagttccagcttctgcaggcgacgcagcagctcgtattctcgttccgccacattgcgcgtgatttccttcatggcgtacacttcgtcgcctacgtgcacgaaacgcaccacatgcctggaaataccacgcggaagattggccagcaggtcttccggccaagtagccagcggcttttcccacggcagggtgaacatctttggattcgagcttgcggcggtgattttcagcgcatgcggctccggagatgaggcagccggatcttcggccttcacggaagttgctttcagcacacggggatccatctgtggcaattcaagagattccatgaatcaacaatttacctgttgacctacccgaagaagcaagtatggacgaatccgtttcacctgccgatatgcgatgatctcaatactggaatctcactatccatctcatattacgatcgaatattgcgatcgatgctacaaacagacattacaagccgatatcgtgcttgcggaaaacaaaagaagccccgcaccgacgcggggcttctccaacgagacgataagagaggaagagcacgtctcgtttaatggttgacggaagttcgcgcttccgccaagtttttattcagccacccgccagccgatttccgtaaaggatattcccctgaagaaacagccaacggttggttactcgatatcagctcagttcagacgcagctcggtcgacggagcgaacaggtgcatcttggacgggtcgatcttgatcttgacggtatcgccgaccttcgggagagcacgcgggttcacgcggatcgtggtgagcttgttctgatcggacatcatggtggatgcctcagcagcggagccatcggtgatgatgttgccgtagatgtagccatcggagcccagatcctcaacgttcatgaccttgagggagaaggcgttggcgtcatccggggcggccagggaagcgtcttccggacggaagccgacgacgatctggttgttgtcttcagcggtgagcttgttgacggcctcggccggcagatccacggtgtcttcgccgatctttgccttgccgttgaccaccgggtgggtgttgatgttcatcgacggggagccgatgaagccagcgacgaagacgttggccgggcgatcgtacagctcggtcggagcgccgacctgctgcaggacaccgagcttgatgacggcgatgcggtcacccatggtcagagcttcggtctgatcgtgggtcacgtacagggtggtgacacccagctggcgctgcagagcagcgatctgggtacgggtctgcacgcggagcttggcatcaaggttggacagaggctcatccatgaggaagaccttcggctcacggacgattgcacggcccatggccacgcgctgacgctggccaccggacagagccttcggcttacgatcgaggtactcggtcaggtcgaggatctcagcggccttctcgacgcgcttgcggatctcttccttcggggtgccggcgatcttcagagcgaagcccatgttgtcggccacggtcatgtgcgggtacagagcgtagttctggaacaccattgcgatgtcgcggtccttcggctgcatcgtggtgacgtccttgccaccgatgaggatgcggcccttgttgacctcttcaaggccagcgagcatacgcagagtagtggacttgccgcagccagacgggccaaccagcaccaggaactcgccgtccttgatgtccatattcaaatcatccaccgacggcttatcgttgcccgggtagatacgagtaacatggtcgaatacgacttctgccatgatttgtcatcctttcagaggcaggtacgtgcctcacgatccgttgtaaagggatttcttttcggtgcctcgccttgcggcttacgacttcgacaaagccacaattcaaagcgttaatttatttctttggtttggcgaaggttctcttcgttgagccacgttccatgatacatacaacgctaaaactgtcaatgcgtgtcgcgagtcgcgctgtttacctacgctggcaaaagggggttaacggcgtagtaaatacacgcctttatcgccatcatgcaagacaatggtgcggagcgaaagacagaacagggaggttgcagtgcgcaatattagaatcggcgtggtcgaggatgatcccgcaagctgccagctggtacttgactatctcaaccgatatcagcaggaaaatgacgaacaattcaccgtttccgtattcgacgacggcgcgagaatcgtagagaaatatacccctgtttacgatattttactgctcgacatcgaaatgagcgaaatggacggcatggccgccgcgagacgcattcgcgagcgcgacgacaaggtcgtgatcgtgttcatcaccgccgcaccgcagtatgcgatcagcgggtacgaggtgcgcgcattgtcgtatctgctcaaacccctgccgtggttcgcgttttcacaggaactcaagaagtcgatcgacatggtgaggcgcaatggcgacgattccatgcttatcgaaaccagcaacgggcagatgcggctgaatcttgccgatattctgtatctcgaatcgatccggcataccatcgtcatccacacgttggaaggcaaactgtcgatcaatggcacgctcaaagacatggaagcgaaactcgccgaccaccatttcttccgctcgaattcctgctatctggtgaatctcaagcatgtgacgggcgtcgccgaccaggattgcgtgatgtcgaacggcgaacagttgcgcgtaagccgaccacgcaagaaggcgttcctcgccgcgttgaccgactatataggaggtggcaggtgaccagcgtgatattgccgaatgcgctggccggattggcaggaggactggcaggaggctccccttccataccttccgttttggtgaccgtgctttcggtgccgccgatgacgccaatcaccaacgctctgcccgacatcccccgttcttatacggcgatctgcgaatgggccgcgtgcatggtgtatatcgcggtgttgtatcgtcgcgtgccgctccgacggtcgatcatcgtcagtgcggccggattggcatcgctggtcgcggtgcagtatttcgacggcagtatgccgatctggttctggatcatcggtatgctgctcgcattcgcctgcatgtatgcgacgattctgctcggcgcgggcaccggcaaacgcgagggcctgtatattacggcgcgcgcgttcgtgttggccgaattggtggcgtcgctgcattggcagatcgttacgttcattggcgtgcgcgacggattcgccgattacgattggcgcgcgatcgcgctgcttgtcgttacgtatgcgctgtgcttcggtctagcttggatggttgaacgcggcaatttcagccaggccacacctaccttgccgaccgcttccgccgcgattgcgacgatggccattatgatcgtcacgttcgccatgagcaatttgagtttcgtgtcgacgaatacgccgttttccggttcggtcggccaggaaatcttctacattcgcacgctggtcgatttctgcggtttcgcgatcctatatgcgcagcaggagcaggcgcgccgtattgaggcgaatacggaactcgcgtcgatcaacgcgcagctggaaagccagcatcaggaatacctgcaatcgaaggaaaatatcgaatcgctaggccgtcttgcgcacgatctgaagcatcagcttgcggcgttgcgtgccgaagtcgatccgaagcatgccgcggccggcttcgagcagctggagcaatcggtgcagcgctatagcacgcagcagcataccggcaatcccgtgcttgacgttattttgaccacgaaagagcgcacgtgcgccgatcgaggcattacgttcacggcggtcgcggacggctcgctgctaagcggcatgtcgtcgatggatatcgcatcattgttcggcaacgcacttgacaatgcgatcgaagcgacgtcgaaattgccgaaacgtgagcagcgtctgatcaaacttgcgttatacgagcagaatcgctttattgttatccgtgttgagaattattacgattcccgattgaagaaggatgcggaaggcaatctgcgcaccaccaagcgcgacgatcagcatcggcatggtttcggcgtgaagtcgattcgtcatatcgcgcagcagtatggcggcgaagtgacgattcgcaccgaagaccactggtttgtgctgaccgcgcttattccgcggaaaaccggccttatggccatgtaggactggccataaggcttaaggcggctccgctagttttcaagattctgcgcagcggcatcgccgtcagacgcatcaccggcatcaccgcctgccgatgcgtcgccgccagcatcgccggcattcgccgcacctccagccgcacctccagccgcgccgcccgccgcgccgcccgccgcagcacctccagccgtattgtccggactattcgcagcaccaccgttagagcccccgttagtgccgatattggtgttgttcgtcacggtgttgggagtcgacgacgcctcctggtattggtccatcgcctgctgaacggcgtctttggcggcattcagcgcgtcaacggcggccgtcacgtcgttttccttgagattggtgccattggcaaggtttctggccgagtcaatcgcctgctgcaatgccacgcgcacgctgtcatcggccaccatgccgtcggaattgtcgagcacggactgcgcctgctcgatcgcgtcattgagctggctcttcagacgattctgcgtggccagcactttggaagcgtcgacggcttcggccgcatttgtaatcttttcggccttgtcgttcatgctccatgcctcggatgccatggctttcgcggatttcttcagcttgctgatgccctgcgacgtgtcgcacgacaggattttcgcttccttcgcgttagatatggccgcattaagcttagtgacggtgctggcgtcggcgacttgatcagcagtgaccttcgcgccggtttttccgatttccaaaacgtcggaaagcgtgttattggcactttgcagctggctcgtggaatcctggcattgcgcggctgcgctggtaatggctgatttcttggaattattcgaaagcatccaacatgcaataccgccaatcaaagcaatcacgacgatagccgcaatcacgatagcgacgattttgccggtattcttcggtggtaccggaatttcattgctgtaatcgccgtaatcctcgaaaacactgaaatcgcttacaccgttcacatcgctttcttgcgaagcgaccgtcggaggcttcggcggttcggacatgtcagcccccatcacctcggtatccgtcggaaattccagcctgaaattgttgtctttcgtcatacgtccttcttcatcatcgggcgctcagcatcgaccatctatacgccgaccccctagcttatcgcctaacacacccttcaacgcgcattcgccttaattaccttcttttccgcacttttcgataggcgcaaagcggcaagcggctcccctaaacgcgatgcggtgaacgcactcaccgcaaccgcgaatccaatgggcacaaacagattgatcggagcatccgcaagttccatcaccaagcaaatcgccataagcggagcctgttgggaagctgcgagcaatgcgcacgcacccagcagagcgtacatgccaatcgaattcgtgtgaaacacctgcatccacagaacacccagcacagcaccccccgaagcgccgagcgcaatacccggctgcagcacaccgccggaagcgccggaacggatcgtcagcaatgtgacaatcaccttcgccaggaacgaaaccagcaaaatcggcaccaccgccaaatcggccttggacaagaaactcaactgcgcggtggcacggccattgcccataacctgcggcacccaaatcgccaccacgccagtcagcagaccggcgagcggcaacatccacagaatgcccgcgcccgacggtttggacttctcagcccactgcgatccgcggcggaacagcgcgccggccgcaccgagaaccagccccgcaaccagtgcgaacgccatgtaatcgggtgtgaacaggccgtccgctttgccgatcaggtagaacgcgtgcgtgcctttgaccagcgacgccacccacgaagccagcgcggaacaggcgaaagcgagcgtcaccgtttcaagggtcacatcggcgagcagaatctcgaccgcgaaaaacgtgcccgcaagcggcgcgttatacacgcccgcaaggccggcggcggccgtaatggccaccaacatacgggtgtctttcgcatcgagacgcacccaacgtgcgaaccgctgaccgaacatcgcacccaactcgcgcggcgccacttctcgaccgatcgacatgcccgtaccgacaatgaaaatctgcagcaacacatgcacgacggtctgccaaatcggcataatatcgccattcaccgcctttttgacggacggcaccttcgtactgcgcgtacgcaacagccaccaaatcacggcggcgacggtcgcgccaacggtcacggaaatcaagcaccgaatcgcaggaacgttgaacgggccggattcctgcgaattctcaacataaccgagcgcaagatgctcgacgccgtacagcataagcgtcagcaggccagcggccgcaccaatggccacacccacaatcgccaccgccgcaatcagcgccggaattctgccaatctttggctgcgttccttgaggattctgcgactcctgcgattctcgtgttttttgcgattcctgcgattcccgcatctgccgcactccttgcacaccgtctccttcgttcaattcgttcccccaattgtcccacctgccgcaacgttcatttgttacgccccgagcgtggcgatcggcagcaccagaatgccgtcatcacgccggtatgcaatatcaccacgcccgacaataaatgccatgaattcaggctcacgaacttgagatagaggatttccgcacactttttctttgaaagcatgtagtttgtccacatttttctccatgactttcaagtcgctcagcttaatccccaccgcagcccagcgaccatccaccaattcaagaatcacatcaacttcaaggcctttttcatcccgataatatgcgattcgattcgtgccacccatcgattcgagatacacgcgcaaatcacgaatcaccaatgtttcaaacaaatctcatactgaatcagagacaatagtgatgacgctctcagcttatccagcacaactcattgcacatcatttgatagggattgctgcgagagctgcatctttaggtcatcgacttttaattccaaacgtctgatataaagcgcctgtcgacggataatcaaatcacgcatatcatttccaccggttccagggttaccttcattcgtgcgactggaagtaacctcagcatcggggagattcactctgtctaccgtgcctggatcttctattcgtattgtcttcctccaacgatgcatgcaccgttcaatacgcttttcgcctatcaactcaggaccgagccccgcttcgcggaacagcacagtgggagattcaccattttcagcactcgaaacgcattcacgcttgaaccactctgcatatcggatacgtgaaccagtaatacttatgaccgcaggcagcgaagccagatactgtgcttgttccggagagaatcgttcgtcgctcatgcttactttttcacttcatcgtgcaatcatctgtatgggatttgccggccgaattgacatcccgtatgcggcgtctcatgcgcaatctgatcaaaatgaacgtaacaagtaacatgagccccgctgccgcggcaatgctgcctacggcggcacccgtacgaccgataaggccaggattgcccggctcctcgctcgggttattttcgggcgggacaacaggagttccagtgctaaatttcggctctactgtgatgttgagatcagcggatgtgtctccactgccaggaatcgagatgaggaacggatcacagtcgtatgctttgttggctttcgccgagctcgtgcgggagaccagatataggccgagcggcagattctggaaagtgagctgaccagctacgttagtggtgccggaatgctggtacagcttgtttttcgccgcgtgcgtagcgagcttcttggcagcatcgtgatattcacttgatgtcaggcgttcccaatcggcagtgaggccggaaaaatcgccgacggttttatatgaggagacgctaccatcattgttcgttgtgacggtggcgacgcgcacgatggaataggtatcgccggcaagcaatttgggcgaagccgtgtctcggccccatacggcattgatggtgagagcgccgaaagaatcagcttgcgcatacggcaccatagagccgaaggctgcaagaacagtgaggacgatagtaacggcggcggcaatcatggcagcaatgcgcgccgcaccatattcgcttccgctatgcaggtctaacatgtctgcccggtccttttcgccgtgatgaatgtgattggttatttgtactgtctggctgaggaggcaagtcaccgtccggctcgatatccgcagagtcagaatcaccagatgcgaccttggcgctcccactctgccggcgtcgccgctcatgacgctgccataaatgccatgcgataagcaaggcaatcagtgcaagagacggcaacaagtactgcagcggaatgtccacgtggaacgtggatttggcgtcatcctgctgctgcggcgcgtatgggatgcgatggccgcgcaccagcagccgatgcgtattgaccgcatacggcgtacaagtgatgagcgtgaccaaatccttgccgggctcaattgccagttgtttggtattggtcggcagaacggtagtgatcttatcgacctgatacgcatacgtgtctttaagtattgtgatgtagaacttgtcgccttttttcataaggttcaagtccgtgaacagttttgccgtgggcaagccccggtggccagacagcgccgcatgagtggacgcgccaccaactggtagtgaggtctgttcgagatgtccgatgccggattgcagtactttctcggaagtgccgtgataaatcggcaaggtctccttgagcttaggcacagtgatgtatcccatcatgccgtcgccgtcaatattgagcagactgttgtattcctcgtccgtggatgcggaattgacggcactggcaagagcgtcggtctctcctgcatcgttctgggcgagcttttcgttataggcgtgcgcagcatccagcaccttctggtactgttcctggctcaatgcctcaacgctggcgtcgtagttatttacggcgcggctggcgttgcgcataatgaggaagttgctgatcgtcggatagaacagaatgagcattccaccgagaatgaccagtaagggcaggatgttgcgcagtcgtttcatcgagcgttcttttcgcgaggaaaccgtgttgtgggcgtagcgggtgtgtgcccttcacgcccaaaacacggccatgctcgtcaggcgttcttgcgcttgagagtccaggcaacgccgagcgcgatgaccagcacaccaatcaccgtgaaggcgatggtacccatgccaccagtgccaggcaggatagcaccggacttgttctggaccgggatgacaccgttcgatgcggtctggttgtagctgttgccattgtcgttgttgtaggtgatggcgacggtggcatccgtggtgtcagtgccgtcgttcttgccatcaaccttcacgccgatggcgctggcgagcttgttgtagccggccggcgctttggtctcggtcagcgtgtactcgccgttctccagtccccggaagacaaccttaccgcttgcaggagtggtgatagtcgtcgtagtatctgtctcaccagccttagctacacggtatacagcgttcgcggtcgcactaccggcatcgacttgcacgaagctcatagcggtgccgttcttaggtgcaagtgtgaactcagcaccagcaagtcgagtagcgtcatcatcatatttgtcaccagtgtacttatcgacggtgaagccataagtgaagacgcgaaccttgctgggttcggactcaccggtgccaccgctgctcgggttgttggagtactgaattgttgcggagttggtgttaccaacaccgcccacaacagccttctcgttcagcgtggccgtgtaggtgacggtaatcttcttgccggcattggcctgctgcttggccttgaagtccttcatggcgacagtaagcgtattgtcggagaccgtaggagtggtgacggtgtagtcagtgttcacggtcagtggatcagtcacaccttcgaccgtaacggaagtgacttgtccaaaggtgaggccctgagacaacgtatccttgaagttgaaggtgtaggtgtcataggcggacatgtctggaatggtggaggtcagggtgaaggtcagggtatcaccgatcttcgcgtcagtggcgtccttaccagtgccgcctacctgtaccttcttgtcgacggtaggcaggtcgcccttaatgttggcagtcacattggtgctatcaacggaaactagcgtggcgtattgaccactggcgttggccaaggtcgcacccggcacagcgaccacgtagtagccgtagtcgagaccagtgaacgtcgccaagtacttaccgtccgtagcagcggcagataccttagcggtcgtgccagccgtgatgttgttggccttagtctgcgcccagttcgatgccttggtagcgaaagcaaccaagtcttcacccttcagcttggatacgtagtcgtttgctttatcgttgacgttctcgtcggtagcaccagtcagtccggaagcagtggagttcttgaagaacggcttccactcgtcagtcaacgtgtaggagacagccttgctgccaccgtcaccgctcacggtggcggagaacatcttgtaggcgttcacggtcttaccggcgaacttcgcgtcagtagtgctgaccgtcagcgtggcattatccgctgcgttggccgtggcgactgtcgtcgcagccaatccaaatacggtggcaatcgccgcagcggcagcgaaaacccttttcatcagtgatttcattactgttccttcctctaaatggaaatcttttctgtttggcagatacggtttgtctatgtagtcgtcacgcggcatgggcacctcgctttcgtatacggctggagcccgagcggactgtgccggattgaacgcgttgatcacgcacgtaccagaccacgccagctcccataagcagcaagccgaacatcagaaaccacatcgtgcccgcgcctcccgtatccggaagcaacgccgcattggtaacaatggccacgcgttccttggtgttgtaggagaccgatacttggtatccggcctccgcgggcttgatggtcttggtggtatcgccgtccttataggtcacggcggtttcttccacggtgtacgtgtagtaacgcacgatgtccttgccgttggcatcctgtccatccacgaatgcgaccggcagtccttgaatcaccttgcgccaggtgttgctccaggaagaggcatcggaggagtccaacgtcaccgtccatggattcttctgcgtcacggttgtgcaatccgcgccgaagcattgaatcgtctgcggcgtcaccgtattgccacggccatcggtatagtgcgcggcgatcttcagttcgaccgactgcggccgttcgaggttgccgtccttccacaccttctgcacggtcaagtcaacgctccggcagccgtccttgccgcacgggtcctggccgtcgtccggttcgggggtgagtccgccgttgttgtcggtcacggtcgcgtcgagcatgagcacggccttggccggggactggtaagcatcgagcttcgtcttggtgctgccgtccgtggagtcgaccacggcgttcttaatgccgacccaagtggtgccggcgtcgccggatgcggagctgtgcacagcgccgctgtcgtatgtgttgaccacgtcgaacaacttcacttcccaacgatcgagtccggtgttcagcgcatcgtctgccgtgttcttctgcgagaagatcttgttgccgtcctgtgcggaggtgcgggcctcactagcgttcgcggccgccttgcggtaaatgcgataggtgttgtatgccttgtcgtcgttgccgtcatcgaccggtccgaggatgtcgctcatggtgttgaagtcccatacggacttgagtttggtgttcgagaacgggtcgaccagtccgctggcaccgcggatcgtgtcggcgtagaccatgtggtcgtctgccagcacgccctcgtcgttcagtccggcgaagccgcccgtgtagcctgtggaaagatccttcacaccgtcggtatcctgagttgcccctccgccgaacacgtcatagccattggcgatgcccgttacggtggactgttccacgcgagtacggttgcccttgatgagctggacggtcaggttgctgcccgaaccatccatatcaatgccgtctttgctgcaaggcagtttgatgacactatcgccgatggtgacaatcgccacgtcggtctgctgctggttttcatcatcagccttggacagagcaacgctcaccttcagtccgaacaggttcacgtacagcacgttgccttccgaaagcaccttgagatcgaataccttgccgaagatggccgggaaccacttgcctaaatcgatgacgccgacctgttccgccttgtcgaggtacaggagcttgaccagcgcgttcaccacttgcagcagcagttccacaagtacagagttgaccttcgcgtcaaccaaataggcacggctggtttcaccgacgaatccgccggcaatctcaccgctagtgaccttcttgagattgtcagacgtgcagcccttcaccctggccaaatccacgtatccaacaaaaccgcctgcgacctcacgtccggtagccttgtcggtggctttgccgtaattgtcgccatggtgtgtggcggtgacggtataaccgtccgggatgccggtgacgcgcgaatcgccaacgtgcgagccccagatgtcaagtacgccggccgtagcaccaagcagattgagcgcatccgtgccgagttgtgcattgtcggcggcgaccgtgccggatttgccaagatgcccgatgaagccgcccacgtagttcacgccggtcacactgttgaggttggtgaccgcagactgcttcacagagccattgatcagtccaccgccgaaaccaccgaccgcaccggtgtaacgcttcgagtcaagcatgccctttgtggtggaatcatgggcgacaatctggatgccgtcgctcacaccgttgacctgaccgtcatagatgaaggtgcggaatgcttcgagcacgcccacgttgccgaccttgagcagtttgagcagcaggttggtatcctgcttatcgccggcctcgccgccgccgacggaagcgacgctggatacatcagcaagaccaaagaagccaccggcgtattgcccgccttcgacagcgcgcagcccgttaacagtaagagaagccgggtcattgttcggatccgcttcactgccggtacctttggcggaatccttgtcaccgaggatcgcggcttgcaacgaaccagcgaaaccgccggcgttcagggcatacttggctgtggtattacccttatcgtccttgctctcatatgcgccattgaccgtgtatccccatgccgggtcatccgagctcacatgtgcaccgcgaatcgtcgtaaccgtggcctgcaatacgctgaccagacttgccgggttcgataccagcgagtcgaggattccttgcaggaatccctcggacgcattggtgtccacatccgcaaccgcaccggcagtggccacgccgataaatccgccgacattgttgcgcccttccaccttgcgcaggttggaaacgttggcgccggcagcggtgacaccctcgacaagcttctggccgttctggtcgagatcgccccagatctggccgccgaccgcgagacccacgtagccaccggcgttgccggtgccgtgcgtgatgtcttcgccggtggcctcgaccttcatacccttgcggtagccggccacgctcgaggatttgatgactggcacgaatacctgtgccacgtcgagcatctgacccagatcaagtttgatgcctttgtcgccgaatagttggatggagccgaacgaggatgccaagccggattccatcgtgcccgcgtagccacctgccgcacgcatggcggagacggtcttgacgtccatcgactggccatcggtgatcgtgccggtgcgcatcaggccgacgtgtccgccggcgacgccggaatcatgcaggttcgcgccggtccgatactccgcacgttctgcgacgacgttgaatccgaagatgtaggattcgaggaacttgtccagggaatcctggtcggtaacagagcccgcaccatcagccgtggtcacatcggtgaattccttgccatacgcaccgtacttgccgatgttgtcgacccacgtcttccactggtcgtagctcatattgcgcagcggaccggtgaccttcgtgtgctcctcggtcgggtagaccacggacagcacgccggcgaggttgccggccttgatgagaccgccgagcaaggagagcgaaccgccttcagcggtatcggccgcttccatgaagccggtgtagccgccggcgatttcggcaccgtatacgctgcggatgcgcgcggcataggctacgcgttgcggcccgttgtatttgccgtcggtgttctcctgcttccatgctgcggtgttgttgccccagatatggccgccgcggttacgtcccgcatagccgccggccatgccgcggcgtgtggtcgtatccgatgccgcctgtgcgcgcaccgcgccgccgcacactgtggcatcggtcgagctgttgcgaatcgtcggcacgaagtcctgcacgagcgagagcaggtagtcgaggttgacgagcttcttgagcacgctgccgtcgccgagtacgtttgccacggctcccggctgcatggtgcccacgtagccgccggccgaaacctggccgatgatgtatacgaactcatgcgagctggagccctggatatggccgccttcgatgtctccggcgaagccgccggccatacccagtggatcgggctcattgttggcattcctatgatttgcggtgctggccagaacggaatatccgccgatgccgccggtcacatcggaatgttcaatcgtcgagacgacgacatccagcacactgagtacatcgttgagattgacgttctggccgagcaggctcaggccgccgcccacggccgccgccgagccgatatccattttgccgatgtagccgccggcataccgagcggcggtgactgcatacgagctgtctttgctcagataggtgtcgtcgatggatccggtggtttccagattcttcggtgccttgacgtcggtgtggcgcagttgggtcacgctggaatgggacacctgcacaccggaaccgtagccgatgtagccgccggcggaaccggattgcgtatcggactgatcaaatcgggtggcggagacggtgaagccgggatcgtccgggtcggaaatcttgttgccgctggtggtctccacggtggtggcatcggaatgcacgcccgcgtaggagatgaacggcacatagccctgcaccacctgcaacaggttggcgagatccaccgtaccgaatttgccgagcaaactcaggccgccgttgccagccgaagcgagcgcgccggaaacgaccttgccgccgaaaccacctgcgtatgcgccgccggtcacatggtcaaggttgacaacggccacggggttggcttgaacgcgggactgcacgtctgccagcgttgagtcgttctcgagatcggtttcggagaactgattgaccttgccgctttggaagtttcccgcatagccgcccgcgatatcaccttcgacgtaaccgccgttgacgtacgtcacggtggtatccgtatagcttggaatcagatacggcatggcaccgagcaggtcgttcacggacagcagtccgcccttgatgaggttgtccaacacgctggaatcatcggcgttgctaagtgcgtcggcgaggccgccggtggtggagaagcccacgaaaccacccgcgatgccatcggatgtgctggtatcggccgcgaccgacttgaggttcgtcacatggctttcgcgggtcttggtgctgttggcctgaccgtagaaaccgcccgcagcgtaatcggtggtctcgttgttctcgttcttgccggtcgccttgaccgtgaatccgttggcgatgccgttcacattcgatgcagtgactgcaaccgaagaatattgggcaaccgatagcagaccggaaagcttgataagtccaagcacattgagcccgccggcaccaacggcgtcgcctggtccggagaagccgatgaaaccgccggcttctcccttggccgtgaccgtggccagattggtaaggttcgtgttggtcacgtcaccaccggtggcgcatccgatggcaccgcccgcatagtatgaaccggccgtcaccgtcaaaccggatgccggagcggtgacagacatgttctccacggtgaacgcggcaaactggtcgaacttcttgagcgtggcgatatcgccaattttcaccacactgttgagcaacccagctaccgttgtcggttgcagattgccggcgatgccacccgcgtaggagcccgtggccgtgaccgattcaaggccttctatggtggtggagcgctgctgagggaagtcacgaggattgttgtacttccagaacgtaaggttcttgagatgatcctgtgaggagtcgccgatcaccgtgcccgatccttcgcccacgagaccgcccgcgtaatcgccaccagccttaacggtgagggagcccttcatctgcgtgccgagaatcacggagggattcacaccgacgatggacagcagttctcccgcaccactaccgctgccgctcagcaatttggccacagccttggtgagttgtttcagcagcgatgcgttcgcggcatcgtccgtgccgagttccaggccccatcccacggaggcgaatccggtgaatccgccggcatgggatttatcagtagacacggcagccgtggctgaaatcgtattattgaccgcgtaggcattggccatcgcgccgctaaatccaccggcatagtccgtggcagatacagtgaccttgccatcgccgtcgacggtcaggttgctgttctcgatgaggctctgcggacgcagcgcagacagcaagtcgacgccaagcgagttaatcagaccgcccacgttgccgttgcgacttattccggcaaaaccaccggcatattgcgttgcccgcacggtgaaaccattcgtgctcgtcaccgaagagttctcaatgattgcaccaatctgcgcaccgacaaagccgccggcctgcgggttatccttgttgccgatcaccacgttctctttgaacccgttcaccgaactattcgagataaccgggttatagtagccaaccggaatcaaggcattcagcccgagcgtgccggacagcaaccagtccaccaaatcgcccagcccgaggaacgggatgacacccaagatcttcgagagtacattggtgagcgctcctacgatgccggagactgcatcgtatcgggttgcgccctcaacatatcccacgaaaccaccggtcatacggcttacgctagataccgaaacatctgctacctcgcagtccgtaaccttggtgtccccgtagatacggccggcaaatgcacccgtggcgaggttggaaggattgtctttgtgcagggtgagcagaccttgaagattgaggtcaagatctacttgtccgagtgtcaatagttttaacgccttcaacagtgtgtcgagcagtaatcccactgccgaagtgagcataccgagcaaggtcggcggaatatacgattcactcgtatgattcgtcaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggccgagctgcggtagcgtgaaccacgcttgcgccatcggcaccaacagccttccacaggctggcttcggtgtcgccgtcattggagaccgcaccgagcatagtgccggagaacatgagcggagtccactcggtgttgttggtatctgccgcgttcttggacaggtcgatgtcacggaagatcaggtagttggcgtctgcggaataggtcaggccggtgttggcagcggagtagtccgtttgcgtgccatcagcacccacgccgtaatacttggtgcgggtcctgttgacgcttaacgccgtgcatgccagcagtggactgtcgtggtcggaggcatcagtatcgcgcaaaatatctgaatcggagagatcggcgtcaccggcgtattcggaagacggcgtgccgtccacccactgataattgagggctccttgctgcatgcaagtctgcgtgaccttgttgatgcggccaataaccttcttgccagaaccaatcgcacgcagctgctgctcgttaccaatcaggatgtaggtcttgccgttgatctccttggtgacctgaccctcaaagtcacggccgccaagcgccgtcgcggcgacctgcacatcggccttcgccggcgattgatccgtcgcatttgaggaatcgttcttggcatcttgagaagaagcatcgtttggagcctgcgtttgggctccatcattagcggaattgccagcggtagcttctgctgagtcgtccgccttattgtctgtcgcaccatttgaggattcggaagaatcaccagtagtagaagatgaaggagatgaatcctgctgtgcgtcttgattcgtttcggaaggtgttggcgcaccgtttgatgtattagcctcttctgacgtcttatcgtcaacgttgacattgcgagcagaaggagcagctacgacagtattacccccccccctcagaaattacggcgttaggagagctactcacatcgtctatattctgagcatatgctgcaggcaccatgcacacgatggacaaggaaacagcaataaccgaagcaaggcaacgcttcaaagacaggcactgccgtccagattcccgttctgttcctccgttaaacccgcaacggacgaacttcaattccgagctcattgtttcccctcatagattcgcaatcccctttcgggaggttactgcatacaactatacggaagaggttgacaaaagaacaaaaaacgttcatttgctggggccggttagcgtatgtctttctgagcaaaaagaaaagccccgcagctatgcagggcttttccaacgaggtcatgagagaggaagagaacgaccccgtttaatggttgacgaagctttaggacctcgccaaatcactcatcattccgcactttcaagtttacgccaatctcattttcgattttacgctgttttgactttcaactttacgccaatcttactttcgattttacgccgacagcactgctgacgattacactttcgatattgagaaatcacaagaaagcagcaaaaagggcataagaaaacccgcccgggaaagagggaagactgggcgggttgaggaagggaagaaaaggaggtcagttatggattacttggcggcctccttggagtccttgttcttcggcataacccagaacttgagcagcgggtagctcacgatcacggcgagcagggtgttgaccacggaagcgatggtgccagcaatgccagcgcccatgccccaaccctggcacagaccggtcacatagcccggcagcacaaggttcacaaccacgatgatcacagcgaggatcacgtacttccaagcggcatccttgaagctggagtcagacttgaacacccacttcatctgcacgaagaagttcaccacctgggcgagcgcctcggcaagcaggaaggtgaggaagccgcccagaccgttgccctgagtgtcgtagttgaagatcaggaagtggaacggctgcgtcaggcccatgccactgatgaagatggcggtgccgatccacgtcaccacgaaacgggtgatggtggagatgttcgacagcacgttgaacaggatgaactcccagatgttcgggtggtccttgatccactggcggatcggaccgaccttctcagccggctgcgttgcgttgttatcagtcattgttcagctcctttgcagtacgcttatttgcggattggttgcggaagaagccggcgatgacgccgcccaatccgcggaaggtgtgtccgttggcgattttgacgatggcgtcgaccatcgcggaatcgaccatgccttgggtcatcttgctcatggctcgcggaggcatgttcaggatgaacagggtgttgaggtccggagcgccggtcttctgacgaatcttggcctcctgcttggtgagcgtcttggcgacggtacgcgccacgaagcccttggaatccacccacgacatgatcggatcgttcacgccgaacgtcaccggcttgcccggtgccacaacctcatggccgaacagcacggccatttcggcgtcggtcacttccttgacgtggccgctgagataatggccgagcgcagtatccgcggcaaccggattgacatcgcctgcgacggtgcgcggaatcgtaagcggcaggtgttcggcgttgtcgcccaccatcagcgtccactcgccggtttccgtcttccattcgttgctggcaacgtcgaagtgacggaaggtgtaacggtcgaaatcgatgtgcacgctcttgctttcgtgtgcggcaagcgaaaccttggcgaagcccttgagctcgcgatccggacgcaacacaccaccctgcggaccgcgcacgtacagctgtacaacggtcgaaccggcaacatcggaatcgttgctgaccatcacgtcaatgccgttctcaccagcagtggcggcactgtaggtgaacgtggagtagctcaagccgtaaccgaacgggaagcgcacgggcacaccggcggtctcgtaataacggtagccaacgaacgggccttcgcgatagatcgcatcgcgaccaatcgccggataccaaccggagctcgggcaatcctcgtaatgcatcggccaggtttcggccaagtggccggacggattgatctcaccggtcagcgcgcgcacggtcgcggaagcgccggcctgacccgacagacccacgtaaagcactgcggcaacgtcgtcaatccacggcagttccaccggagagccggcgacaagcacgaccacgatcggcttgcccgcgcccttcagcgcttcgaccagatcgttctgcacctgcggaatcgccatggtggaacggtcaaggccttcggattcgctgcgttcgtcaagaccgacgactgcaagcaccacatcaacgctttccttgccagccagcgcgactgcgtcttccacgagcacgcggtcagccttgccctggcggtcatagccctgctcatagccggcaagcacgaggccttcggcgttcttgacctcttcaagaatgttctcttccttggtggcgtttaccttggaggagccggaaccctgataacgtgcggttgcggccatatcgccgatcaccgccacgcgggtgccggccttgaatggcagggtcgcgttatcgttcttcaacagcacactggagccttcggccaccttgcgtgccacgtcgtgatgcgctgctgcgatatcgtctttgagcagatcgttacgtccaacaccgaccagcttggtcgctgccgcgatttttgcgacttctgcggcacgcgcgttgatatcggcttcagacagggttcccgccttgaccgcgccttccagctcacgcacggaagtgaagcccggagacggcatttccagcgatccgcctgccttgactgctgcgaccgcggagttggatccgccccagtcggagacgaccatgccgtcgaagccccattcgtcgcgcagaatctcctggagcaaatgtttgttttcgtgcgcgtagacgccgttgatctcgttgtaggaggtcatgatggtcagcggcttggcttcacgcactgcgatttcgaaaccggtcagatacaattcgcgcatggtacgctcgtcgaccacggagttgctggcctggcggcgcagttcctggctgttgaccgcgaaatgcttcgggcatgcggagatgccgttgctctggatgccgcggatcaggcctgccgccatacgtccggcgacgatcggatcttcggaatagtattcgaagttacgtccgcacagcgggttgcgcttgatgttcagacccgggccgagcagcacgttcacgtcaagatcgtgcgcttcgctgccgagggcctcgcccatttcttcggcgagcgccggatcccaagaattggccacggttcctgcggtcgggaagcaggtggccggcttggatacgccgatgccgagatgatcgccttcgccgagctggcggcgcacgccgtgggggccgtcgctcatcacgaagctggggatgtctgcgcggtcgttgcctcgcgaatcccattcggatccaccggaaagcattgcggccttttcaacgaccgaaagttcttcgagttccattggttctcccttgcactaactcctcgaacccgcttggccctccctgagcctgcgctgttcttgttgcggatgttcttggctgcatcgcatgtgagcatccgccgctagtttgattgaaccagcctttcgccgccaatctgcgccccattacacaacctgtcgttttgcccgcacaatcggacattccttaactgatttcggaatcaaaggaactcacatggcagatacgtttttaccgctccgccgcgctttcgtatgcgttccatacacaccatacggcgtaggaaatgagtggacagatggtggcggaaataatcacgtcggtcggatagtgcaagccgagcagcaatcgagaacaggcgaccgccacgacaagcgcgacagcgccgatgaccgccctgcggaggaacacccgtcttccgtttgcacgcccgtcatcttctccgtcggggaagcgtttgcgcgcgaaattacgcacggtaagaatcatcatgaccgatacgatcaccgcggctgccgtgtgaccactcggaaaactcggatcgcctggcaatagatcactgccgacggacgtgatcggacgggggcgttcgaccagccatttgacaccggtcacgtacagtatcggcgccgccgacacgacgacatcgcggatgacgacgcgcctgctgccggtaatacgcaaatcgacagcggcaagcgcggcgacgattgcgatgcagcctaccgttgaaaacaaatacgcaagtaccgtagagcagtcgcgcaacccttctggcagcgccgctaaagcctgcaaaatattggtctcacgcattgtcgcgattgccgaattgcgcagtgcgacgccaatcataggcacaatgccgcacaatatggcggttgcgattaccacagccgccgctctcgcgatgcttccgttcttcatatgcatgatttcagttaagcacagttcaccataccgttgccgtatgttcacatccggggtatccccgaaaatcgaagattatccttcagggggcttccccgacacgcgcgctgcagacggccgcgcaacacaaatatggcatacccacacgggaagtaccgcgaacgatgcgagaatcggaattggcgtttaagaaggaaagaaggaaatatgaccgaaccaatcgcaatgaccatacgccatatgaaaatcgaggattatccgctggtatacggactgtggacacgatgcacaggtttcactatgagggatatagacgattgcgaggatgcgataaagacgtttctcaaacgcaatcccgacacctgtttcgtaactgaggacgatgacggaaggatcattggcgcgattcttgccggtcacgacggaagacggtcacgcatctaccacacggcggtcgaccccgacgcacgcggtaggggcattggctcgatgttggtgggccgtgtggttgaaacgcttcgtgcaatcggtctgccgaaagtcgctgtcggagtgcccgcagacaacgacgccggcaacgatttctgggaacggcagggctttgcagtccgtgacgatttggtttatcgagaactgccgttgtaataacgaaccatccacgatgccgtgcacgtcgcccagcccacgttgttcgcggacagcaagtagaagccggccagcatgccgccccacccatggacacgtaggcagcggaggcgatgccgcggcccaacgcgttcattacgtggcgcagcagccacgtgtcaagaggcccctgccgtaacggaagtccgagaggccaccgatggtggatcgctgttcggacggaagacacggtttaggcgagcgagctatgccttggctagcttcttgtgcctgagagtgtaaacggcatcggcggaatcggcgacacgcttggaatgcgtcaccacaatgacacatttaccgagttgatgagcggcatgccgcaaaagatcaatcacctcatcagtcatttccggatccaggctgccagtcggttcatccgccagaatcgcgcggccgggcgccactagggcacggccgaccgccactcgctgacgttgaccgcccgacaggtgcatgatgttgcgcttcgattcctcacggctcagtcccaaatcctcgaggatcttcatatcggccttgggattgaccaaacgcagattctcttcgggagtgagatagtcgatcagattatggtcctggaacaccaaggacacgtgctcgcgacggtgctttgaataacccgtcgtagctatatcctcaccctcgaaacggaccactccatcagagggggcatccagaccggccaacagggacagcagtgtgctctttcccgctcccgatggaccggttatcgcatacatctttccggattcgaaatcagcgttcacatccgaaagaacgcggatcttcgccgcgccatatgagtaattgacatggtccaattgcagacagatagtcatgattaatatctcctaacgcatagaggaaagaatggttttcggggatttggccagcaccgcggcgcacgacacggcaagcgcaatcgcgatgaccgcgcatccgagcagcaggatgagcagcgtctgttctggcggcagagcctccacctgcaatgattcaagaggcgcgactccagaatcgtgcagcagaagcgaggacacgtatccagacaatagggagcccgtgcccagcgagcacagggctgcgaccacagccatgagaccggtttcgattgcgaactgggcgataatctgcatcttgccgatgccgagagccagaagggtgcctatctcatgaatacgtgagcggatccagaagacaagcgccatgcccagtaccaacacatcagccaagcaaacggacaacagcaccatacgaaccagatcgcgcaccgtttccaccgactgcagcacgccggaaagccgcgccgagtcatcggtgacgccatacttgcttccagcgatttttttcgcttgggccactgcggcggagagagcctgcggattatccgaaagacaccggatcgtgccgacccgttcctctccagtcagcgcggaaaccacttgggcacccgcatagataagattctccgatgcgtccgatggcatagggctctgtgcctgcacattgccagagaagattccggccacgcgaacggtggaatcgcggtcttcctgactgagccggagtgttgatcccaccgatagcccattctcacgtgcgaaatcccggtgaatcagtacgttccggccattacctgaaatgtggtgtccttgttccaaccggtacagaccgctttggaactcttcggacaacgaggagtcagtggtgcccagcacgctgacctgcgtggatagaccggaatccagccgaggaccatgttcggggacaaccggatgcgctccatccacccctgccaaggtcttacgctcgtaaacggtttttcctacgccggggatgcgcgagaaccggctcgcttcctttagacttgcaggattctcgcctgtgtcgacagtaaaacctattcccatgcttctgccgatatcgtcggacattttctgaagtgccgttgacactccaacctgagccacaagactggtgaaaaccatcagcatcagcagtccgatgattccgctgcgtaccggtttacgcacgattgccagcgtggcacgattccacacgttcatgcccgtcatcggagctccgacaggcttcgcggcgacttgcgcagcatcggtatgcacgatatggcgacgcataccagcatcaccgccagcaggccgagcgacacatacagtacggcagtcgtgtcgatcgataccgtgagcgaatccaaggtacgaaccgacatattggattcgagatcgccgccaacctgccccatgctgctcagctccttcgccgcggaggcgttcacggaacggagggccgaagtgccaagccattgggccactcctcgtgcgcacaaccatccgagggccagggacggcagaccgatcagaatcatctcggttagatattgggcgatcagggatggcttgccgatgccaagggacaccagtacgcccatctcctgacgtcggtcgttcatccacagtaagagcatgagactgagaactatcacggccgaaatggtcacgccgatcaaagcgccgagcatcatggaacgcacacctcgggcggcattcagcatgctcgacgtatattggtcattgcgcgtgatctggtagttgttccaatccactggaagcttcttcgccgcttccatggttttctccacgtcgacacccttgtccagaacgaaagtggcatcctgatatatttccttgccggccttgtactggtacagagtacttgtagtgtccaaatcggtgtacacagtgttggaggtgagttccgcgcggctggatacctttctgtcgctgtctcctttgaatattccaacgatggtggttttgacggttgccgtcgaatgcgactcattgtcggcatcatatggattggccttgagcgtgagggtatcgccgactttaagcccattggttttggcgagatcctcatggaccatcgacatatgcttatcggatgccttgagatgacgtccgtcgaccatgctgagcgtgtgcgacgtgaacacattgagttttgacgaatcgtttgtgcctatgacgttggccgtattgccgaactgctgttctttctccgcatcgtaatcatcgccgccggggaccttcaccacgctggctcccacgagatcggcggtggcgttctgcctgaccatgtacgagtcaacaccggacagcttcgagattcgttgcacatcagcgggacgaaccattccgcctccgcgaggtgtcagcatgctgccttgcaggttactggccagcacgaatccgccgaccgcctgtttctcaatctgtccggcctcatgttgcgctgcccgagaaactgcggttgcggacagcatactcgccgttatgatggtcagcacaatgaacagcactgcggtgcgcactcgctttctgagcacatagcgcgccgctcgtgagatgaatgtcattaataccccctgtgaagctgggaccttctcatccgaaacaatgaaatctaattcgattcttcgattggtcattcgccaaaatacatggttcacctcggaacatggcaagatatgccttgagcgaaaaaacgaaacaacattggttgcattatgctccgggacatcggtcgttttgttcatttgacaaactttgaacggctataaaacagtgcatataccaatggaggccccaatcgaaattggggcctccatcagagagaaaggaaggagtggcaagtattggttatttattcggtcagaatcttggccttctcgttgacgcttcaaccgtctcgaccgtcttgacttcctcgtcggggatctcaccggccgcgagcttggcttcgagctgctcgacgatttcggcgtgcatcttctcgttgatcttcaccttgaacatgaacaccagcaggctgagcacgatcaggtcgagcggcacatagaaggcgcagacttcgaaggtgtggatgttcgcggcggtcatgtcggcggcggtcgcgtcaccggtcatacctgccgcaacggcgatgaagccgacgatgccgttcgacagggcgccaccgacaccttgttcaagaaggttttcagcaagtaagatttgagtctttatcaaacgcctcggctgctgtgatgaaccggtccagcagccgaggcgttcccatatatgccccagccgttcccaaatccacctatccgcttcgccgacttcgtccaactttcccgacaatgccattgctcaatggcgacgaaggatcgcagaacgcattggccattgcctcacggaacgcctgacggccaaaatcaggcagattgacatgaaccagaccgctcatgatttcgtgattcggattccaaggcttcaatgcgttgatgtgcgagaacatatcaaccaacggcatccgcgaagggctcggcgttgacggccaaagacgcccctttcatcacttgaaacacttccgatgccatgggcatgaaacgtcggatcgcatccaccttgccgatggccagcactccggcaagcgatggttgcggaccgtagggaccgtccaccaccatcaacaacgcatggtcgaggtcatcgtcatctaacagcagcaatgtatcgccggaattggtgagacgaatcctgtcgcgcaaccgttcgcgcgcgacaggatcccagtcgtccaatcgtgattccgcgcgggctgggcgctgtagtcgtagttgcgcaactgggataggcgactgacgaaccggctcgggaacagcggcaccacctcgggcgttccatccgccttcagacggcgctgtcccgcccctggatactggacacaatctgcaagttgcggtctacctcgatacacgccaccggcaacccgttgtccgcatggatgatttcagcacgcaccacgcgacctgcggcaccgtcttgctgaagaagataaacaccgccagcccgtcaacgctgcgatgttccctgctaacaccggttaccgtgccgttgtcttcgatgccaaggtacaacgacccgttttttcggtattggccaacgccaccacgttgtccacgagctcatcgtcaatctgaggtcgggatgcctcgcttgtaaactcaaccgtcaagctttcatggttcagcagcacaagtttactcacattgataccgttccataaccgttttcgatgtgaataagctcacggtcacaacccacgataatcggccacggaatcaccgtaacggcgttatagtgctgtttgtcggcgtcgacaagagccagcggcgccgatgaaaacaacaccaaagatgttcagcgaattgttcgcagtacatgtggtgtgcatccgtttcctcgacgaaactcctcttgttccaaccggcaggtcatcgtacgccagttgcgaaaggattcgcctatacatggcaaggtttaccaagaatcgttggaccagcgcaatcatccccgcactattgatccatatcccaatcggtaccgtctattgctggagcgtgttcaagcagttgatcgcggaccagcttcacgccagccccgcctccgtggaatggggcttctctctcgccatcttctttctcggcatgtccgctgcattcgccgggccgatggttgagaaaaacatcaagaaatctgctcttatctcaatggtctgctttgtggtcggtttcgccggtacgggcgtgagcatcgccttgggattcctgcccggcgtgttcatctgctacggcgcgatcatgggtgtcggcctgggcatcggctacctgaccccggtcaagaacctgatgctgtggttcgccgacaacaagggcctcgccaccggtatcgcagtcgccggtttcggcttggccaaagccattgccagtccggtgatggaatacctgatcggctcgatcggcctggtgaacatgttctatacgctcgccgtggtttacgcgataatgatgctcgtgggattcctgctcatacgccgccccgccggctgggtctatgatcccgcgacctcctatgtcagccgcgtctcgattcttaagaaacccgtgttctggggcatctggctcgccttctacatcaacatcacctgtggtctagctcttatcagccaagagaaagacatcctgcatgatgtgctgaaggcgttcccgcagtacgctccgctaagcccgagcgcgttcgcggccgccatttccggcattatcggtttggtgctcgccgtggattccgtgttcaacaccgccggccgcgtgggcttctccacgctgtccgatcacctcaaacgccgcgaaaccgtatatcaggtgattttcgtgatatcgatcgccgtatgcctgctgcaggtttgcactaacagtatcgaccgcgctttgttgtgggccgtgttgatgatgctgttcctcgtcaacgccggatacggcggcggcttctccaccctgccggtactgctcgatcagcacttcggcacgaaaaccgtatccaccacgcatgggctgaccttgagcgcctgggcattcgccggcttgtccggcaatcagctggcgtcgttcgtcgtcacgcacacccccgatcaggcgcaccgttatgccgcgttgattccggtactcatcgtgctgttcataatcgcgctgatcagtatttcgctggtcaaggccgcaggcaagcgcgtcgccgtcgcctagtcccccataggttcgtggttcctagttcgtgggattacagcggataatcccacgaactgggtgcctgcgccatcgcatataaatatgcccggaatcaagccaaaacctgattccgggcatattcgtcatcgcgtggcattcggttcacagaatcaggcgacggaatcccgtgggccgaagcgtgctcacgcgcttatcaccgtttgtcacacgcttgtcacgcgccgatgagatcaagcatctgaggaatgctcttcttgccgaattcgacggtctgctcgccaccacggttgatgacgatgcagggcacgctcatcgcgccataatggtccctaagctcggggaagtgcgcaacatcgtaggcctcggcgcgcacggccgggttcagcgaggcgatgcgctgggaagcaagcactgtctccgggcacatcgtacaggtgagcgagacgagaatcatgatactcagcgggcttgcaatggactttgcccgttcgatcagatcatcgcccaacggctgaccaggaccagccacgttgtacaggcccaacacgaacgaattaaattcatgaccggaaggcacgccatggaaggcgagaccagtcggctcgccatccaccaccatgcgcacgcatggacgcgctgccggcagcacgctgtcgacgtcgaataccgcacgacccgtatcatccttctcgtactcaccatcatccaccgtcgatttcagcttgccaccggacagcgcgaccaacgcatcgatgaatccccgcagttccgtggacagcggcgtatcgtccagttccagagcaagcgtgaccggccgagacatgcggccaaagaccacgttgagctgctgtctggtggcgtcggagaacaattcgccgggcttcctaacggcgttcgccgcggcatcggcgttgcgtttggtggcgggcgcaggcgtaggtgtaggcgctgtagcgtccaacgaggcagcatctgtcttcgttgtggactgctcgtaggcgcaagagaccgggcgctgtggcgtcaaaccggttttctcgctcatccgcttggcgtaccgttccaactccactgcggcaatagcgccatcggcggtggcagtaaccacttgccgcaggttcttggcccgcagatcaccggctgcatacacgcccggcaccgaggtttcgagatagccgtgcgtgaccacgtaaccataatcgtccagctccaccacgccgcgcaccagattcgtggcgggcacatatccggcgaacacgaacacgccgaacgtgccgccatcaacaggtttccacgtttcggtctggccagtggcccggtttaggatcgaagcttcacgtaaaccaccttgcccggcagtgacaccttgcagctcgacctggtaacgcacgtcgatcttcggattgttttttgctgcggcggccaccgcagcgtcgcaagtgaagtcctgttcccgtacgagaacggtaactttggaggcgtatgtggtcagaaacacggattcctcggctgctgcgaaccctccgccgaccaccagtacttccttgccggcaaagaactcgccatcgcaggtggcgcagtaggccacaccgcggccagcatattcggactccccttcgaaccctagtttgcgtgggctggcaccggtggcgatgagaataccaaaagctttcaagtcgccgcgcgaagtatgcacggttttgacatcgccgtgcacgtcgaggccgatggcttcggcggaaaggaattcagcgccgaaatcctgcgcctgttgacgcatggtctgggtaagcgcacggccagtggtgcggccaacgcccggatagttgaccacctcattggtgatggtgatctgtccgccaaaatcatctttctcgagaatcagtacgcgatatcgggcacgggccaaatacaatcccgccgtcagaccagcgggaccgccgccgatgactatgacatcgtacaaatcatttcgagacataacgactcccttcgtgccttgatctggctattcaggaggtgcccggaggattctcctgggcaccccgtcggattagcttgacaagccgtccgtcaagcgacgatcacagttgaccaacaagatcaaggctaggttcaatagtgtcctcgcctggagtccagttggcagggcaaacctggtcgccatgttcgtggacgaactgagaagcttgcacacggcgtagcagttcttcggcattgcggcccacattggaagagatgacttcataagccacgaccttgccttcggggctcacgatgaagtcaccgcgttcggccatgccatcgacttcgttgtaggtgtcgagatccttggccaatagagcggtcgggtcggcaagcatcggatattgaatcttggcgatcttttcattggcgtcatgccatgccttgtgcacgaagtgggtgtcgcaggagacagagtagacctcgcatccaatttccttgaacttggcgtagttgcgggccagatcctcaagttcagtggggcacacgaaggtgaaatcagccgggtagaagaagaacagggaccagtggccgagcacatcagccttggtcacctcatggaactcgttgttctggaacgcgttcaccttaaaatcggtcagttcatgctgcaggagagtcatcatcggtcctttcgctgattgtcaattatcgggcttctgccgttttccatcgtaacgtgattctctggaacccgcgcgggcgtaacgcgtgagcctcatcacatcattactaacagtcacgctgacggaccatgcgatgcaagggtgttgtggattgggagcctcccgcgcgtcgcgggaaacaagaaccaaaagacaaacgccgccgcattcaacgttgggggttcccgtcgagcttcggctccgggaacccccatttttttatgctttgttgtgccggccagccggccggagcacgttgcctggggttcccgtcgggcctttcccgttgctcggcgtccggattattccacgcgccgggagacctagaacgccgagggatttcaggaatttcaggggagcctcttgcgcttatccgatggttgaatagactgaagaactatgcattatttcgtacccaaacgctgtgtcgaatcgaacaaaatcatgtatcacgacaaagcaacagcccagcaggccgccgaccaaagttggcgtgaacgcggcactgaactttgggtctatcggtgcgaattctgcggaacttggcatctcacgcatcgcgatccacaatccagctacacgtacgtgcctttcaatcagcagattaaaccgcattcccgcaaaaaaggctacaaaccacgccgcaagtagtagttccgtcagcgttcgaggcggaagccttggcgcttggcgtttggagccacggtcttgctggtcacaccgggatcgaccgcatttgatgcgatctgatcgctgaacgtatcaaccgggcgctcggtattgcgtaaatcgtaataccgatgcacttcctcgtcgaaatcctgcaaaccggcaagcaacgtctcattgttcgacggatactcattctcaaagaactgcatggaacgcggcatacgcggcttaagtgcaggatcctgatcgggcttaccgatcgcaagtcccagcacagggtacgtgtattccggaagattcagcagatcgatcagcgccggaacgtcattcagcagcgagccgagaatcacgcagccaaggccgagtgagtatgcggccgtttccatcgcatgcagggccagtacggcatcgttctgggcctgtgagtagtggtaactgccattcagcgtaaacgtgtcggaagtggtatctacgccctttgtggaagcgattgcggcattgcggtgttcgtcaagtacgaacacatacagcagtggcgcggtggcgatatacggctgtccgccgatttcggcgagacgcttcttggctgcgggatcggtcacgcggattgcggaccagtcattgaggaactggctgctcgccgcatgctgtgcaacggtttcaagggtttcgattacatcatcccccagcggcttcgacttgaatttgcggatggaacgacgttccagcagagtgtcaacagtggcattgtgaagaagattgctcatgtcacccattttcgtccgttttgcaggattacgcaaggatgccttggttcagccggtagaggattccggattcttcggcagcaggatccgcaacgtgaacacactgtcggtatcatccacctgcatggtgccgccgtactgttcgaccgtgtgcagcatgcttttcatgccgaatccgtgtcgggtggcatcctgatgcgtcgtaatgggcaggccattacgaaaacgcagccgacgctgatgatagttctgaatctgaatcagcatcaggttgccttgtgatgagaagcgtacgttgattaccctcttggatgggtcattcagttccatagtggcgttgatggcattgtcgagcgcgttgccgaacagtgcatagatatccgcgacctgcatgaagtccagtgaatcgccgctcggcatgcaggtgagttgaatatcgtgagattgacagtacaggcctttttccatcagtacggtattgagggccttgttgcctgtgtcgatgcgggtgtcatagatcatgatcgcccgttcggcttcggcgaagtatgcgtcacgctccgggctttcctgcatggtctgcagcgtgcgaatctgatgtttcaggtcgtggcacttacgattgatgatgtcgatcgtctcctggctgaccgtatactgcttctgttgctgcagcagcgtgtatcgtacgccgtcgagttcgcgctgcagttcggccttgtcatgattgctgcgctgagcccacatgatgtaaaagcagcataatgcgtcactgatgtggtagaccacgccatggagcgagacatcatcatggcacaacacgcccaatacccacacgaacagcagaatgcaggccatggggaacaggtcattgcgattcacccgataatgtccatgcactgcgagtttgcgtgcaaacatgatgaagaacgcgccgtagatggcgatatagatcaccgtggtcaacagtccgttgaggagcgtgggcagatcggcgttgtgcgtccgagtgcgatgctgagcgccagatagcattcgttggccgcatgctgcgtggcgttcgcacagatggtgcagtagagtacttccgacaatcccgcctgcagacacaacgccactgcgggaaggcatatgaccgcgaatgcaggccaatacagtatggccaacagcaggttgtcgggtaccgtgacggcggcgccgaacatataggcgatcattagcagaacaatggtgcatgaagcgaatcgtgcggggaaacgacgtcgttttgcgaccggaatcatgaacagtaggcaggccacgatgatctgtgccatgtaggaaacctgcagccaggcgtggtcgatcatacgctggtgcctcccatgtattcggtgagtgcgttcataaacggtttctttttggttcggctgattggcagccagtcgcatccgacctgcacggagtccttggccacggccgtaacctgcttgagattgaccagatagctgttattgcagcgttcgaacggcaatccctccagtttggcttcccagttgcgtagggagtcacgttgccggatgacgccttgtgtggtgtggaaggacagatggtgcccacgcacttccacatagtagagattgtcggatgaaatgcgtagaaaaccgtccgtcgttgggaaaacgagcgatttcctacgacgattgccgatcagtgccagaataccgcgcattttgatggagaaggagtagtagttgatgggtttgagtatgaaatccaacgcatgtacggcatagccatgaatcgccatctgcgccatgttggtgacgaataccagtggaacatcggcgtccatctgacgtaggcgttgtgcggcggacatgccgtcggtgccgggcatgtcgatatccatgcagatcaggtcgaaggagcggtcgtagccgtcaagaaaatcatcggcgccggcaaattcaatgatgacgattgcggatccgctctcctgcgcaagccgttcgaacgatgcctgcagggtcttgcgttcgtcggcgtcatcgtcgatgattgcgatcctcacggtgttcatgcctcctcattgcgacggattccattataggaaacgtcacatgctcgggtcgaatggcgaaagaaccagttatgcccctgggaatgaccagttacaccatccgggaaggtagggggtggccgtgccgcgcaccatggaattgacattgatgtcggtatcaacatgtgacaacgaaggagtcgagatgaaagggaattccggtctgctgtggcgagggctcacatcggtgacaggcacattgctggtgcttggcatctgtgggacgcaatgctcgtacatgtatgcgggaacgatcaactccgcgctgggaacgtccagcacgagaatcgtcgccggtgaaggcggcggaaacactacgtactacgccagcgaatatggcgacttgaatgccgaaaatctacagaagctcatcgccgacgcgtacggcgagtccgtgcttgagcaggaggagggttcggtgctgttgcgcaacaacgacggcacgctgccgcttgcctcagacaaacatgtcacgttgttcggccacgccgtggtgcagccggtctacagcccgggtggcgccaacagcgccgccgacatcggcaaatatgtgattgatctgaaatccgcactggaacatgccggtttctcggtgaacaacactctgtttgacgcctattcgaagagcgataccaagcgtgtggccagcaacaacctgcaggtttccggcgatccacgttcgaatggcgcgttgaatgacgccccggtgcttggcgaggagccggcatcgttctataccgatcagctcaaggccagctggcaggacgattaccacgatgtcgccatcgtcatgcttgcccgtgaaggcggtgaagacaaggagatgatgatgaaggatccggagggcatcagtgctctgagtctgcatcaggacgagaaggacctgctgcggatgatcaaggattccggcaagttctccaagaccatcgtgctgctcaattccgcctttccgatggaggtcggctggcttgatgactacggtgtggatgcctgcatgtggatcggcaatccagggcagcgtggtttcgaaggagtggccaatctgttggtgggcaaggccaacccttcgggccgtttgaccgacacgtatgccgtcgattccatgtcgtcgccggccgcgcacacttccagccagaactcaaaccaatggacgaacgtcgatgaagtgaacgccgcagtcagcgataagccggtcaatatcgataatgtgaccgtacagcccgagaacatctatgtcggctataaatactatgagacccgctacgcggacgccgtgacgaatccgggcagcggagcggccagctcggtcggagcttcacatggtgcctcggcatggaactatgcggacgaagtcagttatccgtttgggtacggtctgagctacaccacttttgaacagacgctcgacggtgtgagctacgaccgtgacaaggatgaattcaccgccaaggtaacggtgaagaacaccggtgatattgcgggtgcctctgtagtggaactgtatgcgcagaccccgtatggtgaatatgagcggaagaatctggtcgagaaatccgccatccagcttgccggctaaggccgtaccaagacattgcagccgggtgcttccgaaaccgtggacgttacggtggaccgctacctgttggccagctatgactacaccaaggccaagggctatattctgagcgccggtgactactatttcaccattggcgacaatgcgcatgatgctttgaataatgtacttgcggccgaaaacgccactggtatgaccgacttcgatggcaagccggtggaaggggatgcggccaaaacctaccggtggtcgtatgacgacgtcgacaccaagacctatgccaaatccgatgcgggcgaacgggtcaccaaccggttcgaggatgccgacgcgaactattggaaggatggtgccgtcacctatctgacccgttccgattggaaaggcaccttcccgaccgaaccggtcaagatgaccgctaccggcaagatgatcgaactgcttaagggtgatctgtatcggcagtccaaggattccaagtccgtcagcgactacacgcagggagccgacaatggtctgacgttcgtgatgatgaaagacgtcgattacaacgatgacgagacctggaacaaatatcttgacgaaatgaccatcgatgagatgaccacccagctttccgatttgttcggcacggccgaagcggcttccgtgaaccgaccggcgtatgcggttggtgacggtaccgccagcgtcggcggcaatacctacgccaaagagtacggtgacgcccgtgacgtcaccctgtatccggcgaccaatgtgctcgccagcacttgggattatggacgcatgcaacgtcgtggcgaactggtcggtgaggaagccctgtatgccaagaccccggtcggatggggtggtggcggcaatctgcaccgcactccgttcggcgggcgcaatggcgaatactggtccgaagacagcatcatggtctaccttgacaacctcgtggaactttcagctgctcagaagaaaggcttcgcacagggtgtcaagcatgttgcaggcaatgatcaggagctgtatcgcgaaggtctgaacatgttcttcaacgagcaggcattccgcgagggtgcgctcaagggcgtggaaggcatcgtcagcaacgagaacgccaccgctttgatgatgtcgttcaacagactcggtgtggtctggtcctcagccagcaccgcgctgaccactcaggtgatccgcaacgaatggggctttaagggcatgatcgaaaccgacggcgtggccggcggctcctacaagtcgcatttcccgtcatcattggcagcaggcgtgaccacctactgcatcgatccgggcaataccgcggccgcaggcatcaagaatcagatcgaagacaatgacgacggcgatatgctcggctatctgcgcacctcaatgaagaacttccactatgcgctgactcgtaccagcctgatcaacgggttggatgccaacgccaaagtggtcaaagtcaccccttggtggcgttacgcgatcttcggtgtggatgcggcgtttgcgttgatgacgcttggctgcgcctacatgatgtggcgttccggacgtcgaggcaagaatgcgcgggaaacggtcaaggtcgaatccgaaaccgcgacgggaaagtgaggaatcattatgaatagcagaactccatccatgttctccaacagaactatcggcttttacctaggactcgccgccggtgtgatggccatcgtctcactggttgcctacgccatgtatgccgttgccgccggctcatacaacgtgtgggtcatcgcaccgcttgtgttggtcgtgcttgcgcaggccgcgaccatacctcttgacaatgactggctgattgccgtaacgccggcgataggcatgatcgcatggtgtgcgttcgtcatggaatgcatgtatacgttcgtcggccatttcatgaatctgaacatgttcggcgaccagagcctgttcggtccggtcatgacggtgaccgtgctgaccgcagtcaccgtgctgatgctcatggtgtcgtcgttcatgcgtaagcgtaagtaggctgccggccctccgtcatttgtcagacgtcgttcgggcgaaggggcgccacgatcgttcttgcgcccgaatgacgaccttccttcgtgaacgtctttgaaagcaccatcatgaacagaatcccattcaataccggctggatgtgccgtccggccgcatccgaggccgaggaagtgccggtgaccattccccacgacgccatgcagtgggatccgaaaagcgccgacagcccatccggagtgaacagcggctggtacagcgctcgcgactacctgtacaccaagcatttctcttccgccgacattcgcagatcttccggtgatctcaccctgctcgagttcgaaggtgtctaccgtaatgcccgcatacgattgaacggtaggctgatcgcctcccatgattatggctattccggcttctatgcggatctgagcgagtacatagccgaaggcgacaacgtgttgacggtcgaagcgcataacagcgaccagccgaactgtcgctggtattccggtaccggcatctatcgtccggtatggctatgtgtcatgccggagcgacatatcatgcccgacggcgtgcgcataacgacggtcgattaccgtaccagacgcatcgcggtcgacgtacgcaccagccatccgggagtcgtatatgtgagcgttcttgatgtcgatggcaggtccatggcgcaattcaaggcgttgtcggatcggctcgatgggcagggcaatctcatgcatgaggaatgcgtgattcccgatgttcgcctgtggaacaccgatgagccgaatctctacacctgtgtggtgcggttcggtgatgacgagcaacgtgaggtcttcggcgtgcgtacggtggaatgtgatgcgcgacggggattccgtatcaatggcgaacgtgtgatcctgcgtggttgctgcctccaccatgacaacggactgctgggtgcatgcgcatatccggctgccgaggaacgcaaggtggcgttgctgaaaggcggcggttataatgccatccgttccgcgcacaatccttgttccaaggcgttgcttgacgcctatgaccgactgggcatgttgatgctcgacgagtatgtggacggctggtacatccacaagacccgctacgactacggcactgaagtggaggcgaactatcgtgatgatctggctgatctggtggccaaggactataaccatccgagcgtgatcatgtattcgatcggcaatgaagtgtcggaaaccgcgcagccgcgaggtatcgctctgaccgatgccatgacgcaatatctgcatgggctcgatgcgaccagaccagtgacctgcggcgtcaatatcttcttcaatttcttgtcatccatgggacttggcgtgtataccgacgaaaaagcgatgaaggaaatcgaacattccggcaagaagaaggcggtcggcagcgaattcttcaatcggctcgcaggcatcatgggagccgacttcatgaagttcggtgcgaccttgcctccttgcgattggaagacgcgcggcgcgttcgccgtgatggacgttgccggatacaactacggcatccgccgatacaggcatgacctgaacagatatccgaatcgcgtgatcgtcggctcggaaaccttctgctcggatgcggcgcgattctgggatttggcgcagagcaatccgcggctgatcggtgatttcgtatggtccggtatggattatctcggggaagtcggtatcggctcgcaggagtatgcggaatatgccaagaacttcgacggatcacttggctgggtgagtgcgggcgccggtcgattcgacctgaccggcaagcctttggcggaggcttcatacactcaggtcgcattcggtctgaaaccgattgcgatcggcgtggtgccggtcggtcttggccgtgaacattcgccgtccgcctggaagatgaccaatgcggtcgaaagttggtcgtgggacggtcaggaaggtgaacgcacgcaagtggaggtatatgcgcgtgccgccagggtgaaactcttgctgaacgggcgtgaaatcgggtcggctcgtgtcggacgtgacgctcgcgtgacattcacggccgtctacaggccgggcagtctgacggcggtggcgtatgacgccgacggcgtggaaatcgcgagaacatcactggccacggcgggcaaggaaacgagattgcatgccgtgccggaagcggagcgcatcgcgctcggtgacgggctcgcatatgtgcggttcatgtatgccgacgctgcgggaaccgtcaaaccattactgcgaggtgacgtgcatatcgaagtggaaaacggcgaaatcctaggttttggcagcgcctgcccatactacgagcgtagctatcgcagcgataccgccgacacctactacggcgaggcgatggccatcatcaggccttgcgagacgggaatcctcagcgtgaaggcaagcagtccgtacggtgaggccacggctcgaatcgaggtgagataatggcggtcaatccttggcgaacctttgcgaggaatcatccgaaggccgcaaaatgggtctggcagataggcgtgttctatctgttcagtctggcggtcaccgtgctgcaatatgcgttgttcacgttcctgccgtatctgtttggcgaggggctggcctccacggcattcatgtggccgcatattccgatatcgttcgcaggcatcgactactcgtggaatgtgcttggctatggggtggcgcgcaatgcggccggggaagtggtgatcggcggtggccttggatatttcctgagctatgagatcagatcattcgtggcgcagtgcgtcaacttcccgctgcaacgcaacgtgacgttcaaatcacatggcaacgtggcatatcagatactgtggtacttcatcgcatgggtgctgatctcattgttctgcaacgccatcaacggcctgtggctgccgttggcgcaggtacggttcgatccagccgtatacaatctgctggtcacgttcatcaccggaggcgtgtccatggtgatctacttcttcgtatacaagatcatcttcccggagggcaagtcggacgatcggtgatgatcgtgctacctgcgcttggcgtggcgatggttgacgatggccttggaaccgcggtcggacagttgcgagaccagtgcgcctaaggctgcggaaatgacggcgaaggcgatgccgaggatggcgtccttgcgtgcgtcggtggtgccgtcgggaagggtcgccttgcggccaacgctctgcttccacgccatctcgaacaccttgccgaacgccagtccgactagcgtaggcatggcgaatttgaagattttgtcaccgaaggaatcgggatcgttcagtctctgatcgcgcttggcgttcactttcccgtcgatgttgcgcagggccgctaccacacggtccgctgtagattccagatctggcgtttcactcatggttccatagtaatgcgtgatcgacgtgctttcctgccaatccggatgggcgaagcgcgtagcggaatgatgttgcgatttccgaagacacgagggagcaagtgcaggggttcatgggcggggtcggttagagtagggatatgactgaaaatcatgttggaagcaaggacgcttccgttgttgcgcccggacgcttggtgctgttgcgccacggacagacggtgtggagcgaatccggtcagcataccggacgcactgatattccattgaccgacaccggtcggctacaggccgaatccgcgggagagcgtttgcgttcggccttcccgaacggtttcgatccaggctgcatgttcgcaagtccgcttcgccgtgcccgccagaccgcggcgctcgccggttacggcaattacaggatcctgcccgagatcgccgaatgggattacggtcgcgccgaggggcgcacacgccagcaggtcagcgaggccagcggtttcgcctgggacgtatggcgggatggtccgcgttcgctgaaccccggacttgaaggcgattggattgagacattgccgtccggcgagcaggttccggtgcataacggtccgggcgaggacgtggaggaggccgccgcgcgtacccgggacgccatcgaacgagtattgccgttgctgaacgtcggccacgatgtgctgctggtggctcatgcgcatattctgcgcatccttacttcgcaatggttgggcgtcgacccgcatttcgcccgtctgctgcggctcgataccgcgcattactgcatcctgagccagtacaagggtgacaatgtcatagagcgttggaactgctgaagacatatcggatggaaggtcggttgcctaccggcatttgcagcagtctggcacaatcagccgtcataacggcggtatgacaatgatgtaaacgcattcagcatataatgagacaatcgccgtaagacggcgctaatcatatgcaaggagtgcgcatgcaagccaatatcgaagacgtggcgcagctggctggtgtctccatcgctacggtttcgcgtactttcaagcatcctgacgtggtagcgaagaagacacgtgacaaggttctggctgccgcaaatgaactgaatttttcgatctctcactccgccactgtgtttcaggccgggcggacgtaccgtattgccctattgctgaacgatcgctttgcgtcatagttcaacgcacgaatttacgagggccttgatgcagtgttcaatccggccggttacgacatctccgtctaccccatctccaccaaggaagacaggcgcacttttttcgagaacctaccaattcgccgcaacgctgatgccgtaatcattccctccttcgacatagaccctgatgaggcgagtcgtttgcaaagtgcgaacctaccgcttgtcggcattaatgcattgcctgaaagcgcctttacgttgtctgtttccatcgacgatgagcaggcgatgcgactcgctacgcggtaccttaaacttttacacactggaatcacagtgatttatacattattagaatcatgtgcggcgtatccattcctgctggtttacattcgtttgcaattgtggataagaagtacggtgtcttctttaaccgtttcatttttgacaacgttggcagtatgatatacgtagatatgttcgcgcgcgcacaacgaatgtgtcgcgtgccgtgcaagacgagaagtagcaaaggggcatcatgaccaaagtaggcattcgtgaggtggccaaagcgtcaggcgtctccgtttccacggtgtcgcgagctttcacgcgtcctgacttggtatccgataaaacacgtcggaaggtgttggaaaccgccgacagacttgatttcaacatttcccgttccgccacggcactcaagtctggcctgacctatcgtgcggcgatgctgatgaatgaagacatcaccagttggttcaataacagggtgcttgctgggttggatgatgtcatgcatggtgctggctatgacatttcactgttccaacatatcgataccgctgagaaccgcgaacggttcttcaccactttgccggtacgtcgcaatgtggatgcagtattcgtcgcttccttcgccgtcgattcgcgtgaagttgagcagctcaagcgcattcgtgtgccgatcgttggtatcaatacgccgggacgtgaagatttcgatgccaccgtatgcattgacgacgacgagggcatgatgattgctacgcagcatctcatcaatctcggtcacaaatacatcgtgtacatctgctcgcgcgccgccgattcgcttaatgcctctatcgatgctcgtcgtcagggtttcatccatgcttgtcagaccgctgagacaagccacgacctgcactggaaggtgcttgaagtgccgcgcgatggtggctacgccgacagtgccttggcctcgttgttggcgcttgatcaattcccggatgcaatctgttgtcaaaccgacaccattgcgattccgctgattgtgcgactggaacggtatgacaagctcacgccgcgggattattcgattatcggatttgatgacagtcagtatgcggatatcatgaacctgaccaccatgaaacaagatccgtttctgatgggccgtaaagccgcacataaagcgctcacactcattaatggggagactctcggtcagccgcatgaaatcatgcatgctcgcctgaccttacgtgagaccgacgcgccggtgcagttggtgttgcgtgacaatgaccgggcaatcaacgagtagcgaacctaaagggccatgcattggctgtcgctcactctgcaggaaatacgtcagttcgatgtaagcggtactgcatatcgatagtgttgtatgctgtgacgtcagcgacaactccatgctcatcatggcttacggcatcggcgcgattttcattgccgtgctgttcgtcatattctgatcttacatccggtgatgttgtcgctgtttgcactgttctagtccgctcatgtgacgatgaatgcgggcagtgtgcaaaacgtcgtagtgcaaacgtatgtcataaaacaatatccaaggatgcggattgttgatgtggtgtcgccataagcgccgcaacatgccgtttgttggtattgcaaacgatgtcaatctgcgatattctaaagatgagaaacattcctgttgcactatctgttcatgatagtgataacaggctcagggattcatatgattacgcagtctggcaatgatcagccagcaaaggagagcgaagatgccgaattcaccagtcgctgcacccagaaacgaagaaagcgccgaacgtcttgcacgtccgttgattcagctagccaaagccaacggtatttcgacatcatacatcgatcagttgggcgcttatgtggagattcgcgacgaagtactcgtctccgtactgcgggcgcttggcgtggatgcctccaccgatgaggcggttacgaaatcatatgaggcaactgtgcgtaagacccagactacgctggtgccgtcgaccattgttaaattcctcggtacgcctaccgccattccgattcgtccggcaggccggaacgttacattgcgcctgctgctggaagacggtaccgcctacgcaggcaatctggcgatgtgcctattagcagagaatgacggtacattgagattgaacctgccagatgatattccctctggctatcacacgttgcgtatcaatgctggcgacgcatatggcgaggcgacgctgatttgtgcacctgccagtattccggtcccgaaagcggtggccgataggcaacgttggggatggatggcgcagatgtattccgtacgttcctccgaatcgtggggtgtgggcgattacggtgatttgcgacacctcctcaaggacgctgcagaaaaaacgcatgccgactttatgctgatcaatccgattcacgcatgtgcgccgatcccgccgttggaaccttcgccgtacctgccggaatcccgtcgcttcctgaatgtcacgtatattcgtccgcaggatatcgccgaatacgctgatctaagtgaatccgataaggcggaggtggcgcgtctgcatgcgcaggtgtcggctgccaatgatgatgtgaatccgatggacatcaattccgcatggtgtcataaacgacaggcgctgaaaatcatcttcaggcaaccgcgttccgttgagcgtcagtctgccttcgaacggttcaaggagcaggccggtccggatttgaaagcgtttgctgcttggtctgtggcgttcgaggtgtggggtgcgccgtgggaaacttcctggtttaacgacaccaatcgtgactcgccggaagtggccgaacttatacgtgagcatgccgatttggttgaatttcagtgctggttgcagtggattgccgacgaacaagtgtcggcggctcagcagattgccaagaactccggtatggcattaggcttgatgcaggacatggccgtgggtgtgcattcgttaggtgcggatgtgtggtggaatccggaacgattcgctgtcggtagcgtgaccgtgggctgcccgcctgacttctacaaccaacaggggcaggattggggtcagccgccgttcaatccgaattatctgaacgccaccggttacggtgtgtaccgtgacatggtgcataccatgttcgctcacgccggtgcggtgcgtatcgaccatgtactcggcctgttccgcctatggtggattcctcagggcgaaggcgccaagaacggtgcctacgtgacatacaacgttgatgcgatgatagccatccttaccatcgaagcctcccgtgcggacggcctggtgatcggtgaggacttgggtacagtgccgaactatgtacgcaaggtgcttgcttcacatggtgtgcttggtaccgtggtggagtggttcgcacgagtggatgactctcccaacgcaggcgatccatacgatgatccgaccaactatcgcaagtatgcgttagcgtccgtcactacgcacgatctgccaccgaccgcagggtacctgcagttcgagcatgtacagttgcgtgagcggctccatctgcttaccgaatcggtggaatccttccaagcatcggccaccgcggaacgtcaggccatgctcaatcgtctgcggacacttggtctgatctccgatgaggaagctgacgatgcggacagccacatcccgcagattgttgaagccatgcacgccatgctgcgtaaatcaccatcgttgctaatacaggccgcactggttgatggcgtcggcgagcgtcgtacccagaaccagcctggaacgtccgatcagtatccgaattggcgtattccgctggctgatgagcatggacgtgtcgtgcacaccgacgaagtgttcgatttgccacgagtcaaatcgttagctgccatcatggatgcttgagacagaccgtttccttagcatagctgagtcaagagccgtcgcggcaatatgtgtcacgacggctcttgacatgattttaatagcaatttggttgccgagcgaccgccgccgatttcatcggaaaccaccgatggaaattcagcgtgcctagcagagcagttcaccagaaccgctctggttttgcgtaagatttcgggaggagttacctgccggtgcgcccaagatgaatgaatgatgctatctatctggtggtccatcttggattcaaaggcctgcggttcaacgtttttcaccattggtgtccacgatcagcagaatcataccttgatgccatgccccatcctgcgagcctcgaatgacttgtccggcatggggcgcgccatcgctgatgaagccaataagtttagagagcccactgacccaacccttcgccaatgcgttggggcgatatccaaattgttgtgcaaccttgcgtgctcggcttcttatggattctggaatgttgacctttgttgttcgccacccagggaacggtggccactgacactccggctgctctggccataatcttgaatcgtcactccgttcatgccatgtaacctacgcaacctgtcccagcaacccatcgcttagttcggtggccgcatgcgcagccgtggccagacgctgcgagacggagggccgagggagattcttgtgacagtaatgctcccgtgttgctgatgcttcattggggggggggtaacacgggagcattcaatgtgtggattagagcagcatccagatggttgtgtcttggggcaattgcccgttggatacatcgccagacgccagtatgatctctccgtttggcagtgaagctggagtcttaccgaagttcgtataggaggcgaatgtgcgaccatcggcggcagggcgcgtgtaggcgattatctcatcgcctacgtcgattagagtgcaggaggtatccgccgtggcggtgagtatgtcctgacgtgcggcgagtgctgcgcgatacagcgacaacattgaatccggatcctgtgcttcgctgtcggcggtgaaattgccgtaccagagaggctgcggcaaatgggggcgttcggattgggtaccatccaccttggtgacgggggagaagccaaaggaggctccgtcgccaaaactctcattccaggaagccggcgtcggcttgtccgcggcgatccacggcatcggcacgcgacagccatcgcggcccttttcataataacgctgggtggtgaagtacggagttgggtcctcaagacgatcccaaggaatatctgctacctcgaacaggcccagttcctctccttgatacacatatacagaacctggtagcccggtttccatcatgatggcggcgcgggagcgcttggtgccgagttcacggtcttcaatataagaggtgccgtcgcgcagcaaccagtccttggctacctgatgatgactgggggtcttgatctgaggtagggcgtaacggctggcatgacgcggtacatcgtggttgctcatgacccacgtggtggtggagccgccggaatgtgtggctgaatccaagccctcctcgatggcggtacgcatctcggcggcgttccagttggcttcggcgaactcgaaattgaacacctgtcccagctcttcgggggaggcgtacagatgctgatgctccggtacgcaccaggcctcaccgacggcgaagcgtggcggatcgtactcgttgaacacttcgcgccactcgcggtagatgtcgtgcacttcaaaacgatcccaaatcgggttagtgccgtcatggcatagcgattcgtgaatcggatagcgtttgcccatctcttcaagtggcatgcattcaagatccttggctaggccgtgcgccacatcgatacggaagccatcagtgccatggtcggaccagaagcgtagcgttttcttgaattcctcgtgtacctccgggttcttccagttgaggtctggttgttccttggtgaagatatgtaggtaccattggccatcttccacacgctcccaggctgggccgccgaacagggagatccagtcattcggtggaagttcaccgttctcaccgcgtccctcgcggaagatgtagcggtcgcgttccttggagccgcgccccgcggcaagagcctctaggaacatccgatgcttgttggcggtgtggttgggtacgatgtcgacgattactttgatgccggcctcgtgagccctgagcgtcatctcgtcgaagtcgtccatggtgcctaggcgtgggtctacgtcacggtagtcgatcacgtcgtagccgccgtcggcgagttcggagggatagaacgggctcagccagacggcgtccacgccgagggcccgcagatagtccatcttctcggagacgccggcgatgtcgcccaagccatccccgtcggaatccttgaacgatcgtggatagacctgatatacaacggcctgcttccaccaatccgcacgttcattattcgcggtcatgatgttgtccttacgtctttgtcccgatatgtccctgttctagtgattgttcgcctatgaacagctaatgacaacgatatcaccaatggtgccaatgcatcacgggtgtgttgtgattacgttgtcacggacatggcggagtcttggtaagattgaacacaacgttggcggtcatggccttgcacaaaggagcgatatgaaattcctgtcacctgattcaggtctcatgcgcggttggaacaatctgaccgacggtgtgtggatcaatattctcatgcttgtcaccagcattccgcttgtgactgtcggtgccgcgctgaccgccggccacgacgctgctcgcaagacgcttgcgggagagggacacgtcaccaccaattatttcagatcattcaaaagtaattttgtgaagtccacggtgcagtggctaatcttcggtgtggcgctggcagtgctgtcctacgcgtgggtcgttctgcagattgtaccgttgctaattccaaaattcggtttcaccatcgtatggatcatgggcttcgaatgggtctgggcgttacaggctcgtttcgaaaatagccttggtggcaccctcgccaatgcattcatcttcggcgtgactaatgtcgcgtcgaccatcgcgctggcgataatcgatgttgcgttcctagggctgattgtcggctcttggttctacatgccgcagggtctgtttttgctggtggtgcttgggtatggcagcgtgcttatgcttcacgtcccgattctcgaacatgcgttcgccaaatacgtcaacaagccggagtctgatggtcgggggacggtatggcgaaagtaacgttgcaagacgttgccaaagcggccggcgtctctatcgcgactgcttcatgggcggtgaatgacaatcgtaatgtgcgtatcccggaatccacgcgccgcaaagtccgtaaggccgccgattcgctcggttaccatcacaatgcattggctcgggggttggcccgtggctgttccgacatcataggcttcatcagcgacggtgtggctacctctccgttcgcggggcaggtaatccaaggtgcgcaggatgaggcttggcgtaacgggaagattctgctggtggttaacaccaacggtaaaaaagatgtggaacgtaagactttcgcgttcatgcttgagcatcaggtcgaaggcgtcatctactcgaagtgggttcatgaatcaattacgccaccgagcgaactcgataaggtgccggcggtgttggtgaactgctatgacgaacgtggccgatttcctgctgtggtgccgaacgaagttcagggtggggccacagccacgcgactattgcttgaggccggacatcggcgtatcgcgttcgttaacgccattacgccctcgcctgcgtcgcttggccgacttgaaggatacaaagcggcgcttgcggcattcggcatcgattttgattcgtcactggtggtacctgcgaacgctgaccaagaaggtggatacggggcagcggaaaaggtgatggcgacggatgcgaccgcagtgttttgccataatgaccgcactgcgcttggtttgtacgatgcgttgcgtgagttaggtaaacgtgtgccggatgatatctccgtggttgggttcgataatcaggaaatgatttccgcgcacatgcatcccgcgctgaccaccgtgggtctgccacaatatgagctcggtgtgatgggcgtgcgaacgttgttgcggcagtgcggccgcaatgaggatgatggtgatgaacatgtagtgacgaggacgttcgagccgatttttgtgcaatgtccggcggtatctagggattcggtgaagaggttgtagcatggtcgtcgtagtgctgcgacactcgtggaaacactcacgaaacggtggaaaaacggcattgtgcaaggtgactgcgtcaatcgtttgacattttgattttaagtgctatacttgtacttaatcgcttaaacagtttaagcgcttaaactgaataatgcgaagtaatactggttccttcaaaaggtaatcgcagacgattgccgggcgaaaggcaaagcagctgaagaaaggtaaagatatgaagctttattaccagttccctggcacttggttcggtgactgcatgccatttggcaagggcgacgaattcttcctgttccaccagcgggacaatcgcaacccggagccgttcggagagccgttcggctgggatcttgccacaaccaaagatttcgtaaactacgagaatcatggagtggcaatcccccgtggtgcatatgacgcacaggatcaattcatcttcgcgggctcggtgtttgagggcgagggccagtaccacatcttctacaccggctataaccgcgattatcccgcacagggcaggcctgcgcaggtgctcatgcatgcggtcagtgacgacctgtaccactggaccaaaacacaggatgctatcacctttacgccgcaagagggctatgaccctgatgactggcgtgacccgtgggtcattcgggacgaagaacatgaccagtatctgctgattcttggtgcccgtaaaatcggtccgaaaacctgccagaccggccgtaccgtgaagttcacctctaaggatctcaaggactggaaatttgagggtgatttctgggctccaaacctgtacaccatgcatgaaatgcccgacctgttcaagatgggcgactggtggtaccacatcgtcaccgaatacagcgacaagcacaagatggtctatcgtatggccaagagccttgacggcccatggattgcaccgtcggacgatgcattcgacggcagtgcctactatgccggccgtaccttcgaactgaatggccaacgcatcctgtttggctgggtcggcaccaaagagaagtgcgatgacaggagcaacttcgaatgggccggaactttcgtggcgcacgaggtgtatcagcgcgaagacggcacgctcggtgtgcgcattcccgataccgtgtggaatgcattcaatgagcgcgagaatgtcggcaatgtgaccatcgatggtactggtgcgcgacaggaggcggtactcgcccttggctgcggtgatttgttctcgttcgaagccgacatcaccttctcagaaggaactcgctccttcggcctgcgtgtcaacgagaacgaagataccgcgctgggataccagttcatcttccccgtagctgaaaatcgctatgtgttcgaaggcagtccgaacttcccatggtttaatgtcatgaacatcgggcttgagcgacctatcaagctcgaggcaggccgtaactatcatctgcaactcatcgtcgatgacactatcggcacgttgtatgtggatggagtggcactgaacgtgcgcatgtatgagcgccccggcgagtcgctgagcattttcgccaccgacggcgtcgttgaggtacgcaatgtctccatcgctcgcggattgaaggaggtctgaccaatctgatttctttttgactgattacgggtcgtcgaggtcgtttcgtaccttcttttcgcctcggcggctctccttgcggcttttcctctcatttttgcttaagcgattaaactatacttcggtaccacatatcgcacgatgcacgacgtttgtcatcatctgacgacgctgtcagaatcattattttttggaggagatcatgaagaaactcactcgtaccattgccgcagtgtcggcgctcgccatgtccgttggtgcgctctccgcatgcggcggctcaaatgtcaacgctgacaaagggcatgtatattttctcagcatgaaggtggaacaacaggaccagttcaaggaactggccgaaaagttcaccaagaagaccggtatccaggtcgatatcgccactgcgtcatccgacacctacgaacagtcgcttaagagtgagctggccaaatccgaggcgcctacgttgttcgatgtcgacaacaacgactttctgaattggactgattattatgccgacatgtcgggaaccaacatctacaaggatcaggagaaccccgactatgcgctgaaggatggcgatacggttggtgctgtgccctacgtcatggaacgatatggcatcatctacaacaagaagctgctgcagaagtacttcgattcttcctgggcaagcattaagtcggttgacagcatcaacaatttcaagacactgaagacagttgccgatgaaatacaagcacataaggatgagatgggcgtgaaaggtgcgttcacctccgccggcttcgacaccagctccatcaaacgtttcggtgatcaactggcgcatatctccgtctactatgagtatcgcgatcagggtgtcacgcaaatgccggccaccatttccgacaagtacgtatcgaacttcaagaacattttcgacctgtacatcaacgacgccacgattccgaagacgcagctcgccagtgccaccatggacgacgccaactccgagttcgcactgggtgaggccgtgttcttgcagaatggctcttggggctattcgcagattcgcgatcaagaggtcgccgatgaagatatgggcgtattgccgatctatatgggtgtgaagggtgaggagaatgcaggcctgaccgtgagcttcctgtactttgcgatgaacaagaacgcctctgaaaaagatcagaaggccaccaagcagttccttgactacatcctgaacgatgatgaggcacgtgacatcatcacgaatgaggcgggtttcgaaacaccgtttaagtcgtatgcgaaggccggctaccagaccaagaacccgattcatcgcgccaacgatgcctatgccaaggcagataagtacgatattgtgatctatccgttgccaagcactcagtgggtgttgacgctgggcaacgcgatgttggaatatgcgcaggagaccggtacatgggacaccgtgcatgatgcatttgtggatggttgggcgtctgaatataagaccactcattgagcgcaatagagtctcatcgaatgcgcaaacggggcttggcggtttatctgccaagccccgtttgcgtattacgatataggactagtcaggttgagcttcaccggtaccgcgaagatttgccatgctgaacctcaccgtaatgcgtatgtgttcatctggcttggtgcagggcctttaaccactacactcaaaccttctttgctgagggggcgcataccataggcaggctgaagggccggagtgtcgatgatgagtaggtcatcctgcagggtcttggtgaattgctggtcggattccggtcgtgatgtcatgactatctgcgtgtcgtggttttcgaaaatgccatcttcctgccattccggacagaattagagattcgatgatgatgccgatgcgccaaggtcactctgaatggtgatttcggattcatagccggttgggcagtcagttacagcatatgtgccatagagaaccctttggcgaggtagtagtggcttggtcagtcgatgaatgcggtggtttcacgcatcatgagttgtgcctgtagtgtttcatgcagcggtttcggtgtttttccggacatgacactcagcatcttacgtgcggcgttttcgcccatgttgaacggatcctgatgcaacgtggtcaggccgatctttgcggcaagtggtacgtcgtcgaatccgatgaccgagagctcttgagggacggcgtgcccgtactggcacaacttatagatgacaggcaatgccagctcgtcactttcgcaatacagtgcggtgggggcggggtccatggtcagcaatgaattgagaatagtgttggtggcgtcttcatagttgcggattgcgatgcgttccaccgtcatctttcgctcttcggcagtttccatcagcccatgcagacgcgcttctgcgctgaagaccatgttctggttattgtcatttgatgtctcgtacgcataagcgatacgtcggtggcccatggagaacaagtgcttcacagcaacatgcatggcctgacggtcgtcgatactcaccgtggcattgaatccgttgattgatggaatgttgatgccgacgatcggtaccttcatgttcgaaagtttttcgacctcttcgggcacgatgttgaaggagtttacgatgaccgcgtcgacgttgcggcgtaccggcaacgttgcgaagaactcatggcggtcgtgcgcgtcggccatctcgaagatggaaatgtcatatccggccgggtgcagcacggaatccaatccggcataggtattggaattgaaccaagtcgaaatcgaatcgctcatcaacagcgcgacgcggaacgattgaccggttttcagtgcggccgctgagcgggagatgcggtagtcaagtttttccgcggctgccatcactttgctgcgagtctccggcagcaccagattcggtttggcgaatgtgcgagagacggtcgaaatcgatactcccgcttcggcggccacggcttggatgctcgctttcatagagaatcctccactgacgaacgacattgctgtcatgacaactgctagagacacgttaacataagtgtttgcaacggttgacgtgcgtgttctgcggatatgaagaaaaggggtgccgacgaaaattccgacagcacccctcatgcgatgaagttaatcagcctttgacagcgccggccatcacgcccttgatgatgtacttctggcagcacaggtagaatatgatgatcggcacaatcgccaccaccaagcaggccatcatggcgcccatgtccactgatccataaccacccttgaggtactgaatcgcaatcgacatcgtcttgaaacggcgcatgtccaacgtcaggtacggcagcaggaagtcattccagatccacatcgtctgcaggatcgccactgaaatcaggctcgggcgcatgataggcagtacgatttggaagaagattctcggtaccgacgcgccgtcgatcatcgcagactcctcgagttcggacgggatgcccttgaccacgccagtgaagatgaacacggctaagcccgcaccgaagcctagatacacaatccacaggccccatggggtgttcaggcccatcatgtcggcgagcttggaaagcgtgaacatgaccatctggaacggaacaatcatgttaaacaggaacagtgtgtacagcaggcgcgcagcccagttgttcgtacgtacaatccaccaagcgcacatcgacgtgcacacgatgatcagcaggaccgcgccgaccgtgacgactacggtccagccaaaactgctgattaggttcgtgcgctcgatgcctctgatgtagttctccagtcccacgaaggccttgccggtgggcagggagaatgcgttgcgcgagatgtaagccttctgcttgaagctattgatcagcaccagcacgattggatagacccatgccagcgagacgatggaaaggaaaaccgtccagaatacaggatgcttgaccttgtcgctcatgcttggacctccttgctggtggtgagcttgttctggatgagggcaatcacggccacgatgatgaagaacaccacggccttggcctggcccacgccctcgaagccggcgcgtccgtagaacgtgcggtagatgttcagagccaagagctcggagctatttgacggggcgccattggtcagggcgaggttctggtcgaacatcttgaagccgttggtcaccgtcaagaatgtgcacactgtgattgacggcatcatcaatggaatcgtcacgttgaacagcgtctggcgggagttcgcgccgtcaaccgcggcagcctcgatcacatcgccgggcaggccctgcagacccgcgatgtagatgatcatcatgtaaccgatttgctgccagcaggtcagcagaaccatgccccagaagccgtacacgcccgagaatgtgatcgaacgaccccagtgcgccagtacgccgttgagcagcagtagccagatatagcccaagatgatgccgccgattaggttcggcatgaagaacaccgaacggaacagcgtggagcccttgatggccttggtcagcatgtacgcaatggcgaacgcgactacgttgatcaccacggttgtcacaatcgtgaacaggaccgtgtacaccagcgcgtgcaggaactccggatccgtgattatgttttggtagttcgacacgcccacgaacgtggcgtcagtgaccgtgctgaacttgcagaacgacaggtacacgcccatggcgaacggcaccaggaaaccaatgacgaaagccgcgaacgtgggtagcgcaaacagcgcccaccacctgcgaattgccttgccggacatcgtaatcatttcatgcccactttctcctccttgggtacacccggggaacacccctcgagtgattcaacgacagttcgaccgtgaccgcaacgtcgggttcgaaccggttcgagaataccctacttcacagataaataaaagtcaaacgttgtcatgattttcatgcaacgtcaattcatttatcaaatgtgaacagttatcagtatacggatacccttggaaataagcaagaaatacgtattgtcgtgtcgttgcaaacgtttggatattttttgcaaaacacgttgtgtcttgtagtatctactgccataaaggagttgtgcatgtcagtcaatattcaagacgttgccaaagcggcaaaggtgtcggtttccacggtgtccagatcattcacccgacctgagctcgtatctgaggcgacacggtccagggtgttgcgcatcgccgacgagatgagtttctccatctcccgttcggccactgcgctcaagtccggcaaagcattgcgtgtcgccttgctgatgagcgaccatatccgactatggttcagcgcttccgtcatcgaagggttgaaccaggttttgcacgcagacggctatgatttatcgatcttccagatctccagtatcgaggaacgccgtgagttctttgatatgctgccggttcgtcgcaatgccgacgcggtgatcgttgcttccatcgatgtcgatgcgcaggaaagcgcacagctggccagcaccggcgtaccaattatcggcatcaactgtgtgaatccaagagaatacggtttcactgcggccgtggggatagacgatgatcaaggttcgcgtctggttgcgcgccatcttatcgggctggggcatcgcaacattgtctacgtacgtacgtcgcgtgaggtttccttgcacttcagtgtgcagcaacgttatgactccttcgtcaaggcctgtctggaacagggtgtcacgccaactacgttggttgcgcaggaaagtgaggaccgcattagcacgattgtctccgagttgctgagcttgccgcaaatgccaaccgccatcgcttgtcaggaggacggcatcgcgattccactgatttatcagcttgtgcgttgtggctaccgtattccgtctgatatttccgtcatcggctatgacgacagcttctatgcgcacgatatcggcttgaccacgattcgccaggatccgattggcatggcacacgaggcggcttgtaagactcttgacttgatcaatcgcaagaccacgggtatgccgtttcagacgtttccggcgcaactgatcgttcgctccagcacttcgcgagtgtccttggataagggctaatcgcttaccgatacatagaaaaccgctccggttggttccggagcggttttctataaggagagaatcagacagtgaagtcaattgcggtcacttgtgggcgttggcatattccttggcccagccatccacgaacgcggacttgacgccatcccaattgccggtgccttgggcatactcgagcaaagcggagccgaggtcgttcttccattgttcggacggcatcatggtgaagttccaagacactgcggtggtaccggacttttggtcgtccatggcgtcagtgaccagcgggttgtcggatttgacgctggagaaggtcttgaacggggtggtgaagcccatcttctgagacagcgcttctttgcccttatcggaggtgatgacccacttcaggaagtcggcggtcgctttctgattggccttggatgctttcgaattaatgcaccagtaattctcggagccggttgccagaccttggttctcctcgcccttggcgccgatgtagattggcatcataccaacggaatcggcctccatgccggctttctgcaaatcggaccatgcccaagtgccgttttgatagaaagcggcctcgccgagtgcgaattcggaattggcgtcgtcaccagtcttggagcttagttgggacggctcggtggtggaatcggtgatgtacaggtcaaagatgttcttgtactccggcagataggttcccttgatagtggccggctgttcagtgatgttgtcatctttgaactcatagtaaagaggcaggttggctagatgggtcttgaaacgccaatcggagctggagtcgaaaccagcagaggtgaaggcgcccttaatgccgagttcatccttcttggactgcatgtcgtcagcaacggccttcagcttactaaaggagttgatgtctttgatggacttggccttggcgccggaagtgctgaagtatttgttaaggatgtctttgttgtagattaggccataagtctccatgacgtacggtacgccaacgaccttgtcgccatccttgagggcaacatcttggttctgcagttgcttgtatacctctgtgccggacatgtcagcagtgtagttcttccagttggcgtaaccgaccggaccgttgacttggaacagggtcggtgcctcggacttagccatctcgctcttgagctgctgctcataggtattggaggccgcggtctgaacgttgacctcgacaccggtttccttagtgtactccgcagccaaatcggcccactcgtcggcggcttctggtttgaaattgaggtagtataccttgcccttgcttgaatcagagctcgatgagctgccacaagcggcaaatgtcgtgacagacatggcggtgaccgcaatgagggctagtgcggacttcaatttacgattcatcttcgaaccttccttttccgcatcgggtccaacgtccccgttggatatgtgcactgagatagtgctgctttctgccgatgcccctattatgcatcactttcatcttttttgcaaacgatggcagtattttgttgatttatcacgttgcaataccgggcaatccgctatttgctgccatttttaggcataaaattaggcgacacactatgcaagcgtttgctaaaaaagttgtacatcaaacgattgactgtagcaaaaagccgcatcccctgagagacaagggatgcggcttgaggtgagctacttatggatgacgtcagcgcggccaacgttcctcggcgctaggtagttgcggaaatggagcgtgtggccccttctggtaccagtaggcaactgatgccacatcatcctgacgttcgaagaatccgcggtgaccaacaccgatttgctgaacggtcaccttcaggttggaacggaaacgaatcggatcggggatgtgccaacggtagaagccacgcatcggggggcaatcatcattgtgataatcgttgtgaatcagctcgtcgtgtgaagagtaatacgggtatccgagatacggtgtgcagtagttttgctccacggtcttgccattgacctgcttggcgaagctccaagagcctccgaaatagtcctcggtgccggtgccgcagatcgtggggtactcttcatcgtcatcgatgtagaatttgaattcgccttcaccccaccagtagcgctcaagcgtggtcagtgccaggtaggtacctacataatgcccttcacctttcacgccatcaagcaccacatagtctctccccttttcagtaaggcgctggcgccgccattgtgcgtggaaataggcaatgtcatcgtcgaacggctcgtcattcacggtgtagtcaatctggtagaaaaatgcgctgatggcgttcttgtgttggttttcgagcgtgatgcgtgcgcgtgcgccgaacggcatcgaaaagtacatgttgaaaccgcggttcggcactacggcgacaggcatggaatttactaggcacgcacggccgaatccgcagcaaaagaagtcaccaagcggacactccacacttggttcctcctcgtcatcccaatagaagcgcagcacaaggtcccgcagtacaaaacaatcggcatcggtggtcttctcgtcaacggttatccagatgtgtcgaatgcagccggggccggtgatatcagcaagagtcgccgttgcgccgacgggtatgttacgtaggcaagggctgcctttgcgacttgggccaagctcactggccgctatgccgcctttgcccggttcgccggtcgggttttccgcgttgactgcgcggcttgattcgtgccgtatcttggtcaaggattctagtgtcatgttcgttcctttcatggcgtatgctgcgtctgtttgcgcgatacattcatatctgtgcgtatcagcttcggtcacagacgttgtttgttttttgaatatgagaaagtctccatcggcgagcgagaaagccgatggagactgtggtcatgccgttatggaccaggtgaaaatggcgttatgcgattcaccgcggcccataggcgaatcacttgtgggctggcggaagcatgccgaagttgttttcataatcattccaggcgctggtccaatcgtccagatatgccttcttcacgccattccagtcaccggtgccctgagcgtactcgagcagtgcattggccacgccgtcagcccatgcctgtcccggaatataggcgccatgaattggagtgaggccatcggactcaagcttgagcgcggacttggtcagcgggttgtcaggctggaaatcctcggagtcaaaggtggtgaacggaacggcgaagcccatatccttggagagaatcttcttggcatcctcgtcggagaccatccacttgatgaaatcctcagtggccttcttgtccttgtcggaagcgttcttgttcacagaccaggagatgtcatagatggagttcgcggcgtacttgctctcattcgggaaacccatgtagtacggcagcatggccaagtcttcatcggcaacttcgttgcctttgatctggctataggcccatacaccattcgggtagaaagcgaccttgccggcggagaactcggcggtggagtcctcataattcaccgagccaagcatggtgttttcggtcgggttgtccttcatctcgagatcccacagattcttgtagttatcgagataggtgcccttgagttccttctcgaagtccacgccctcgtcaatgtactcgtaggcgactggcacctgagtcatatgcgaagcatatcggtagtagttggatgagtccagacccggcgtggagaacgcgccgtcgatgcccaaatcatccttatgctgttgcatgctgtcggcgaccttcttcaaagtgttgtagtccttgatgtcgtcgaaggacttgatgacggcgtagtcctttttggcatactcgttgatgagcttcttgttgacgatgataccgaaccattcggcggcatatggcaggccgtacacgttgtcgccgtccttgtgggccatctgcttgccctgatcgttgagaagcttgtaagcctcagtatcctgcaaaggttcgaggtagtccttatatttggcatactgatcgaagccgccgataccgaacatggtcggggcgttgttcttagcgagttcggacgacagagtggactcgtagctgccggaggtggcgctctgaatatccactttcacgccggtttgcttggtgtacatttcggcgagttcgttccactgattgacaacttccggcttgttgttcaggaaatagacatgtcctttgtcgtccgcggtgttggaaccgcaggcgccgacgcccgtcaacatggccaacgcgccgacagcggcgatgcctttcgtgagattcttcatggggtttcctttcctccttgcgaccttccttcgtcggaaatcacttgtcaaggtcatatgcgggccctctcttgcctgatacaatctgaccgtggcctgattcttgcagacggtcatcgtctgtgtcgaaccggtccgagattgattgtatcgaaccggttcgctactgtcaaagtcggagggtttatgcgtgttggcgtattttttgttgccgtattgcgacatgtgtcgagactttgccgatacaagtagacgctctttttgggagcaatagtggcttcggacatgcccaatagtagatggccattatcctctgcgtgcgactgcagcaacatcgggcgtgatagcggaagatggaaggagggttgcgtcatggggacgatatgactgaaaatgatgggcaggatcgcctattcgggccgaatccgagtgggctggatgaatcgcctcacggcatgatggtgctggtgattgtcggcatgatcgtcggcctgttgtccggcatgttcggcatcggcggcggtacggtgatcgtgcccgcactggtgtggctcggactgtcgcaacgccatgcggcggcgacctccatgctggcgatcgtaccgacgtcgatttccggtgtgatttcctatgcgcacaatggcaacgtcgactgggtcgcggccgcgctgctgagcaacgcgcaatcctgctacgcccgtgccgaactggaaatgacgggacttgccggcgtgcttgacgatgtgatcatctccagcgaggagaagatccgcaagcccgcgcgcgacttgtacatgctggcgctcgaccgcgaattcgtgaccgccaagcatgcgctgatggtgggcaatgacgagcagaacgatattgttggcgctcgcaccgcgggcattgacggcgtgtatttccgcacggagatttcgccggcagatgatccggaaacgtcgagctatgcggtgcgttcgtttaccggcgccgattatgagggattgctggattacgtgctgaacgcataagcctgcgtggtgcatgggttttgacaacgtttgcagtataataaaaaacagattgagagggcgttgttgctccaaataccctcgtacttgccatttttgattcacggtactagtgcaggggtatttgcatatgcagcccgctgctgtctgttgtcgccgtctgcgcgaatcccgttccgcgtctgcatcaccccggaatcgctcccaaatccgacttgtgcagacggaggacttgaattgtgtgaacgtaaggaagtcttggaatggcgttactttccgagcatccagtcgattgcgttggcaacggtcacgccgtcgcttttgccgagtccgaaacgatctagcgtcagcaccattcttttcgcagacaaatcgcgtgcattcagcagtggtgacagttcgcgctcgcgagtgtgctcgtccaatatgctggcgctcacctggatatacagtttctcttccgtaagatctgcatgtttccgagtcgcaacaaaatcaatttcagctttaccgattttcccgacgcgaatctgatatccgcgaatcttaagctcattatgtacggcattttccagaagaaatccgaaatcttctatggaatatccgagcagcatattgcgaattcctaaatctgctggataatacttagctaatccttgtaaatatgcgccacctttaacgttaattcgttgcgcattgtagaaaagaaaagcattgagaagtccactaatatatcgttcgatggtctcatttgaagctggtcgatgcgcgcttctcaatcgattttctatcttcgaagttgagactggagatcctgcggtatctgccaaatatcgtgcgacatcgttgaaaactagtggatttcttacttgcagaaattgcgaaatatctcgcaccaaaatagtgtcgtaaattccggaaagcacggtgtatgccaggttttgatcggtgccttgattcacgaccggcggcaatcctccatatcttgtgtacctttcgaaggccgcgttctcgtcggtcagatcggcgtacgccatgaattccgcgaaagaaagcggaaatacattgatctccatgtatctgccggaaagcagcgttgccagctggctggaaagcaggtaggcgttcgatccagtgatggtgatgtccacgtcggcatccgtgtggagcgcgttcacggctcgctcccacttgtccaccagttgcacctcgtcgagcagcagataatagtggtcgtcttgctgcatacggtcggcgatcgcgttgtgcaggtcttcgaaggtgaatgacgagtattggaacgattccaggttcatcatgatgatgtggtcttcggcgatgccctgctgcagaagatgctgtcggaagagtgtgagtagtgatgattttccgcagcggcgcatgcccgtgatgactttgatgaggctgttgtcttgcgccgcgacgagtttgctgaggtactgcggcctgggtttaagtttcatgatgttcaacttttgctagtgtatccggaaaagtatgtattctaatgcgactttcactagtatacctttaaaagtgtgctctgagatacgacttttactagtatgaccggaaaagtgtgtgccataatatgacttttgccggtatggctggaaaagtacggccgtacggttgtgggctggtggggggggggtagggtgaactcgcgcaggctgctcgtgcgcgggcatcgcataccgaatccgaagcaatgtgcgcgtgcaaacgggtgcatgtaacgttgggcaaatcttggcatgggagggggctttttctcttcttgctttctcgcaatgtgccgggtttgcggtgctgaaatgtgcgggaatgtactatcgcaactatcgcaattatcgcaagatgaagaaagtgcgatggtaggggagagatgaagaaatcggatatttccaatatttcgaatgctgaaagtgttgaacgcgctgaagaaagtgtgcgatcgagtgtgcagccgagcgggaaattcggcgagaaagcggatcggctatttggtgcggatcctgtgggactcgacgaatccgcgcgaggcattgcggtgctggtgatcgtcggcgtggcagtggggctattgtccggaatgttcggtatcggtggcggcacggtgatcgtgcccgcgctggtatggctcggcttgacgcaacgcaatgcggcggcgacgtcaatgcttgcgatcgtaccgacctcgatttccggcgtcatttcgtacgcgacttgcggaaacgtggactggctcgccgcgctgctgctgttttgcggcatgttcgtaggcgggcagattggcagttggttgctttcgcgattgccggaactcgtattgcggtggattttcgtagtgttcctcgtgtttgtggtgttgaaccagataagtttcgtgccgtcgcgagaccagcacattacgatgagcgtgctgaccggagtctgcctggtgctgctgggcgtggtgattggcatcttggcgggactgctggggattggcggcggggcgctcgccgtgcccgcactgtcgatgctgttcaacgcttctgatctgattgcgcgaggcacgtcgctgctggccatgttcccgaactcgatcaccacgagcgtggcaaacctgaagcgcaagctggtgcatgtgaaggccgcgctgattattggcttggtagctgccgttaccgcgccattcggcacatggattgcgggcgcggtgtcgccccgcgtcggctcgatcatgttcgccatctacctgtgcgtgctcctgatccgcagcttcttcgtagctgtcaaggccactcgttccgcccgcgcctctgcctgaccgtttgcacttcatgcgggaaaagcatgagtcataattcagcatttagggggtattggggatgatggttgacggaaagaggatttgagataagtgttcactttgtgaagacgagagttcatattgtgttcgtctaaaacgcctcggaagttggtttgcggaacctagcgtgggaatcgcaatacagcacaggctgaagaaagaagaacaagatgagcaatcgaaaggctctcaagggagcgattgcagcaatcgcttccgttgcaacgctcggcgcactcgcggcaccggcgctcgctgacgaaaccaccacctacaacctgaacggcaagtccgttgcggaactggctcagcatggcggcgcacagcgcattgctgccatcggcaacggcaacgccaagaacgtcatcctgttcatcggtgacggcatgggcgattccgaaatcaccgtcgcccgcgattatctcaagggtgcgaacggccacttcgaaggcctcgatgcagtcggccagtcggcagaactcggcgacaccaacgccggcaccggccagtacaccaccttctcgctgggcggcaacagcggcgacagcgcagtcggcaagaactccgacggcagcctcaacgccaacccgaacccgggcaagctcaccgcagtgaccgattcctccgcatccggctccgcatgggcaaccggcaccaagacctacaacaacgccgtggacgttgacgtgtacggcaacccgcagctcaacctgttcgaactcgccaaagcggcgggcaaggccaccggcaatgtgaccaccgccgaaatccaggacgccaccccggccgtgctcgaatcgcactccaccgagcgtggctgctacggcccacagggcaagaccgacggcagctccaacgacgcgctcaagcgctgcctcgccaaccagctcaaggaaaacggcggcatcggttccatttccgagcagctgctcgatacccgcgctgacgtgaccatcggcggcggctccaagtacttccgccagaccgtgcagggcggcgaatacgctggcaagaccgtgtgggagcaggccaaggaaatgggctaccagaccgtcgaaaacgattcggccgcaatgaacgcgctcgaatacaaggagggccaaccggtgctcgccctgatgagcgacggcaacatgcctaccaagttcaacccgtccaaggccaccgcgcaggatccggccaaggacgccaacccgaccgtgtgcactatgaacgacaagtggctcggcaaccagggctcctcgctcaaggacatgaccaagaaggcgctcgatctgctcgaagccaacccggccagcgacgcgaatggctacttcctgcaggttgagggcgcttccatcgacaagcaggaccacgctggcaacgcttgcggccagatcggtgaaaccgacgatttcgatcaggccatcgcctacgccatgaagaacgttgacctgaccaacaccctcgtgatcgtcaccgccgaccacgcccacacttcccagatcctcaacgctcagccggcctacgcactctccaccgtgctcaagaccgctgacggcaacaatatggtcgtctcctacggcaccgctgaagccgactcccgcgatgaggacggcggctacaacggcggcgacatggctcacaccggcacccagctgcgcatcgccgcttccggccctggcgcccagcgcgtgattggcctgaccgaccagaccgacaacttctacaccatcgccaacaccctcggccttgcctccacctccgacgatcagaagtcgctctccaacgacgccaagaccgaagtgaagctcaccgacggcaagtatgtggccgaatccaccggattcaacggcgacgcagtgctctcctatgagcttaaggacaagtccggcaacgttctcgccgcttccgacagctccactccggtttccggcgtgcgcgtcaagaccgctcagaccaccagcatcgcgctcgacaaagttgctgaaggcaacgagtacacgctcaccgtcaccggccgccagtccggcaagaccgtgaccgtcgacttccaagctccggcccgcgattcctcagatgagaagccgggtgacggtaagaatgacgtgatcgcttccggcaaggtgagcaacaatccgaagtccggtgtgctcggcaacaccggtgccgcgatcaccatcgccgcacttgcgatcgccatgctggccgcaatcgcgatgatcgtcaagaccgccaagatcagccgctgaaaatctgaagtggtctgaagatcgcagattggatccggatcgcacgcgtcgcagtgtgatccggatcttttatctcaccgtacgatcgggtttgatggcgatctcaccttgaaatcgtgtcttgagattgcgcttaagattgcacccggcaaaaagttgagctctcttcgctcaacttttttgtagatttgggaataatcgcttgcgattcaaagttgagtggtgtaggctcaagttttggaaagttcgagagacggaaaaccgaaactcgggcgaaagaacgaacagaacagaaaacgcatagcgaacctatctacaaaggagacaagttatgggacgcgcagttggcatcgatctgggtactactaattcctgcatcgcaactcttgaaggtggccagcccaccgttatcgtgaacgctgaaggcgctcgcaccacgccgtccgtcgtggcattcagcaagtccggcgagatcctcgtcggcgaagtcgccaagcgtcaggccgtgaccaacgtcgaccgcaccatcagctccgtcaagcgccacatgggcaccgactggaccgttgaaatcgacggcaagaagtggactccgcaggagatctccgcacaggtgctgatgaagctgaagcgcgacgccgaagcctatctcggcgaaccggtcaccgacgccgtgatcacctgcccggcatacttcaacgacgctcagcgtcaggccaccaaggacgccggcaccatcgcaggcctgaacgtgctgcgtatcatcaacgagccgaccgcggccgcactggcctacggcctcgaaaagggcaaggaagacgaaaccatcctggtcttcgatctcggtggcggcaccttcgatgtgtccctgctggagatcggcaaggacgacgacagcttctccaccattcaggtgcaggccaccaacggcgacaaccacctgggcggcgacgattgggatcagaagatcatcgactggctcgtcggcgaagtcaagaacaagtacggcatcgacctgagcaaggacaagatcgccctgcagcgcctgaaggaagccgcagagcaggccaagaaggagctgagctcctcctcgagcacctccatctccatgcagtacctggccatgacccctgacggtactccggtgcacttggacgaaaccctgacccgtgcccacttcgagagcatgacctccgacctgctgggtcgctgccgcaccccgttcaacaacgtgctgcacgacgctggcatcggtgtttccgacatcgaccacgtggtgctcgtcggcggttccacccgtatgccggccgtcaaggagctcgtcaaggagcttaccggcggtaaggaagccaaccagtccgtgaacccggatgaagtcgtggccgtcggcgcagccgtgcagtccggcgtcatcaagggcgaccgcaaggacgtgctgctcatcgacgtgaccccgctgtccctcggcatcgagaccaagggtggcatcatgaccaagctcatcgaccgcaacaccgccattccgaccaagcgttccgaggtcttctccaccgctgaagacaaccagccgtccgtgcttatccaggtctatcagggcgagcgtgagttcgctcgcgataacaagccgctgggcaccttcgagctgaccggcatcgctccggctccgcgtggcgttccgcagatcgaggtcaccttcgatatcgacgccaacggcatcgtgcacgtgtccgccaaggacaagggcaccggcaaggaacagtccatgaccatcaccggcggttccggcctgggcaaggacgaaatcgaccgcatggtcaaggaagccgaagctcacgaagccgaagacaagaagcgcaaggaagacgccgaaacccgcaaccaggccgaatccttcgcctatcagaccgagaagctcgtcaacgacaataaagacaagctctccgacgatgtggccaaggaagtcaccgataaggtcaacgagctcaaggaagccctgaagggtgaggacattgagaagatcaagtccgcccagagcgagctgatgacctccgcccagaagatcggccaggccctctacgcacagcagggtgccgccgacgctgcaggtgccgcaggcgccgccggttccgctcccgctgacgacgacgtggttgacgccgaagtcgtggacgatgacgacaaggacaacaagtaatcatgtccgacttcaacaaggacgaatatctgaacgacctgcccgacatggacaacctgtccgggcaggccgcccctgcagccggtgcatcgcaggaatcgcagaataatggcgattctgcagctagtgcaacttccgaaactgcagcgaacgcagcatcttccgaatcgcaagaaaacggcgatgctgcggatggtgcaacgcaagatggtgaagatacgctgactccgcttggccaggccaagaaggaagcggcggaatacttggaagccctccagcgcgaacgtgcggaattcatcaacttccgcaatcgttcgcagaaggagcaggaacgtttccgccagcacggcatcatcgacgtgctgaccgcactgctgccagcacttgatgacatcgatcgcattcgcgaacacagcgaaatggacgaatccttcaaagccgtttccgccaaaatcgacaaggcgttcgaaaagttcggcgtcgagaagttcggcgaaaaaggcgaggatttcgacccgaccaagcatgacgcgatcctgcacaagccggatccgcaggccgagaaggaaaccgtcgacaccgtggtggaagccggctaccgcatcggcgaccgcgtgattcgcgcggctcgcgtggttgtggcatccccgcagagctagcgcagtgacagcgatttcaacaacaacaggcatttgacatcagcaacctcgtgaaaggaggcacatcatggctgagaatgaatggctgagcaaggatttctacaaggtcctcggtgtctccaaagacgccacggacgatgagattaccaaagcgtaccgcaagctggcgcgcaagtaccatcctgatctgaacaagaccaaggaggcggaggagaagttcaaagacatctccgaagcgtacgacgtgctcagcgacaaagacaaccgccagaagtacgacgccatccgccagttcggcatgggtggcgcgcgcttcgcaggcggttccggtgcgggcggattcgacgcgggggcattctccgacattttcggatcaatgttcggcggtggcgctggcgctggagcgtatggcacgggcggcaatggctcgcgcatccgcttccagaccggtggcggcaatccgaatatcaacgatattttctcgatgttcggtggcggcgctggtggccctgccggggctggcaacccctacgggggcagctacgagcaggctgcgcagccggaagatggcgaagaccgcaattccaagatcaatttgactttccgccagtcggtcaagggggcaacggtttcgctgtctgccgacggaaaaaagttcaagacgcatgttccagcgggtgtgcgtgacgggcagaaaatccgtattccaggcaagggcaagccgggtcgtaacggcggaaaaaacggcgatctgtacctgcagatcaacgttgccgaagatccgaaattcagcctgcgcaagcgtgacatcatcatggatctgccaatcaccgtcggtcaggctgtggcgggcgcgaaagtgaccgcacaggatatcgacggcaacgaagtcaccttcaaagtgccggcaggctcgtccagcggcaccgaagtgcgcatctccggcaggggcgtggccaacaggcagggcgacggcgatctgatcgggcgtgtgcaaatccgcattcccgacaagccgagcctgaaagtcaagcatgcggcaaaggaattcgacaaggagtgcggcgatttcgctgacgaacttgccaaggagcgctgattgccatggcacgcgcatcccggacctcccaagcccgtgcggcgcggcaggccaaaatgctgtacgacatgtgcgcaatggcgatcgtggccggcagggccgatctggacggggcggatgaagttggtttcgacatcgaactgccgatgttcacggtcggtcgcgccggcgaactcgccaacgtgcatccgcagacgctccgccaatacgatcgtttggggctggtggtgccgcaacgcacggacggtggcgctcgccggtattcgctgcgagacatctcgcgccttgcgaaagcgcagcagctgagtcaggaagaaggcatcaacctggctggcatcgcgcggatcctttccttggaagaggagaaccgcgagctgcgccggcaagtcgagcgattgcgccggccggccggttccagcgtgttcgcggccgatgcggacggtgacattgtggaaatcgaacgttcccgccgcgctcgcatgtggcgtcggcagattcaggtcgacgcccgtcagctgccgtcgcgcgagtccgtggaggccgcgcgtgtcgcggctgatgcgtacgacacgcgcggtgggggtgtcgcaggcgaaaacgaggggattgagaggggtaaacccgtttctcagccgatttctaggtctatcgtgctttgggggattgactgattttcagaaaacattgaaaaaaattcaaaaacaggcatatcttgcaacagatgtgcctgttttgttatatagttttaccaaatgcattgcttcctgcgacgatgtcgttgttgtgggaaatagtgttgagcatccgcgttctaactgtcattcttccggtcgtcaaggtgcttcggtgaaagatggttctctttgcccatgaataatcatggaggagggggtaagatatgcggcgagaacaggaaaggttaggagcgtacagtgccaagagttgcgttcacagctaagacccgcaagtatctcgggtctctggatgccgtggaatcggtcacccagtatcgtatttgttactccaaggagtttcgcgatgattgcatgcgcaggtatgccgaaggtggctcgcctgccgcgattttccgcgaggccgggcttgatccgaagatcatcggatacaagcgcgtggaacgttgcatcgctcgctggaaggcggaaaatgcggaaaaggccgctgaaaccgctgtggaaaacagtgaaaatcagggagagtgaatttcaaatctcccgatacaagtgaaattttcgaatttcatggattatagcgatgggggttgccgataattcgtgaaaaaaatcggatgattttgcgaatacgtaggcgcgaagtattgcgtcgatatgggaagcgctcggatggaggaccgtccgggcgcttttcgtttgcctcgcttgtatgcctgtttgttgtctgccgttttgccgcgactcgcgaatgctgccgtcttgccgctctgctgaaatggcagtggaagtcgcgatggacggcgctgcccggaaatccggtgctccgcgtccgacggtcgtagggaaggaacatcatgaccgagacgaacctgatgatcaaggccgtgttttgggatatggacggcacgctgatcgattccgaaccgtattggcatgagggtgagatgaaaatcgccgccgcgcatggcggatattgggatgaggagctcgcctggcagggttcgggcacgccggttccggatgtggcccgtcgcatggtggagcatggttgccagctgtcgattgaagagatcggccagggcatgatcgattacgtcgcccaaaaggaattcgagcgcattccgtggatcgaaggcgtggaagacgtgcttgtcgcgctgcgtgacgctggcgttccttcgatgctggtcaccacgtcgccgcgtcatcttgcggagaatctggttgcccaagcgccggctggcgcgtttgcgggctacgtgtgcggcgatgatgatgttgagaagaagccgtctccggccccgtatttggaggcgggtcgtcgcttgggtatcgctccggaagatatgaagtactgcattgcgattgaggattccatgtcgggcctgcgttcggccgtcgcctccggcgcgacgacgatcggccagaccgggttcatgcagatcgacaattccaacggcccgcagttcgcctcgatcaagggctacgagggcattgacgcggcctcgctcgacgctttcgtgcgtcagcgcgtatcccaggcctgatttttcgccccatctcgcttacgtatggcagatttgtctggtggctaggaaaagaaaaagcccgctgcggtggaatgaatgcagcgggcttagtggagccgacggtagtcgaaaccgcgacctcttcgatgcgaacgaagcgctctaccaactgagctacggccccaagtcatgtctagcaacacgctaagcaagacaactctcgcgattctagtacgaagtctgtacgaatgcaatctgcgagattcgcgtgttgcggaatatcccttgcaggaaaagcatgcgaaagcatacgaaaacggtgccttccgaaaaatcgaaagacaccgcaatcgcaagaaaaggagaaaacgtaagatcaggcttccgcggtcgcggtatcagccttctttttgccgaactttgctttgagcaagccgacgaaggtaggaatcagcgacagcacgagaatcgcaatgatgaccagctcgaaatgcttctgcacggccggaatgccgccgaagaagtagccgagcagcgtgaacagggtggaccagcacaggccgccgagcacggagaacggggtgaaacggctccaacgcatgccggaaatgccggaaatgaacggcatgaacgtgcggatgaacgggaagaaacggccgaggaacacggcgagcgggccccacttttcgatcatgccttcggttttggcgaggcgttcgggggtcatagccttgactctgccggattcgatgatgcgacggccgaagaagtggccgatccagtagttgcactggtcgccgatgatcggagcgcaccagaccacaggcagcagcgcgaacagcggtagtgcggaaacgccggtctgggcgtcgggcgcggcgaagaagccggcggcgaacagcagggagtcgcccggcaggaacgggaagaacacgacgccggtttcgacgaacacaatcaggaagatgaaaccaagcgtgggggcgacgcccatggagatccagctggcgatcgccgtgcgtggatccttgagcagattaatgaagaagttgataattcccatgaaatgctctctgtgagtaccttacatctaaacgtccaaaattaagtggttcaggctgccttgtgtgggttggccttgcggaaccaatgtcagcctaccagcgaccctctaatgcggcgcctagtaatgcccgacggttggcaaatctgcacaaacggacgcaaagtgccaactgcggtgggtgattttggtttgggggtgtttggcgtttggctgtttggctttagagtatgcgatatatccggtatatcgcgtatcgctcattgtgatttggcgttgtgacctcacgattttggtttttttttggggggcctcatgattttgatttggtgacctcacgatttgaaaaaaggcggcgaaaaacggaatcgtgaggtcaacaaatcaaatagtggggccgctgaacacgaatcgcgcatgttgacggtacgaaagtgtgtttcgatggcgcggaagatagagtggaaacagcagtaaggcaatgcgagagcggttggggcaatgcaagactaggcgaatacggcaaatacaagggagtgtgaatcgtggcggaaaatcttgcgcaatcggttgatgggaatctgaatcggcaatcgcgggcgctgctcgaagcgttgcatgcggcggccggaaaattctccatgttcggtcatcaaaacgaaaccagcaaggtgattacccccgatacggattccgacgtgcatgccgtgaccggcgcatatccggcggtctggggcaatgattcgggcgctgctggcacgggcgcatatggcattccgctgccggaatcgccgtatgcgcgcgatttcaacgctttcgcgcgcaacagcttcatacgcatggccgattcgctgccacgtatgtacacgaggtaagtacgtgtgcgcggtgtaagcatgcgtttgcgggcggattcttccagtcactggaagaatcaggacgtttttaagcctgttggcgtccgaattgttccaatgtctggatgttttgggacgttactggggctgtaagcggggtgattgttccagtgggtgggggaatcaccccgctgagggtctgttttgtgtccggattgttccagcgattgggggtttaggacgcggggagggttgttttcctttgcgttggataggctgaaggcatggaacgcatgaatgagacgttggacttgaaactgaatgagttgagtgcgaatacggcagcagtaacgggaactgcgggaatggtgaatacggcggagatggcagaatcgccgacagcggcggaacagtctggaacagaacagtctggtacgggacttgacgccctcgtgtgcggaaccgacgttccgcaaggcacggtggtgatggctgccacgccgatcggcaacacggccgacgcctccgcacgcctcattgcgctcctggaacgcgccgacatcgtggccgccgaagacacccgccgtctctacgcgctcgccaaccgtctcggcgtgcacgtgaacggccgcgtggtggcctaccacgatcacaacgagcgagacaagtccgacggtctgctcgatcaggtggaaaccggcgctaccgtgctggtcgtgtccgacgcgggcatgccgaccatcaacgatccgggcctcgcgatcgtgcgtcgcgccatcgaacgtggtctgcccgtcacctgcgctcccggcccgtccgcagtgctggacgcgctgtgcctttcaggactgcccaccgaccgcttctgctatgaaggattcctgccgcgcaagcattccgaacgcgtgcaatacctgcgtaccctgcgttctgaacgccgcaccatcgtgttttacgaaaccctgcatcgcatcgacgattccatggccgacctgcttgacgtgttcggtccgaaccgcaagatggcgctttgccgtgaacttaccaaggattttgagcagatccgtcgcggaaccatcgagcagattcgccagagcgtgatcgacgagccgccgcgcggcgaaatggtgttggtcgttgccggcgcttccgaagaggaggctgacgctgctgcccccgcatcgttgagcgtcgaagacttggcggtgctgtcgatcgaccgtgcgcaggaagacaatctgcgcatcaaagacgcgatttcgcaggtcgttgccgagcatccccttgcggacggctcgcttgccaatcgcaagcaggtctacaatgcggttcttgcgatgaagcagtaagtccacattatttaccgtccggcgattgcctatcgtgcgattgcccgtcgcgcaagtgttagctgcatgcttgcgatccgcacgattccaacgattccagcagtatttgcagggcgcgggccacgtccggcccgccgacttgcgcaagatagtccaacatcgccggtgttgcggaaggattggcgaccagccatttgcgcagttgcggcgcgtattccgcgatatgccatagcacgtcctgcggtgtgtccggactgcacgccaccagcggcgtcaatggaattgggggagacggcggatccaccagcggtttcggccgcggtttgggctggtatggcggcggttcgcggcgcgtccgctgtgcacggtgtgcgagattccgcgcatcccgatgcgtcgcgcgatgcgtccgtggcctgcgtttttcttggattccgagcagtctgcggaatccgtttgctctgtcggcacctatcctgtcggcgtgcgtcgcgtgccgcgccttatgcctgctatgcgctgcgctcatattcgtcgcttcttccgtcgatcgcgagaatgtagttgcgcgcctgtggcgcgttgcgaatatgcttcgtctcctgcatgatttgcatgcaatcgttggagcggaaatgaaattcctgcatgagcatgcagatgatttcggaaaccaacgattcgctttcgggggtgcagttcaatgcgagatcgcatgcggtgcgaacaggcgtggtcacgatgatcggaccgactttgatggtgtgttcgtttggtgcgagacggttgaaaacgttgattttacggccgtaacgtagcgctcgatagtgggctttcgcgataatgtcgatggattcggggaaggtgccgcctagccaaacccatgcggcggtgcgtgaacatgccacggaccggctcggcagcaatgtcgcgatgatgcaggaccgcccgtacaacgtgtccgaatcgtggcatgaataggcgttcgcgctgtcgagcttgcacagcgcgccggatgaggccagcaggttcaggcacatcgggcccggaaggtcatcgttgcccagaaggggtggtggagtgtccatgacggtaccgtagcggattcgaattccgttgcgccaccagcccccgaaaatctgtggatatgtggaaaatgattgttacgtaatgcaacaatgtggatagatcggcagatatgcaaattatgatgcaaactatttcaaacgattgaaatcgatgatcgcacgtccatcctccaataaaaatccaactaccgaaatacatggaaaatgcgggatatggcgctttgtataatcgggcaccatgagtcatattttggtgaatgttgcttggccgtatgctaacggcccccgtcatatcggtcacgtcgccggattcggcgtgccctccgacgtatacgcgcgctacgagcgcatgaagggcaatgacgtgctgatggtgtctggcaccgacgagcacggcaccccgatcctggtggaagccgacaaggaaggcgtcagcgcacaggagctcgccaaccgttacaaccgtgtgatcgccaaggatctgtgcgatctcggcctgagctacgacctgttcacccgcaccaccaccggcaatcacgagcaggtggtgcaggaactgttcaagcagtgcctcgccaacggctacatttataagggcacccagaaggtcgccatctcgccgtccaccggccgcaccctgcctgaccgttacatcgaaggcacctgcccgatctgcggtgccgacggtgcccgcggcgaccagtgcgacgcctgcggcaacgaactcgacccggacgagctcatcaatcccgtttccaaaatcaacggcgaaaccccgcgctttgaggaaaccgaacacttcttcctcgacctgccggcgctcgccgaagccaatctcgcatggctgaagacccgcgaaggctggcgtaccaacgtcatcaacttctccatcggcctgttcaaggaagtcaagccgcgtgccatcacgcgtgacatcgactggggcattcccgttccggttgccggctggatcgacaatccgaacaagaagctgtacgtgtggttcgacgcggtgatcggctacttgtcggcatccatcgaatgggctcgccgcaagggcgatccggaagcatggcgcgcatggtggaatgatccggaaaccccgggctactacttcatgggcaaagacaacatcacgttccactcccagatctggccgtccgaaatgcttggctacaacggtcagggctccaagggcggcgaaaccggcaagctcggtccgctgaacatgccggagcaggtcgtggcttccgaattcatgaccatggaaggcaagaagttctcgtcttcgcgtggcatcgtcatttatgtgaaggacattctcgcccgctaccctgtggatgccgtgcgctactacatttccgtggccggtccggaaagctccgattccgacttcacatgggctgagttcgtgcgccacaacaacgaggagcttgccgcttcctggggcaacctcgtcaaccgtgtggccaatctgatgaacaagaacttcggtgagattccggcgctcgatgagagcgaaatgaccgatgaggatcgcgctctgctgagcgaaaccaaggccgcgttcgacacggtcggttcgctgatcgagaaccatcgccagaagaacgcgctgagcgaagccatgcgcgtggtcggcgacatcaacaagtacatttccgccaccgaaccgtggaagatcaaggacaatccggctcgcctcggcaccgtgctgcacgttgccgcccaggccgtgtccgacgcgaaccacctgctggccccgttcctgccgcattccgcgcagaaggtgtgggaggctctcggcggcacaggcacgttctcgccgttgccgcgcttggaagaggtcgaggatctcgacaagccgggcttcatgtatccgatcatcaccggcgactacaagctgggcgaaaccgtgcatccgtgggcttccgagccgatcgtggccggcactgcagtgccgaagccgcatccgattttcgcgaagattccgccggaggccgttgaagaggagctcgctcgcttcgattcggagctgaaggctcgtcgtgaggccgaggcggcccgtcttgccgccgaaaaggccaagctggaaggctgattcgctgattcacctggggattcggcttgatttggcctgatttgccgctaaggtgagttgttctgattgccggtgcaaggaattacgaagttcttgcaccggctttttatatctgattttgcaaatccgacttgtaaatctaatgcgcaatattcgactttctgtatacgattttacaaatctatagtgcaatccggattgaatcgatttcaaaatccgtaacaatcgctatttctcttcgccattcctctcgttacaatggggaagttgagggaaatgcgatgctgcagggaggctcttatgttggacgtcaagcgagtgctgaaagccgcgcctacgaaaatgcgttcccaagagccgctgcagcagttgtggacgccttggggcgaacagatcgccggcgaatggttgtcttccaacgacgcccacaaggcgttctgccctgcaaaagacggcgaacgcaaactggaaaacggccgcacgccaatcctgaacgagcatccgcgcccaaccatggtgcgcggcaatcacaccatgctcaacggattctgggattacgcgatcgtgtccattcccgaaagcggcaacggctcgaaatggcgcaaatccgcggctgtgctcacccgtgacgaagcggtgcaggcagtgaaggaagcggccatccccgaaacgttcgacggcaagattttggtgccgttctccccggaatccgcgctttccggcgtgcatcagacgatttacccagacaatatgatctggtatcgcacggtggtgcatcccgtgacgcttgggggaggggaagcggttcggcagatcggcgatgcgaaccgcttggttctgcatttcgaagcggtcgattacgtgtgcgcctgctttatcaacgggcagtttgcagggatgcatgtcgggggatatttgccgtttgacgtcgatatttcggcattcgtcgatcccgatgatgctttcgagattgcgttgtgcgtgtacgatccgaacgattcgggcacgcaaatgcgcggcaagcagaaaatcgagcgcgaggggatttggtacaccgcgcaaagcggcatttggcagagcgtgtggatggagatcgtgccggaagcgtacgtgcagacgcttacgctgaagggcgccgccgacggcagattgtttattcgcgcggaaatcggcggagacaagccgaatgccaaactgcatatcgtcgtagccgatcccgcggacggcacgatcgtcgcggacgaactgctgccggctggcatgcgtaaggtgcgcacggaaatcgcaacgcgggccgaacacttgtggtcgccgaacgatccgtatttgtatgacgtgacggcgacgctggaatttggtgcggcgaaatcgcagggaaagcaggaaaagctgcagcaagaatcgcaggaaattcaagagaaacccgcgaaatcgcaggaaaagcaagatattgtgcgctcgtattgcgcgttccgcacggttgagattaagcctgatttgaagggtatcgcgcgcttccatctcaatggcaagccggtgttcctcaagggtgtgctcgaccagggctattggccggacggcctgctgaccgcgccgagtgatgaagcgctggtgcatgacataaccgccatgaaggaatccggctttactatgctgcgcaagcatatcaaaatcgagtcggcgcgctggtactaccattgcgaccgcctcggcatgctggtatggcaggacgcggtgtcgggtggcggcgaatacaacgcgtgggtcaccaaccgcaagccgacgctcatgcgtgccacatggaacaagtaccgcgacgacacggcgaagcatttcgcggcgctcggtgccgacgattcgacgtaccgccgcgactggtcgcgcacctgcgatgccatggtgcacatgcttgccggccacccgtcgatcgtcacgtgggtgctgttcaacgaagggtgggggcagttcgacgcgtgcgatgcggcggaacgcattcatgcgcttgacccgacgcgcccgatcgacgccacgagtggctggtatgaccagcgttgcggcgatgttcacagcgtgcacaactacttccgtccgctggaaatctacccggataaggggccgttgcgtgggtatgtggccgaatatgaaaagcggcataagcggcgtcgtcgtgccgcgcattacgcggtgttgccggttgcgcagcatggcgttcgtgcgttcgtgatttcggaattcggaggattggcgcagttggttgccgatcatgctgcggtttcgcgcgcgtacggctacggtgaatacgattcgattgaggattggcgcactgccgtccgttccgtgcttgattcggcggaatcgttggaatcacgcggattggcgggctacgtgtatacgcaggtttccgacgtcgaagaagagctcaacggcctcatgacctacgatcgccgcctcaacaaattcgcgcaatgattcgccgagattgagtgcggtcatggctgtcatggaagcgttctgcttcttgcgtttcggtggcgcgttcggtacgttgggaacggcggctattatggcgccatcacagcgagccacggcggaacggagcgaggagatgtgcgttgcgtttgcattggccgcattaaccgagggggtcttgtgaccatgaatcatgttccggaagcgccgcagtccgcaagcggcgattatgcgtggttgggagccgagccgggttccgtagccgatcagctgtatatgtcggcggccgacgaatggaatcaggcaatcaattcgcgttttgtgaatgaattgctggatgatacacttccagaatcgattttgaagtcttatttaattcaggatttcaagttctttaatcagggcatcatggcacatgcgattgaacttgcgccgcgtcaggaaaccaaagatatgctggcgaaacaatcgcaatggtttgctgacaatgaagcaacatattttaccggattccttaaggaatacggaattactgacgaagaatacaataattccgagcagactccggcaaatcgtgaatattgcgaatatctgaccaagctggttcagggaacttgggaagaactcattactgcgctgtgctgcatggaatggatttatcttgcctgggccaagcgcaccatcgacgctggcgtcgttcagcagattccggcgcacaagggttgggttgatttgcatgagggcgattatttccgcgcctggacgggccgcctgatcgcgctcgtcaacgagtatgcgtcggtggatggctcggaggccgacgtgttccgcaccatcgtgcatctcgagcgtcgcttctttgaggattcctatccgcagcggtgagcggtgagcatgatatgaggcaatgagcgccaatgcaaattggcggtaacgcggtaacgcaataacgcaagcagggggtccgcagaatacgcggaccccccgtaattgttggggcaaccggcatgccccaacgtgtcagatcagctcgatatccacatccaagtggagcggcttatcggctggaatgtggtactgcgggtgcaccgggctcatccaggaatcgtcgccgccgacgcccatttgcgcggcgagtacgcgcaggaacatgtgcttcggagcgggcagttcgtcctgatgctgggcttcttccaacatgaatgcgctgtacggctgcaggctgagcgcgaacgctgattcgccgtgacggctcacacgcatgccatgaccggcatcatccgtgatctcagcccaacgcacatcctcatggttgccggtttcctgcggcatgaggtacggcgcatgatcgtcgtaagcgttggtgttccaaatgcccagcttggcatgcttgcggtcggcgtaggtttcgtcgggtccggggccgtagaagcgcaggttggagtattcgaccggcagcgtccattccaaaccgaaagccggaatggtcggggcttcctgagtttcacccggatagtcgacgctcaagtgcagcttgccggtggtgtctgccacatacgtgatggtgacgtgcgtgcgctgcggagtggcgagctcgtactcgtatacggctttcagcgtatcgtcattgacctgttcgatggtgttgttgacgcacttggcgtaacggcctgcgccgacccactgcgcgcggtcgtaaccgtggcctgcaccgcgatcgttgtcggtcagcgcgcggaacgtggtgagcgtgggcttgcgcagcacgaattcacggccgtcaagcgtgtacgaaacaatgccgccctgcgtacgcgacagcagaatctcacgaccggatccctgcacgccagcattccaacggccaacggtcacgatgccgtcaacaggcttcgtctcgctggcagcaaccggcttggagcctgcaaccacggtctggccgaacgacagctcgtagcccttcgacgcccactcttccgcggcggcaaggcgttggctcacttcgagcgtgagctcgttggcttggcctcggtaggcctccaacggccattcaatatcgaagtgcttggtttcgccagccggcacatcaaaacgctgttcggcctgccataccggctcgccatccgcaagcacgcgcgtaacgaacacatagtcggcggtggaaacgaacagattgtcattcgcgatctcaacgccggtttcacccggcacaatgcgcacgttggcatacagctgcttgacgtcttgcgcctttggcgacggcgtgcgatcggcgaacacaataccgtctccggcaaactcgtaatcgctcggacgatcgccgaaatcgccgccgtagcagagacgttcatcgccatcgggcaagcgcacaagaatcgcctggtcgatgaaatcccaaataaatccgccctgatattgcggatagcttgccttgagctacctgctgtacgccatcgccaacgtggccaccaccggcgtgctcatgtacctgttcaagtacatcctcgacaacaccgccgcatactccatcgtgggcgtcatcccggtcatcaccggcttggttatggctccgctgtatccgatcctgaacaagcgcattccgcgccgctacctgtacttgggtggcatggtgctcatgatcgtcggctacctgctgttcgccgtcggctccagcaatctggcaatggtcatcgtcggtctggtcttcttctacctgccgcagactttcattcagatgaccgccatcctgtcgctgaccgactccatcgaatatggtcagctcaagaacggcaagcgtaacgaggccgtcaccctgtccgtccgcccgatgctcgacaagatcgcaggcgcatgctccaacggtatcgtcggcttcatcgccgtagccgcaggcatgatcggtgacgcaaccgccgcggatatgaccgccgcgaacatcggcatgttcaaggtctgcgcattctacgtgccgctgggcatcatcgtgctgagcctgctcgtgttcctcttcaaggtgaagatcaccgagaagatgcacgacgagattgtcgaagagctcgaagccaagcttgcttccggtgaaatctccgaatgatcgaacatagtatgttctaaaaatacatattgaaaatacgattacaatgccgatactgatgggccgtcagcatcggcatttctgttgtatgtaatcctacataagagctattgtgaatcgtcatgaaacctattgtgaaatcgtccataatcatgcaaaacaagcgaaaatagttcgcgctgcatgctatagtgacaaccgaaatgcgagcgatgatccgttatcagcggggagcttccggaagaacggtcgcgtgagcgacttattagacccggcgggaaggcccgaatagccgaacatacaagcggtcgcacgtatatttgaaagtgcggcaaacgaggtggtaccgcggtggcggcgtccagcagacgttacggccatcgtcctcgtaggagatagatagcaagaacctacgaggagatacggtgagcgaaaacaacgtgtatccgaaggcagctgcgggtgagcagagcgccaatgtagcgccgaaccccagtttcccgaagctggaagaatccgtccttgattattgggagaaggacgacactttccagaagtccattgaacgccgtccttccggcgatcacagccagaacgaattcgtgttcttcgacggtccgccgttcgccaacggcctgccgcattacggccacctgctgaccggttacgccaaggatgtgattccgcgttaccagaccatgaagggccgcaaggtcaatcgtgtgttcggctgggatacgcacggtctgccggccgagcttgaagcccagaaggaactgggcatcgattcggtcgatcaggtcaaggaaatgggcatcgacaagttcaacgacgcctgccgtgcctccgtgctcaagtacaccaacgagtggaaggactacgtgcaccgtcaggcacgttgggtcgatttcgagcatggctataagacgctgaacattccatacatggaatccgtgatgtgggcgttcaagcagctgtacgacaagggcctcgcgtatcagggctaccgcgtgctgccgtactgcccgaaggatcagacgccgctttccgcgcatgagctgcgcatggatgccgacgtgtatcaggatcgtcaagacaccaccgtgtccgtggccgtgaagctgcgcgacgaggaagacgcctacgcggtgttctggaccactacgccgtggaccgttcccaccaacttcgccattgtggtcggtgcagacatcgactatgtggaagtgcgtccgaccgaaggcaagttcgctggcaagaagttctatctgggcaagccgctgctcggttcttacgccaaggaactcggcgagaactatgagatcgtgcgcgaactcaagggtgccgaaatggaaggctggcgctactacccggtgttcccgtacttcgcaggcgacgagaacgccgtcgaaggcaaggttccgggtccggaaggctatcagatcttcaccgccgactatgtcgataccgttgaaggtaccggcctcgtgcatcaggctccgtacggtgaagacgatatgaatacgctcaacgccaagggcatcaagagcgttgatgtgctcgacgcgggctgcaagttcacttcgctgtgcccggattacgagggcatgtatgtgttcgatgcgaacaagccgatcctgcgtaacctgcgtgccggcgacggcccgttggagcgcattccggaagatcagcgcgcgatccttttccaggagaagagctacgtgcactcctacccgcactgctggcgttgcgccactccgctgatctacaagccggtgagctcctggttcgtgtctgtcaccaagatcaaggaccgtctgctcgaactgaatcagcagatcaactggattccgggcaatgtgaaggacggccagttcggtaaatggctcgccaacgcacgtgactggtccatttcccgtaaccgtttctggggttccccgattccggtgtgggtgtccgatgatcctaagtatccacgcgtggacgtgtacggttcgttggaggagctgaaggccgacttcggtgactatccgcgcgaccatgagggcaatgtcaacatgcaccgcccgtacattgatgagctgacgcgcgtcaacccggacgatccgaccggcaagagccatatgcaccgcatcagcgacgtgatggactgctggttcgaatccggttccatgagcttcgcccagtaccattacccgttcgaaaacaaggaaaccttcgaacagcatttcccgtgtgattacattgtggaatatatcggccagactcgtggctggttctacgtgcagcacatcatggcgaccgcactgttcgacaagccggcgttcaagaacgtgatctgccatggcatcgtgctcggttctgatggtcagaagatgtcgaagcatctgcgcaactacccggatgtgaacggtgtgttcaacgatttcggatccgacgccatgcgttggttcctcatgagctcgccgatcctgcgcggcggtaacctgatcgtgaccgccgatggcattcgcgacaccgttcgccaggtcatgctgccggtgtggagctcgtactacttcttcaccctgtatgcgaacgccgccaataatggtgccgggttcgacgctcgcgcactgcgtgccgatgaggttgccgcactgccggaaatggaccgctacctgctggcacgtacccgccgactgatcgagaagacgcagcattcgctggatgacttcctgatttccgacgcatgtgaagccgtgtctgatttcattgacatgctcaccaactggtacatccgcaacaatcgtgaccgtttctggaacgaggatgagaacgcgttcaatacgctgtacaccgtgcttgaagcattcatgcgcgtgatcgcaccgcttgctccgatggaagcggaagcagtgtggcgtggtctgaccggtggcgaatccgtgcacttggccgactggccgttccttgccgacgagcagaccggcgaagcgaccgaactgggccgcgtgcttgttgacgatccggctctggttgatgcgatggagaaggtgcgcgaggtcgtgtccggcactctgtctatgcgtaagacaaagcagatccgtgtgcgccagccgctgtccaagctgaccgtggtggtggagaacactgccgccgtggccgcatacgacgagattctgaaatccgaactgaacgtgaagaacgttgaattgtgcacgcttgaagatgccgaagcccaaggcttgaagatcatcaacgagctgcgtgtgaacgctcgcgtggcaggcaagcgcctgcgcaaggacgtgcagttcgccatcaaggcttccaagtccggcgcatggcatgtgaacgccgaaggcgctccggtatgtgagactccgaacggtgagatcgtgcttgaggaaggcgaatatgagctgatcaacagcgtggaggagaagaacgccgaagaggccgccaactctgtaagtgctgcactgccgaccggtggcttcgtgatcctcgacaccgagctgaacgacgatctgatcgcagaaggctatgcccgcgacgtgatccgcgccgtgcaggacgcccgcaaggccgccgatctggaaatctccgaccgcatcgcactgaagctcgttgtgcctgccgaagacgtggccaaggtcgaacagttcaaggaacttgtctcctccgaaacgctcgccacctcttttgaagtgactgccggcgatgagctgaacgttgaggttgccaaggcctgatctggttccaaggatttcgtggatttcgcgaattccgtgaaatccaatcagcttgcgattattccaagctgcggctagagtaatcctttggctttcgagccgccgtggtattgtccaccgcggctcgaatcgcgcaagacttgatttgtgtccgcgtgcgtgatcgtgttgttcaatgcgaccgaagcgtgcggaaacagatcgttaagcgaatggttttcagtaccatccatgtgagtcaagcacacattcttgagaagcagtcgcgttgccggacggctggatttgacgggcgtgcccccatgcgggtgggttgccgaaaatccaccgtccggctttttctttttgtcggcgagctgccgtcgcgggctatacgcggttgcacatacttccgcctggccgtgtgtgccacgaatcattgcttggattccatcggccatcaaggtagaaaatgtaaagtagaaacggtagaaagtgtcaaataggattggtaagaaatgccaaataggcacgccaaaacctagtatttaagccaattccgcaaatcgatgatttcctgatcgcatacggcatgcgccatgccaggatattcgaaaaccgtgcagttacccgtcgccgtaagcttcgcccgcgcacactgctgattggcggcgggaatcgtacgatcagcagtaccatggcacaatgcgaaacgagtatggccagcaaccggctcgctggcagcctcgcccttaaacgacggactgagcaaaatcgcggcatcaaacacatcaggatgctccgcaaccatgcgatacgacagataaccaccctgcgaaaacccaatcagcaccttacgaaactgcccgaacgccggagcgtccaacagctgtacaacgctatcgccgatctcggtgcacgcgcggcggcgctcgctgaccgagcagccgtccggataccagtagtgaccgatgtacgggcgtgcatgtggcgcgcggaacgagagatagctggggcggcgggtggtggggtagtgggtgaaagtggcaacggtgcttccggtggtgttgtcggcattgctatcgccgcaaatcgcattgatgatgcgaaccatctcggattcgtcgttgccatagccatggaatccaaggaacagcaaatcactgggtgaggaaacgccctctttgaaatcgatatttcctgtgatgcccagatgcatggtgtgctcctttgttcctgtatatgtcattatcgcttgtggctgggattcggcaacgccataaaagcaagtgaggcttccggacttattgaaccttatccgtgaccgacatcgtcatttagctacacttaaacagataaatgtagctaactaggaacgggaaccatggataccaacgaggcgcttgccatcccttcgtttggaaaagagcgacatatctggcatattccggaagatgctcccgtttcgcggtcgcgccgttcgcgtggcaatggcgaatatgagtcgaccgtgcccatcaaacttgcgggtctgaattacgtttttcccttccaatctgcttgcagactgtgaaaaggcatcgtgtgcattggcttcctttgactcctatgatgctgcgaaacttggcgaggacaatcacgtgcttggcccgatgagtgcagtgttgctgcgtgctgaagcatcgtcgtcctcgcagatagagaatctaacggtcggagcgaagaatcttgctctggaaacgattgacgagggaacaggcgacaatgccgcggttgtagtcggcaatgtgcgcgccaggaggctgcgctgaagcttggtaatagcatgacggaaaacaacatcctcgccatgcatgaagctctgctttcctcgcagcgtggctgggaggaatatgcgggtgcctatcgcacgaacctggtgtgggtcggaaccgacagctattcaccgcgcggggcggcacatgtcggtccgcagtccgagctgattgccgatgcgaagacggatctgcttgaattcatcaagcatgacgatctgccggtggtggcgcaatgtgcgattacgtatgcgcaattcgagaccatttatccgtttgcggatggcaatgggcgttgcgggcgtgcgttggtgcatgtgattcttcgtaataaaaggttgtcctgcaataccacgcctcctgtttccgctggtttgttgcatgatacggagagctatttcgaggcgttgactctcttccgggaaggtgatgctgcgccgattgccagacaattcgcacaggcatgccgattcgccgtgacaagtggcaggaagcttatcgacgatttgtgcgaacagttggacgaaggtcgttcacatttgcaaggtgtacgttctgatgccgctgtgtggcgagtgttgccgaatctgatcgcgcagccgatcatcaacacgagatacctgcagaaagcagtgggattgtcgaaaccgcaagcggagcgtgcgatcaagaccttgagcgaacgtggtgttgtagtggagcgcacgggaaggcaacgcagcgttgcatatgagcatcgtggcattctcgacgtgcttgacgaatatgcggctgggttgcggagaggatgagtggacggttagttggtcttggcatatcctgcgaatagctgtgaaatgtagcatgtctttactcgtgtattgacaatctgattgccctgctgtttggaggatcttgctgttcgacgtcactcatctcagattatgcagtatgcttgattgcaacaatgactctaattggcgaaggggcaatgacgagcatgacattctatgcaagaactagcgatcatggatatgagacttgtgtagagcacctatccatggctggttgtctagctggtggctttgcacaagtcttcggtcatcttgacgatgggctacttgctggtttggtccatgatttaggcaaatactcggatgcttttcaacgaagaatccaagaccccgatcattccggactcgtggatcattcaacagctggcgcgatgttgctggtacagcatggatgtcctttagcttcaatggcggtagccggacatcatgcgggattgcctgatttcggtagtcggggcgagctggaggggccgacatatagcgcgcgcatgaacagggctttttcggcaggtagttgtggtccgcttgctttatccaaggcatgggaacaacagctgaatattccacagtcagcgttcgagaaaggaacgaaaccatcgaactctatagcaatgagtggaaagtctggagagcagtcattttattctgacatgatgttgactcgcatgttgttttccaccttggtagatggagaccggcttgatgcagagttctttacttcaaatcgtgaaaatcgtacggaacatcctttacttgaatctctaaaagaatatcttggggcagactcgttagcaagtgagcaagcgcctaagtgggacaagttacgtaaagcatcgttgatggtagtttcagagtgtgataccgaggatcgggctcgaattaaacagttgaccgatatcatcgagaacaaggcgaatcggtttttaggtaagcctaataaaaaaccgctcgatattaaacggtgcgaattgcttgcgcagtgtcttgcctgtgggcaagacacatcatatggtactggtctttacacgcttactgctcctactggtagcggtaagaccatctcttcgattgcttttgctctcgaacatgcgcatacaaataacttgcatcgtgtcatctacgtgattccttacacgtcaattattgatcaaaccgtcaatcagtttgaggcaatcttcgggacagatgcagtattgcctcattactctgaagctccgtatcagctcaaagatgagtccgatatggatgagatggatctcaagcgtgcgcttgccgcggaaaactggaaagcgccaatagtggtcactactgcggtgcaattcttcgaaagtctgtactcgaacaaaacatcgagatgtcgtaagctgcacaatatagctaattctgtcatcatttttgatgaggctcaaacattgccagtaccttatctgcggccatgtatacgggcaattgctgaacttgtgaaacgatatggttctacggcagtattgtgcaccgccacgcaaccagaactgcagccgttgctcaatgagtcttttaatagtgagcatgcccaagctcgggagatatcgccattcacaaaagatgaccgtaattccttccgtcgtgtaactattgaacgtattggtgatattgctctagatgtacttgcagaacgtttgaacgatcataatcaggttctatgtgtagtaaacacgcgtaaaaaggctcaatacctctatgaacggcttacggaaaatgacggtgaaggcagtttttgcctgaccacattgcaatgtgcggctgatcgtcaacaattgcttagcaaaattcacaatcgtcttggtgcaggaaaaatatgtcgtgtggtatccacttcgttgatcgaagccggtgtagacattgattttcctgtagcatatcgagaagaagctggattggactccatcattcagacggctggacgttgcaatcgtgaaggccgtcattctgcatcagaaagtatggtctacatattttctacggaaggtggttgtgctccgtttcttcgacagaacattgcggcattccgtgagacggcaaatagccaagttgatttgaatacggatgaagcgattcgtgcatatttcaaggaggtgctgtatctaagagatggtggtacttctagcaatgatgcgcttgacaggcaatgtattttgtcactgcactcgtttgaggagcgtatgccttttgctaccattgctgaacggttcaagcttatagatacgccaactgtgccggtgtacattccgctattcgatgaaggctctcgtttgtgtgaacaactggagcacggcgatatagatcgtactctgtttcgaaaactcggtaaatatgcagttaatgtgtggcctcgtcatcttgaaaagttgcaatcagcaggagctgtactggcagttggccgaggagggaagaatgaagagagctgcttcattcttcaagacatgagcttgtattcatcgcttttggggttgagattagacgatgcgactgctgacggcatttttgtgtgaataatccgtgtgcctagtcgcgcatgcgattaggcacacgggcgttttcaccgcaagacaaaaaacaaatttcaatccacgctctctcagggggcatcgattgcatatgatgaatatgcggtacctgttcttcggcggttaaacacctttgactacaatagcggatattaacttcttgttatttgttttgtaaacattctgaacctgatgtacattggcaaatgaaggcaacatggatgttcctgaacagcttattattccaatgaggggaggagcaatgtcaatacgtttggaagtatggggagacaatgcgcttttcacgagaggtgaatttaaaacagaacgtgtcacttatgatgtcatgacgccgtctgcggcgcgtggaatcttggaagctattttctggcatccaggtatgtgctggcggatcgacaggattcatgtactcaatcctattcggttcgacagtattcggcgcaatgaggttgatagtgtcatcgacaaaggcaaaatacgagcaatggcggaaggccgtggggatggcggtaccatctatgctgctgagtccatccaacaacgtgcatccactattttgcgtgatgttcgatatgtaatagatgctcattttgagcttaaaaggtcgaaaatgacaccaacagattcggcagagaagttccagaacattttcatacgtcgtgcatccaaagggcagtgtttccaccacccatactttggtgctcgagaatttcctgccgagttccagttatgggaagatgacagcgatcccgtcggattcgaacaggggcacagagatttgggttacatgctttacgatttcgactaccgtaatccggctcatcctgttccgttatttttccgtgctgaactaaatgatggcgtggtggatgtcgaatcagtggaggtcaaatcatgattatcagcgatctctgtgacgagtatgcagttttggtgtctcaaaataaagctccagtttatggttatgacaatgttaatgttccatatggattggtcatcaatgatgatggcattttagttgaggtccggctacttggggacttcagtgggaagaaaccaattaacaagatttcagtaccggctcgttttgttaaaacgtcaggtattgtgccagattttctttgcggtaatgccgaatatatgctcggttataataccgagaaacctgagcatgcagtgaaggcattccaagcgtgcgctcaattacacatgcaaatattagagggaattgacgatccggttgcttctgctgtacgtgcattctttttgcaaggtccccaatgggaaattgctaaacggttgatgggagattgctgggaatcgtctctgaagatgaattttgctctgcaacatgttgatggagcacaaacaatatttgttggagattttcctggtatacaaaaagcatggaatacttattatgaccaaaaagggaatgatgataaatcgtcattagtttccagtttagtttctgggaaactggttgtcccggaaaaaactcatcctaggattaagaatgttgcaggggctcacccagccggttcggcattgataacattcaatgctgcggcattttgctcacatggtgccgtgcaaaatgagaatgctcccatgagcaagcgtgaagcctacgagtatacaacagcattgaacacattgctcgctgacgagagtcgagtccaacgcatcgggaatgatactgtcatatcatgggcatgctgcggtaacgctgtatattctgatttgtttagcggattgtatagttcagagacacagtctaatgggttggatgaaaaaacaattaaggatgctacgtgtgctctagcgcaaggaagacggtatgactatgaaggaattcgtcttaatccggatgagcattttcatattcttgcgttatcgcctaataagtcacggctggctattcggttctatctgactgatacgtttggagtgttcgctcataatattgagcagtattatcaagataccgaaattcggcgtccacgctacgacaagacaggttttttgccgatactacggttgctaggtcagacgattagaaaacagcgtaaggatgaaaatgctcctgtaaaaaagcagaagaaaaaaagcgcgatagagaatgtgtcttcggagatggtaagcgctatcatgcaagcgatacttaatggcacgccatatccagtaactctaattaatgtagtggagcgtcgtatcaatgttgaacgtgatgttccaccggataaagctgcaattatcaaagcatattatctgcgtaaaacaactaatgaacaattcaaggaggtgctacagatggacatcaatgaagaaagcgaatacctgccgtatgtgcttggtcgtatattctccatctacgagcaaattcaattgggggccatacctaatatcaatacgaccattaaggataaatatttcacaagcgcatctacgacaccggctcgcatctttccgattctgggggatctcgcagcgaagcatatgcggaaagcttggaaatcagaaggactcaaaatcaagctggacaaagttctcggtacattgactcaaaaagtaggagaccattatccttcgcgtctctcgcttgaagaacgaggtgcatttcaactcggatattacttcgagaatcaaaaacgatttaacaagactaacaagagcaatgaagataatgagcaaggagaaaacaatgactgaccgtaagtctatcgaaaaccgttatgatttcactattctttttgatgtgaaggacggtaatcctaatggtgatccggactccggcaacatgccgcgagtcgacattgaaactggcaatggtttggtgacggacgtttgcattaaacgtaaaattcgcgattatgtgcagacagcgatgggggagcaaactccttggcgaatctatatccagaacaggcggacgctcaatcggctggacagtgaagcattggaagcagaacatatcgatgcccggccagaggataaagatttcgctaaggaaattaagtcgctgaagaaggatgaccccacattggatctgcgtctacgagattatatgtgcagccagttctttgatatccgaacatttggtgcggtgatgactacctttgtcaaaggcagtctgtcatgtggccaggtgcgaggtccggtgcagcttgggtttgctcgttctattgatccggttagcgttcaagaaatatctcttacgcgtattgcggttactacggaagcagatgctgctgataagaataacaccatgggcaacaaattcatcatcccctacggtctttatcgcatgaacggctatatttccgctaaactcgcacagaatgtcacaggtttctgcgatgaagatcttgacatgctgtggcaggcgattttgaatatgtttgagtttgatcgttctgcggctcgtggaaatatggcggttcgtaagctatatgtgttcaagcacagcagtgcgcttggtgatgctccgtcgtggaagttgttcgatagcatcaacgttcataagcgcgatggggcagatgttgcccgtaattttagcgattatgaggttcaagtaaatcgtgaagctattccggattctgtcagcgtaagcgagatggttgaccatacattgtaatccctctctgcacagaccggagattgctattctgcaatctccggtccactttgtgcatacttgaaatctaggtgcaagaattgttcgggggagaaattatatgcggtcgcaatcagaatatccagaagaggactggctggccctgtctggtcttcagcactttgcattctgtcgtcggcagtgggcgttgattcatattgagcagcagtggcaggagaactatctcaccactgccggtcatcttgagcatgagcgtgcgcatgattacgagcagtctgaatctcgtggagataccctcattatgcgagatctgcgtgtgttctcgcgtcatcttggtattacaggcgcttgcgatgtcgtggagttccatcagtccgatgatggtgttcctctacggggcaggaatgggctatggagcgcatatcctatcgaatacaagcatgggcaatctaaaactgtggatgctgaccgtctgcaactgtgcgctgaagccatgtgcctggaggaaatgctttcatgcgagattgttgaaggagccttgttctatcagcggacacggcgacgtgaacgagtggagttaacagaggaacttcgtggcacagtggtagccatggttcaagaaatgcaccagttgttttcgagaggacatactcctcgcgtaaagccgcggaaggcatgcagcgcatgttcgttgaaagacatttgcctgccggagctgttaaaagcaaaatcggccgagcagtacatacatgcttacgtgaatgaggaaacgtcatgaagcaattgttgaacaccttatttgttaccagtgaagacgcttatctctcattggagaacgacaatgttgtcgtgcaacgtgataaaacggcattggccaagattccactgcgttcattggaacagattttgagtttctcctacaaaggtgcatctcctgcgctaatgggccaatgtgcgcagaccggcacgggattgtctttttatacgccgagaggcagatacctttgttcgattctcggtgagaataatcgtaatgtgttgctgcggcgttctcagtaccgttttgccgatgatacagattcctcagctagattcgctcgttcttttgtcattggaaagattttcaacagtcgttgggtgctggaacgtaccaaacgtgaccataatttacgcgtcaatgttaaaaggcttagcggtcaaagccaggctctgtctggatatctaaagcaggtgtctggttgcaacgatgttgatgccatccgaggtctggaaggtttagctgccaaggattatttctatgtattcgacgatttgattctccgctcaaaagatgatttcttctttgaacagcgcagtcgcaggccaccacttgatcgtatgaatgcactgttgtcgttttcctactccttgcttacaggggattgccttgctgcactgcaaggggtggggcttgacccatatgtaggtttcttgcatgtagatcgacctggtcgaccgtccttagccttagacctcatggaggagtttcgtcctgctcttgctgatcgatttgcgctaactctggtcaatcttgggagtatttcagctggtgattttgagcagcgagagaatggtggcgtattccttaatgacgctgggcggaaaatcgtattggctgcttggcagaagcgcaaacaagaagtgattactcatccgttcttgggagaaaagatgccgtggggcttgattccatatgttcaagctttgttgctggcaagagctattcgtggggatatagacgcttacccgccattcatgtggaagtgataggccgtgaagctgctgatgaaggagatgactgatgcttgttgtggtgacatatgatgtgaatactgaaacatccgctggtaaaaggcgtctacgtttagtggcaaaaagctgcatgaaatatgggcaacgcgtgcaaaatagcgttttcgaatgtagcgttacttctgcggagtatctcacgcttaagcatgatctgttgagcatcatcgatgtcaaaacggatagtttgagatattacaatttgggaacgaactattcacggcgcattgaacacttaggcgttcaacgtcatgttcccgttgatggagtcatgatggtatgacttctaaacgacatgcagtgcgaccctgaagcagtcatgagttacaggtaggttcgcaccttttttgtgcggaggaaattaaaactggaaccctgatgtaatttcggattgttgtttgataatcgaaaagtgtagtcagatagagtttgatctttgcatttggacgtatttggggcggtggggaactgatgtaatatgtgtatcagccgagatgaggttttgcttgaatcattatttggtcaaaaatgtctcatttctgcggtcgctccccgcaaggggagtgtggattgaaatatcgagcagacggacgcgccgcgcatcgtgttcgagtcgctccccgcaaggggagtgtggattgaaatagctttagcgtgcgtatcgaccgcgaaaactcgggtcgctccccgcaaggggagtgtggattgaaatgtttggtcaatccattgagcaaaagtaatagccagtcgctccccgcaaggggagtgtggattgaaatagtgcataattgtcagttttgttgtaaatggtacgtcgctccccgcaaggggagtgtggattgaaatgaattcaccatcaacgcttatccgaccgcagacgtcgctccccgcaaggggagtgtggattgaaatgatgagtgtttcgtctatggagaatcggtatgccgtcgctccccgcaaggggagtgtggattgaaatcacgtcggaatcgtccgaggtcaatgcggcacgcgtcgctccccgcaaggggagtgtggattgaaattgcaaatgacaaacgtattgagtgatgaagcattgtcgctccccgcaaggggagtgtggattgaaatgcattccagcatcgagcaccggaaacggcgatggtcgctccccgcaaggggagtgtggattgaaatacttcagtcttccgagacaacagtgagggttatgtcgctccccgcaaggggagtgtggattgaaatttctgctgggacgaaatgctcgaaaccaccaatagtcgctccccgcaaggggagtgtggattgaaatttgttgtagaagggcagcacgtaggctcgtcccgtcgctccccgcaaggggagtgtggattgaaattgcgtcaatcggatacatgtactcggtattaggtcgctccccgcaaggggagtgtggattgaaatcacgaccgtcttggactcgctgatgctatcggcgagtcgctccccgcaaggggagtgtggattgaaatactgaccttgaaccttccatcctgctgatggaagtcgctccccgcaaggggagtgtggattgaaatacgccgtgttctctcactcccctgaaacgtgttcgtcgctccccgcaaggggagtgtggattgaaataactcacgctctgataggacagtcaaacccccgcgtcgctccccgcaaggggagtgtggattgaaatagcagaccgcgaacgaattgaaagcgtctccaatgtcgtcgctccccgcaaggggagtgtggattgaaatctccaatcatttgaccagataggcgaggtattcgggtcgctccccgcaaggggagtgtggattgaaataacgtccagatcaaggacggcgtcgcgtacgtgtacgcgagtcgctccccgcaaggggagtgtggattgaaataacatccaggacaaggacggagtactctatgcctagtcgctccccgcaaggggagtgtggattgaaatgaattggtctgcaggcgtaggagctgctccgcggtcgctccccgcaaggggagtgtggattgaaatcttgagttcgcgcacgctgcaggtgttggtgccgtcgctccccgcaaggggagtgtggattgaaatttttggaccgtttggtcaagcgaagcgtgcccgggtcgttctcctcacggagagcgtggattgaaatcggtgtctgcagcgttccggccaccgcgtggatgtcgctctccctgtttatgtccagtgttctccgcacatgcggggatgattccgcatgtgcgggactgttagtttcaatgacaatccgaggggtgaaaacgagtttatgggcacgcgtgcggagtctcagatgcgcagaactcctcacgcagtgcatatcacaatcccagccaggcgcgtaggtcacgaatttcctgatcgcagatgccgtggcccattcccggatattcgaaatacgtgagattgccggtttgcgcaagtttgttgtgcgcgcaccgttgatcggctaaaggaattgtgcggtcttcgctgccgtagcagagcgcgaatcgcgtgcgtccggtcgcgggcaaaggctcagcggtttcgcctttgaatgatgggctcattagaatcgccatgtcgaacgcatcgggatgttccgcaaccatgcgatacgacaggtatccgccctgcgaaaacccgatcagtaccttgcggaaatgcgcgtatgcgggcgaatccagcaatcgtacgacggcgtcgcctacggcactgcactcacgtcgacgctcttctacggaacatccatctggataccagtagtagcttccgatgtaaggacgttcgtacgtgccttggaacgacagataattcggatgctgggcaggagcaatggagttgtccgttgaagatgcgtcttgcttcggaacatcataaatcgcatcaataatgcggatcatctcattttcatcattgctgaatccatgaaatcccaagaacagcagatcatcgccggccttttcgagggctgtcacatcaatgctggtactcacgttcaaacgcatgtcatcctcccatcgcatgtcgatagtatgcagatttccaacggcaccataacggtggacagcgaagtggggaagggcacgacgttcaccgttatgctgccgttggttgaggaaaacactgaatatgtggcgaagtttacagcaatccatccgcatgcaacgcgccatacatgcggtccaggcattcgaccagcagcggatacggcattgctatgttcacgcgcacgcatccggcaccggtctcgccgcatgaacgtccgtcggtcaacgccacttgcgccttctcaaggaagtatgcggccggatcgtcgatgccaagcggcgagaaatcaagccatgcgatatatgtgccctgcggtttgatatagccgacgccggcgaacctttcacgcatctgctcgtcgaacaacgccaaattcctgcgcacataggcaaacgcatcctggaaccacaggtcgccttcgttatatgcggtggtggtggcgattgcgccgatggtggcggtctgatgttcgctccactccgccttgaccgcccacatgtcacgatccgcaggattggtaagcagcacctgcgcgcacttcgtgcccggaatattgaacgatttcgacgcgctggtagcggtcatcgactgtaatgcggcctgctcgctgatggtggggaacggaatgtgcttgccctcaaacacgaacggcgcatgaatctcatcattgaaaatacgcacgtcatactgtgccgcaagatcgctcagacgcagctcctcctccaaggtgagcactttgccgatcgggttgtgcgggttgcagagcacgaacgcatggcatccggccgcaaacgcgcgttcgatggcgtcgaagtcgaacacccattgcgcctctccggtttcggcgtcgccgctttgcagcatttcgatttcgatcacgtcaacgtcgtacagtttcggaacgctcaaaaacggcatgtaggcaggcgtcggcacgatcacgctgttgcccgcaccgaccagttcacgcaggaaaagctcataagcttcgagtacgtcgggaaccacgcgaataatgctcggatcgacatcccatccgtaatgcgagcgttgccatcctgcgcatgctgctgccacgcgctgtttccagggttcgggaatgtagccgagtttgcaatggtcgcaggcgttgtcgatggctttctgaatgcagggagccaagccgtagtccatttcggcaatgaacgcgccaatgcagccggggtagcgtgtccacttgtcggagccgactgcggcaagatcggctgcggtggtgtggtcgatggcgtcggcgtcaaagccggaaccggtacgatgcttcatttccatgatttcttccatggttccagcatgacgtaccgatgcttgcacgaacagtgtgttcttgtactgaaagcaaagactgttatgaagttttcttatatcagatgcttttgctattcaattattaatctgattatgacgatatagcaaaatactggaaacaattgtttgctgcagtattccgcgattgcgaataagcacggatatcaaacgatgaatcaaatgttttccaaatactggtgtgacgccctttcgatttcgtctttgacgcgggccactgccggtcggtcgtccacttttcttgtgacgaaacagactgtgcggaatgcgttgttgtcggcgattggcagtgcggccaaatcgggttggattccagcggttgtggctaagcgagatatgatcgagacgcccatgccaacttccaccagattctgcgtggcccaaaaatcgtcggtcgaatgtgtgatttccggtgtgaagccggcggcacgcgccaacgacaccagattcgcctggcaggtttcgcagccggcgatccactgttcgctgcgtgccgaaaccaattggaccggcaggtgcgagctttcgtactggcgcgcgatcgcattgttcgcgccgatcagcagcatcagcggatcgacaccgaaaggagcgacttccaaatcgtccggtccggccaaagcggggagtgaattgtattggaagatgatcgcgcaatcggcaagcccctgttccaacgcctccatggcctcaggcggctccatctgcatgaggctcacgcgaatgtcggacgttttgctgatatgcacgagcacgcgtgccacgaacgacgaacataccgatggaggagcgaccaaacgaatatgcgtcgatccgttgcgctggtactcttccacatctttgacggcttgggtgacgcgattgtcgatgagctgcccgtggcgtgccagaatacggccgatcggagtcaattccacgccatgcgacgtgcgctgcacgagttttgcgtcaagttcgcgttcgaccttgcggatctgttggctgatggccggttgcgaccagccggtttcgcgcgcgaccgcggagaacgaacccaaacgttccacattccacaaggtcacgagaatctgcgggttcagtgttttcgtgctgaatcccgtggcattcgcggtgatgctgatgtcggtgttcgtgttggcgttttcgcgcgtgttgctatcggctggagtgttcatatgagggtagtgctcagctttttaggaatgcggggatggcctcggctgccgcatagcccgcgcggtacatgcgttccaatccttcgaacgacttgctcaacgtgaggttgtcggtgtcctgcagcgcgtcatagcccttgatggtggagaagaaggaagagcacagctgcgcgttcttcgcattagccgtatagctccaagccttggtgaaggactcggcggtcacatcggtgccatcggtgaacttccaaccatccttgagcttgatgtcgtactgggtggcgtcatcattggcggtaatggactcagccacttcattctgggccttgccatccttatcgaaagacaccaacccagcgaacagcagatcgattggacggccaccgccggtttcattggtgttgcccggaatcaagccattctgcggttcggagtcaaatgccgtaatgacattcgatccttcagtcgcgttcccagacgtggaagacccacagccgcccagcatcatgccaagcacacaggccgccgccgcaacggcaaacaccttgcttttccttatactcattatgttttccctcattattcggattaccggtcggtattgtttccccgtaccagcttcatctaggtaatacaccctaaatcaagaagaaacaccaatttctgttacaggaatgtaacgaaatatccatggaccgcgactacgcacgaggaaatgcctgaccgtatcgggctttcaattgttcgatggagacatgcgtgtaccgttgcgtggtcttcagcgaagaatgtcccaagagctcctgcacctcacgcaaatccgctcccccgtcaagcatatgcgtggcggcactgtgccgcagagcatgagggctaatgtcgggaacgccggcatcacgcgcgcattcgtgcaccacacgacgtaccatccgctgatcaatgcgtttgccttgtctcccaagaaacagcgcagccgcggactgctcccccaccaacaggggacgcccatcatccagccaccgacgtatcgctttttgcgccggagcgccaaatggcatgactcgttgtttgttgcctttgccggtcactttgaccgttcgattggaaaagaccacatccggcacatcaagtcccaccagttcagccacacgcatgcccgttgcatacaacagttccagcattgcggcgtcacgcagctcaatggcctgctgcttcatggtccgttccttcggctgagacgtttcaccgtcctcatccacgcgttccatcagctgttcagcctgtgattcgctgagcacatccggcaacgtatcaggtattttcggggtcatgagcgcacaagccggatccgtcgtcgtcacgccatgctcatgcgtccacgcgaaaaaaccacgtacagccacagtttttcgggccatgctgcttttcgcatggtttttcgatgattccgccatccacatgcgaagatcttcgatggtcacctcgttaagatccctgcatctaagccgctccaaggcaagcagacattcttcgacatcgcctcggtatgccttccgtgtgttttcactcaatccacggttggctttcagatatgtatcgaatgcctctacgctcttatcgaacagcatgccgatcagcctttcccgagctcaacagcaagcccgaatccatgaatttctttccattatgtgtccattctccgatagaaaccgaaataccggcacaacttgaaaggagaccaactatgctgtccagtagcgttcgctcagcgaatccgtcgatgatcgtctattcgaaggggagattatgccgattccaaacgaaattccagcaggtgcacgcattgtggtgcgcacctgcgaaggtgtcgatccaaaggaccagcgcatgaaattccgcgattatgtcggtcacgtacgttcttgggacgggcagacattggaaatgacgcgcgatgcggcagccaacggttcacgcccagagcaacgtgtcagcattcccgccgacaccatcgtcactgtcaaaccggttccggaacgttccatgacacggccgcgcccatagcgcgtcacactgcggaacgcacctgtgccatagcttgacggtaaccgtcgaatcgcacgatatgctctcccctacgcgccgactccagaagcatctgctgccatccggtttcgggaattgccagttcgaccgtttcgcaacgttcttcgaagtcaggttctttggcgagagccttgtattcacggaatggctgcccttgtatgaagaaacgcgccatctccttgtcgtcaccggcagtgggcgagccctgttgcgtggtcatgccgtgcagcacgttggccataagcgtcaaccgattggccatattacgcagcaacgcttcgacattggcggcgtcctcttccaccattgcacgggtacggtttggatcggttagcgcaacacgagtcatgtcccgccatgaaccagcggcgagcgcggctgcgatgttccggttgggattggccaccagctcgttgatcatagctgtggaaatgacgtgtggcatgtgggaaatcagtgccgcgcaacgatcgtgggtcgcatcgtcaagaacgatgagtcggttggaacaatgatccacaatcattgtcgcaacggcgcggaaccgctgatactcggtgttttcatctacggtgatggcccagagcgcgccatcgtagagcgtcggatccgacgattcccatccggacagctcattgcctgccatgggatgcgcgcccacatagcaatgttccaatccaacggctttaacctgttcccgaaccattgctttgacactgccgacatcggtgagcgtggtgatgtccgtatcgatcagtggcttcaacgcacccaggatttgcggcatggccttgagcggattgcataacacaagcacgtcaggttttgtgtcggcgagcgcggccagtgtggacacacatcgtatgccgtccgctttcgcagtttcatatggacgatcgttatggttccatgcgatgacttcacagccagcattaacgagtctgcgagccagtgaccctccgataagaccaaggcctacgattgcgatacgctgcttcaccacatcagctcctttccgaccgtttcgccgttctgccaatcatctggcagatgctgttcgtcaagccgtacgcctccctgcggcagcatccatgaggtgactggaggattggggcgttctcttcgtgggtatacggccagagttttggcccagtcaccgtgttcggcgatttcgaccagcgcgccatggaagcgttgctcccatggcgccgcatcgagcgtcgcgataaaactgtatgtgcctgtgcgtcctttgattggccgcgagatgaaacttgtcatattgaggcctgcatcgcggaatacgtccagcaggttcgcgagtacgccaggacctgtgacaagcggaataagcgtcagcacggattcgtattccatatcagcttgcgaacgaggctgttccaacagttttccggcttccttgcgtggtgcgagcacaagaaaatcagtctgtgcgccttgataatcctgcacggcggtaccgatgcgcgtcacattgtagagttcaccgcaaatacttggcccgaaagctatttcgtttgctttgatatcgcgacatgcggcagcattggatggcgctggagtcggttccaaatggtgttccgcgatgaaacgtttgcattgcgcgagaccatgcgcgtgtgcggtagccacggtggcgtcttccggattggatcccgcacgcacatatgcgtcgaaagttacgtcgacgcccactcgcgcaaatccgactagatctttggcgtcgatgagcgcgtccagattcggcaccacgtaaccttcgacgttgttttcccatgccacgacgccccatccttcgccccgctgcgcggcatcaaggatttgcggtacgtcatccgcagccaccaattcgaatccttccggctcaagatgggccagtgcctgcgatgcattgactgcggcctgatgggtgaaggtgccttgcggacctagatagaacagctttcgtgcgctcattcaaccccattccttattcttggtgttcccctgaaccttacctcattgccgtggaatcgactgccgattattccaccggttgggcgttatcagatgttttaccctcgttcgtctgcgtatcagcagcaaacgcaccatcacgcgtctccttacgcggaggtgtgacgaaccaacgtttcggcagcaccagcatcacaaccggaataagcacgacaccgtacagccacatgtatcctgcctgttcactgaagaacggcatgggatcatctccaccgaatcccacaggaatcatggcgtctcctcccggaccataccccgacatcaccgtccagaccaccagagaggagccgatcaggtgcaatgcgaggcctgagacaccgtcgcgtgatcgagctgaccatgtcgaaatgatcaccatgagataggcgatcgccaatccgtagggaatattcatggatgcgcccatgcgatgggccatggttcccactactccgactatgattccggaaaccagatcgacgaggaaccgtccccaaatcggcagacggtatgaccatggcatcagttgcgcatcgggcgccgcgtcttgattcgacccatacgtatcatgcgattgcttcatctgttgcatcatatcccctactatcgctcaccaacctgaaaagaaaaagagatacgcgaggacacgtatctcttttcatggaagcaataacagcatcacttgttcttctgagcgttattctgctgagccgtcaaacggagagcccagcgggctcaccataggcgaagtgagcaagcactaccgtgcttgcgaagccgacagaacaacgtgaagaatcacttgttattctgagcgttgttctgtcgacgctgcttggcgcgccacttgtaccaatcctcacggctgagaatgatcttgcgcacacggatggattccggagtgacttccacgcactcgtcctcgttggcgaagtccaaggactcttcgaggctcatcttgatcggcggagtcagggtttcgagcacatctgcggtggaggaacgcatgttggtcatatgcttggccagcgtgatgttcacatccagctcgtcaggcttgttgttcacgccgacgacctggccttcgtacaccggagactgcggttcgacgaagaagttgccacgtgcctgcagacgctgcatggcgtacggagtggcgatacccttgcgatcgcagaccatggaaccgttctggcgggtcacgatctggccagcccacggagcgtagccggcggagatggaggatgcgataccggtgccacgggtggcggaaagcagtgcggtgcggaagccgatcagaccacgggacggcacggtgaactgcagacgaacccagccagtgccatggttggtcatgttctccatacggcccttacggtcggcgagcagctgggtgaccgtgcccatgtactcttccggaacgtcgatggtggtgttttccatcggttcgttgatcacgccgtcgatggtcttggtgaccacctgcgggcggccgacggtcagctcatagccttcacgacgcatctgttcggcaagcacggccaaggcgagctcgccacgaccctggacttcccatgcatccgggcgttcggtcggcagcaccttgatggacacgttgccgatgagttcgcggtcaaggcgatccttgatcatgcgggcggtaagcttgtggtccttgccttcggttccggcaagcggggaatcgttgatgccgaaagtcatggagatggccggatcatcaacgtggatcagcggcagcgggcgcggatcggacggatcaacgatggtttcgccgatcatgatgtcattcacgccggcgactgcgacgatgtcgccagggcccgcggaatcgaccggggtgcgctcaagaccctgcgtacgcagcagttcggagacgcggaagttttcgacggagccgtccacacgggacagaccgtaggtcttgcccttttcgagagtgccgttgtagatacgcaccaagccgagtcgacccaggaaatcagaggaatcgatgttggcgacgtgtgcctgcaaaggcgcgccttcctcgtattccggagccggaatgttcttgatgatggcttcgaacagcggttcgagatcttcgttatccggcagaccgccattctccggctggttttcggaagcgtagccggccttggccgcgcagtagatgaccggcaggtcgaacagcgcatcctcatcgagatcgataccctcttcgataacgtcctgagccaggccgagcagcagatcggaggattctccaacgacctcttcgatacgtgcgtccggacgatcggtcttgttcacgcacaggataaccggcagcttggcttccaaagccttgcgcagcacgaagcgggtctgcggcagcgggccttcggatgcgtcgacgagcagcacgacgccatcaaccatggagatgccacgctcgacctcgccgccgaaatcggcgtgaccaggagtatcgatgatgttgagggtgatgccttccggatggccgtacttggcggccagcggaccggtgtactgcacagcggtgttcttggcgaggatggtgatgcccttctcacgttccagatcattggaatccatcacacgatccggaacttcctcacgttcgttgaacacgtgggactgtgccagcatgacattgaccaacgtggtcttgccgtgatcgacgtgtgccacaatcgctacatttcgaatatcgccgcgaaccgccatcgaaacctctcttagtattgctgttctcttgcgttaccgttcggtacatactggttatcggtacttacaaatccgtactccacacaaaccgagccaatcctagcgaaccattacgacagttccggtcccagcgctttcgcccacatacaaagtttgcggttgtcgaatctcaacaaccgcaaacgtatgatctcttgggaccactcaaaataattcgttaatcctcaagttccttaccagtgcgttccggcaagcacaacgccgcaacgcaggccagaatgaaggcgaccgcgaaaacgatgaatgccaccgccttgttgccaccggacagcgtcaggaaccacggcatgagcagcggagctatgatggcagccactcggccacatgccgcagcagcaccggacgcagcagcgcgcaggcgggtcggatagatttccggagtcaccgcatacagtacgccccacgcgccaagattggatgcggacaacaacatgccaaagcccaacaccgcagctacggaacccgcttgcgagaaagcaaacgcggccacggccgacacggcaaggaacacgctcagcgtcttcctgcggccccagatctccaccagccatgcggccaggaagtatcccggcaactgcgcaacggcgatggccagcgtatagccgaacgacttggtcagcgagccaaactggtcggccagcagcgacggcatccatgtgaacgctccatagtaggagaagttcacgaagaaccacgtggcccaaatggctgcggtgcgcgcgatgcactttttgccgaacagttcgcgggtgttgatcttcggcagtggtttgcccttcggggaagccactggctcgatgccacttgcctgttcgaaatagcgtacggcctgttcggcttcgtcctcacgccccttggattccaggaatcgcacggattccggaatatgaacacgcgtcacaatggcatacagcagcggcaacgcgccaatgagcaaagcccagcgccaaccccaatcgccggtattcggaatcacaaagtagccaatgcaggcggcgacaatccagccgacagcccagaaggattccaacagcaccgtcatacgaccgcgttgtttggtcggagagaattcagaaaccagagtggaagccactggcagttcggcgcccaaaccaagaccgatgatcagacgagcgatcaaaagcgcggccaacgaccatgacagtgccatgccgccattcgccaaaccgaaaatcaccagcgtcgcggaaaagaccgttttgcggccaacacgatcggctacaaaaccacccagcgcagcaccgatcgccatgccgacgaagccgatggacagcacccagcttttctcggttggtgtcaaattgaaatgcgggtcagccgcgatggccgccacaacgaaggacaccaagccgacgtccatggcgtcgaaagcccagccgataccggacgccaccagaagtttcctatgcgctttgttaaacggcaggcgatcaagacgctcattgcgtgtcaacgaacccgacgaagcaaccgatgcggattgcacggatgtcatacttcttcctctcatacgaaacgaccatgcctacaaggcatgccgaaaaccagacagaatcgtctgaaaaggaaacaatccgaaaagacgtcagatcgtcgtcaacgcggaaagcacatcatcctgcgtttcccgcacatcgaaatcatggcgatcccgagcatcgctccatgtcgactgtcggagcacatccatggtgtagcgatacaccgttgccggacgattgcgtccgacacgcaatttgtcaccggtgtcctccagctgcccggatgcgagcatcttacggcggaaattcgccagatcgatgctctgaccggcaacggcctcgtacacgtcatgcagctggctcagcgtaaacctctcgcctaccaatctggtgacgatctgcggatattcgattttgccacgaagtctgctgagggcgtagtccacgatgtcgccatggtcaaatgccaactcaggcagatcatccacaggaaaccatttgacattgtcgtcgatactctgcccgagttgcccgttaagatcgtcgactaacgcccaatagacgatggataccatcggcagcccgccgtgtgagcgcgccggatcgccgaatgtatacagctgttcaagataccgtggatgcaacgatgtcgtggattccagcgcaacgtaggcagattgctccagcgagtggtcagccctcaaaccaccaccgggcaacgcccactggccaagaaaaggctggcgcacgcgccggaccagcggtatccacaaggtggatcccgcactggttcgagcatgttcctgcgttccgtgggaagctggccccaaagcgagaatgaccacggaaacgcccacctgcggcggctgtttgcgtcgttctgagacattgcccatgatcatcgcgacctcacctctccgatcttttgtcgatttgaattgttccggaatcacagtgtagcacttatagtcaacatgactataagtgcagtgtttcaccacaccgcttgaatttcaacccacgtatgcccttcaacgaaaaaggccccacgaaggagccctatgcgtcttatgcgacgatgccctgagcaatcagctctcgggcaacctcacgatattccttcgcggtcttatggttcggcgcataaatggtgataggcgcggccgcaaccgtggaatccggaagtttgatggaacgtgagatgactgaatggaagaccttgccttggaatgcctcataaatacgctgcaacacttcatcacaatgcaaggtatgcgtgaacatggtgacgagcactccgtacacttccagactcggattgatgcgggattgtactttttcgatggactgcatcaacaaggccacgcctcgcagtgcgaagaactcagcagccacgggaatgatcacgccatcggcagcggtcagcgcattcaccgtaagcaaacccagagaaggctggcaatcgacgatgatcacatcgtattcatccttgacctgacgcaacacgccagccagcacctgctcgcgcccaacttcggtgaccaactgcacttcagcggcggacagatcaatgttggccggcatgatatcgagattctcgaaatcggtatgtcgaatcacatcatgcacatccatgcgaggattgaacagtgcggtgtacaccgtatcttccacggtattggcgttgatgcccaaccccaccgtggccgcaccctgcgggtcgaaatcgacgataagcacgcgacgcccatactggctcaatgcaccagcgatattgatggaactggtggtcttgccgacgccacctttctggttgcacatggcgatgatcctcgccggaccgtgcgtctgcagcggctccggagcgggaaacgtctcataatcacgtccaagcaaatccgtaggcataccgtttaccttaccaacatccttgtgtcaattttcactgtaatccatgctagtccattgtcaccgttcaaaacggcagcaacaccatcatctggcgcgcggatgagacatcagatatgtctcaatcaggttttcaggactgatatgcgtgtaaatctgtgtggtggtaacgcttgcatgaccaagcagctcctgcacggtacgcacatcggcaccgccctgaataaggtgcgtggcgaaagagtgccgcaaggtgtgaggatgcagcggcttatcgatgtgcgcacgctcccccgctcccctgatgatttcccaaaccgactgtcgcgacaatctttttcctcgtttattcagaaatagggcacgccgttccacgggacctttcgatttggattccagcttaggacgccccgcatgcaaataccggatgatcgcttcgcacgcatagctgccgacgggaaccagccgctgcttagagcctttgcccataagtcttgcgattctgccgtctacatcgacatcatcgagattcgcaccgcacgcctccgacacgcgggcaccggtcgcatacatgaattcaagcaatgccttgtcacgcaacatcaccggatcatcgggaaactccgacacgacaccatcatgctctctgttttgagaaacggggatagagtccagcagtctagccacctcatcaacggtcagcacatcgggaagcgtgctcacgcccttaggggcctttacctgcgcggacacatcatcgacaacaatatgttcgttcactgcgaaacgatgaagcgcatgaatgctggccaaccggcgtgccttgcttcgagatgactctcccgactcgtcaaggaagacgatataacgttccacatcctgtgtcgtcacggccgcgataccgccaacgccttggtcggcaagccactgacgatacttcttcaaatcggcgccatacgccgacaccgtcgccttcgacagtcctcgttcaacgtcgatatgagcgaggaattgccgaattgtccgttcgaaatcgtccatcaccctccttccagcagatcccatccggctcatcgtataccactgagcggtcccttaccataggtcaaacgagccctgccatgcaacgcaggaacccccgcccattgctggagcgagggttcctgtcaatcacgctgaatcagcgaagaagctcaggcttccttcggagcattcacatcagccggaagagcggccttggcctgctcgacgatggccttgaaggtctccggatcagagatggccagctcggcgagagcgcgacgatccagttcgatgccagcgaggtgcaggccctggatgaagcggttgtaggtgatgccctcagcgcggacagcagcattgatgcgctggatccacagcttgcggaagtcgcccttgcgagccttacgatcgcggaagttgtaagtaaaggagtgaagcagctgctccttggccttacggtacagacgggagcgctggccgcggtagccggaagccctctcgagaacgacgcgacgcttcttgtgggcgtttactgcgcgcttgacacgtgccatgtttgattcctcagctttctattaagtcttcttattcgctctcgctatactcagcgaccgagcagcttcttcatgttcttgctctgggaagtagccagaacgccatcggccttcagtgcgcgacgcttacgagcggacttgtgctcgaggttgtggcgcatcgcggagccagcgtgcatcagcttgccggaaccggtcacgcggacgcgcttggaagcggcggaattagttttcatcttcggcattgctgccctccttgtttattacttcgtttcggaagtcttcggtttgtcggatgccactgcagccttggcttcggccgccgcctgagcttgggcttcctgcttggccgccagacgtgcagcctgacgggcctgacgctcggcacgggactgatcaccacgacgacgctgctcggactgggtgtgaaccttcttgcccttcggtgcgagcgtcatgatgatattgcggccttcctgcttcggagcgaattcgacggtgccgtattcctccacttcgctggcgagacgctgcaagagctcgacgccaccgatcggacgggactgctcgcgaccgcgcagcatgatggtgaccttgaccttgtctccaccgttcaggaagcgcacaacatggcccttcttgacttcgaagtcatggtcgtcgatctttagacggaagcgaatttccttgatttccgcagtgctctggttacgacgagcctcacgagccttgatcttctcgttgtacttgtacttgccgtaatcgatgagcttggcaaccggaggcttcgcgttgggcgccacctcgacgagatcgaggttcgcttcctttgccaggttcagtgcgacggaagtcgcgatgactcccacctgttcgccgttcgggccgatcagacgcacctgggagacgcgaatctcgtcgttaatgcgtggttcgtcgctgatgatgactccaatcctcatgttccattcgacggaatgctcccagatcggcagtttttcaaagtctcgcatgttcacggcaagccaaaacacccaattcgagggcgcaacaaagagccataccacagctcttccactgccgtttcatacggcaccagaggcttatgcctgaacccgaggccctgaaaggcttccaggtggagatatcccgctttcttgatttctcaagccttgtagatgataccacacaccgcgaccacagcgtgtcgcataatgaaaccttctgaaacatcttctttaatcattccaacgccatattacactgaccccatatgacagataattccaacacatgcgtgattttcgcggctggcgaatactacagcgatacccccatcgttccgtctggagcattcattatcgcggcggacggagggcttgaccatgcacgcgcacttgatatgtcgcctgacgtggtggtgggcgatttcgattcgcttactggagaacgtccgacacagggtgaacacaccattgccctacctccagaaaaagacgatccagaccttctgtcggcactaaaaatcggctggtcacaccatgcgcggcttttccatatatatggcgcgctcggcggacgaatcgatcacaccatatccaatatccaactgatggcattgctggctcagcatggtgcggtaggttttctgcacgggaacggctccattgtgaccgcgatttgcgatggagcactcgatttcggcgagaacaacgtcgaaccaggacgtatggtttccgtattctctcattccgacacctctcttggcgtgagcgaacgtggactgaaatacgagatagatgacatgacgatgaccagcacacgtgtcaacggcgtcagtaacgaattcctcaacggagccgccgcccatatcggcgtcgaacatggcaccttggtggtgactttcccttcggaagccccactaccagcagtctcttggcaccacacatttgagggtgacctcggatcgttggacaccaaagtatcttcagcgcttgccaagcacgaactccaatcccgctaatcgcaaagcgaagaaaatcacctttcgtctatcacgttcatctcgaaaagatgatgtgagcgttcacggaaaaacacgacgttttctgaaacacacgcgcgagtgcgttgccttaagtacaggtgacgcactaaagtgggtgacgttggtaaacaatggcttctgtgtgcccagcacacgcgtggcctaccctaaagggagaattacatgacagttaagattggtattaacggctttggtcgtatcggtcgtctggctttccgccgcatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggttgaggtcacctccaccgaagactccatcgtggtcgatggcaaggaatacaaggtttacgccgagaaggatgccaacaacatcccgtgggtcaagaacgatggcgttgagttcgtgctcgagtgcaccggcttctacacctccgctgagaagtcccaggctcacatcaacgctggcgccaagaaggtcctgatctccgctccggccaaggacgagaccaccccgaccgtcgtcttcggcgtgaaccacgagatcctgaaggcttccgacgtgatcgtgtccgccggctcctgcaccaccaactccatggccgccatggtcaagctgctggacgagaactggggcatcaaggctggcttcatgaccaccatccacgcctataccggcacccagatgatcctcgacggcccgcgcttcccgaaggctcgcaacaaccgtgccgccgcaatcaacaccattcctcactccaccggcgctgccaaggctatcggcaaggtcgttccgtccgtgaacggcaagctgcagggccacgcccagcgtatccaggttccggatggctccgtcaccgagctgaccaccgtcctgaacaaggaagtcaccgctgacgagatcaacgccgcattcaaggctgccttctcctccaccgacttctacggctacaacgaggatggcatcgtgtcttccgacatcatcggagacacccacggtggcgtgttcgatccgacccagaccgacgtcaacaccgttgacggcgtgaccatggctcgtaccgtttcttggtacgacaacgagtacggcttcacctgcaacatggtgcgcaccctgctgtacttcgctgagatctccgagtgaaccatggcggagcaatccgcacagttcactaagtagaacttggtacaagggctttcgtctcacggcgaaagcccttttgctaaccgacacaaatacgttttagagtgaatcgatatgggcaagaaaaagcatgagaagggcgccggctccacgccggcaacagtgcaactcgaacaagcgggaatcccattcaaaacatacgaatacgcacattcgaacgaccatatggatgacggttatggggttgaggccgccaccaaactgggcttcgatgaacatcaggtattcaaaacgcttatggccgacaccggctccgaacgtgtggtgggcgtggttccagtaagcgggcacatggatctgaaggcgctggccgcagcagtcggagccaagaaagccgctatggccgatccaaaagtcgccatgcgcgaatccgggtatgtggtgggaggcatctcaccactcggtcaacgtacgcatcacaaaaccgtgctcgacgaaagcgcgctgcaatatggcgaaatactactgtcgggaggcaaacgcggcttttcgatcggcatcaatcccaatgatctgctcaaggtgcttgacggcatagccgcacctatcggcacctggtaatcaccggtaatagaagccggtcagcaggctggtttcttacgaagctcactggggagcacgaaatgcatgttctccttaatggtttcgatggtggtcacatcatcgaaaccacgctgttccagcgcttcgataacgcctgacaccaattcgtcaggcacggatgctcccgacgaaatccccacggattcaacgccttcaaaccacgcaggatcaagctcggacgcatcatccacgcggtaggcctttccgtgaggaccattcggcacgccatcgaaacgcgtgttcagcccctcctgcgcaacctccatcagacgaacggaattcgacgaattcgccgaaccaacgatcaccacgcaatcagactgctcggcaaccaacttgaccgcggcctgccgattcgatgtggcatagcagatatcggaattcggaggcatctcaagccaggggaaacgctctttcaacgcagcgatcgtgcccgccgtctcatccacgctcaatgtggtctgcgaaagcagcaccaatttcgcatccgaagaaaactcgagcgaatcgacatccgattcatgttcgatgaggtgcacatgttccggggattcaccgaccacgccaacggcttcatcatggccgttgtgtccgatgtagatgatctcgtacccttctttgacgaaacgcaacacttcacggtgcactttgctcaccaaagggcatgtagcatcaacgatatgcatgccccgagctgaagcttcagccttcacctcaggagacacgccgtgcgcagaaaagacaatcggaattcccgcggaagccgcggcatcgggaacctcatccaattcctgtacgaacaccgcaccctgagccgacaattcctcaacgacatgcttgttgtgcacaatctgacggcgtacatacaccggcggcagaccatcattgcgagacgtattggcagctttgagaatcgtctgcacagtcagaatcgccctgtcaacgcccgcgcaaaagccacgtggatccgccagtacgatacgcttggtcatgatggccgcctttcgtcacttcgtgaaaacctcatcaatactaaagcatgggcggcacgccggagaaacggcatcgccatacggcataaaacaggtagactgtggtgttagcggtaacgctaccgttaccggaacatatccaacggcactatggagtgactatgacctgcatcaatctgcctgcccgcaccggacagcaattctccatctcccatggcgactatgaagccgtcatcaccgaactcggcgcaacaatgcgcaagctgacctataagggcgaagatctgacggtcgcccttggtccggacgatctggtgacctgctgccacggccagatcctcattccgttcccgaatcgcatcgagggtggcgagtacacgttcgaaggcaagacctattcgctgccgatcgatgagcatgaccgcaacaccgccatccacggctacggataccgctcgttctggaagctgatttcgcttgccgaagacgcagtgaccctcgcctggcgttcccccaacatggtcggctacccgtttgatctatatgtcaccgccacgtacagcctcgccgacgacggcatgcatctgaccgtcagcgcctacaataacggcgacacgaacgcgccgtgggctttggccattcacccgtggcttgccaacagcctcaacggctatggcgacgaaatcgacgagcacaacgccaagtgcagccttacgctaccggctcgcacgcatgtcaccgtagatgaaaacctcattccgaccggcaccgagccggttgacggcaccaaatacgacctgcgcgaagacaccctacttaccgagcagccgttcgacgatgcatggaccgatctggagcatgccgaagacggttccgtcacggcagtgttcacccgcgccgatggcaagaaggtccgtgttggcggcgatgaaaccatcacttcgttccaggtgtgcaccggtaccaagttccccgcattccagcatcctgccggcgttgccgtggagccacagaccgcctacgccaacgcgttcaacacaggcaacgagctgatcgtgatcaagccgggcgaaaccaccagcacctcgctgttcctcggtatggccgagtaaacatgcgagtgagcgtgatcgagtgatccagtcggttaaaccggctgattccggtcatataaaaacccgacggataagtctaagtggccacctatcgaacaccggatttggcaaacgtctcgctcgtgtgcgataatcccgaaggcttattaatcgtaagtaaaggagtccaatcatgggcatgcgcggacgtaagcgcaaggatcgtcgtaagaaggccgccaatcacggcaagcgtccaaacgcctgatccctgccagcgtgaataacgctacagagcatcgaaaaccccgctgaatcgttatgatcggcggggttttctcatactctcatcggcttgctcaccgctctccacaacaatggtcgagcgttgcctcaaggcggtcgataagactctgcggggcatgctgcggacgcaaatacgcacgcatggccgcgatcaatgcccgttcacgctcgtcgcagcaacgttcggggtcgaaacaatcaccggaggtgctaacgcgcacgctggtatgcgtcacctgtgtcacagtgccgtcctcgctggcggcgacagtggtgatatgccgttcgatcgattcactcatgctctgcccttccctgccgtggcatagccacgttccttcgcatagttggcaagttctcgtttcaactgcgtacgcgcgcgattgagacggctcatcaccgtaccgattttcacaccctgttcgtcagctacctgctggtatgatttgccgtcgatagcagcatcgatgaacacctgacggcgttccggcgaaagcttggcgagcgccgccatgatttcttcaggcgcgtaagcgtccaaatattcctgttccgccgatttaagctcttccggtgaatgctcggaagccgaatagatgtcccaatcgtcgtattcgccggtggaatcgttggctcgctgcggtctgcgcttggctttggcgtattggttgaagtaggcgttgcgctcgatggtcgtcatccatgcggcgaaattcgttccctcctgaaaggagtcgaacgccttgaacccccgttcgaaagtatcctgcaccaaatcttgggcgtcgtcgggatcgttggtcagcttcatcgcctgccggtacagcgcatcaaccacaggcatggcaagtttttcaaaacgcgcccttctgcttgccatggtttccgttcgtacttcagtcacagcttcattgtaatcacatcgacttccacatgccatgcacatagctgaaggtagaatggctgttcggtatccgaaaaacagggagaacacgaaatatggctttgactctggcatcagcagcacgtctgctcagtgagtatggattgctgcgcgaaatcatccaaggagacgactggacgcttgacgcgcaggccgtcaacggattcgacaagccattcggttcaatcacctacgacaccaggcaggtcgtatctaacacgctcctatgctgcaaaggccgtttcaaagcggaatatctcgatggcatcgatgatcgcggtcttgccgcatacgttgcggaaaacgatttctccgcggcgacgaaagctccgggactcatcgtgaatgacgcgcgcaaagctatgagtctgctgtccgcggcattctatgggtacccgcaggaccaactgaaagtcgtcggcattaccggaaccaagggaaaaaccactaccgcctacctcacgcaagccatgctcaacggctgctccggcggcaaatgcgcattgttctcctccgtcgacaattgccttgacggacatacctatgccgagtccgatttgaccaccccggagtccatggatgcgttccgtatgatgcgcgaagccgctgataacggcatggaatacctagttatggaggtttcgtcgcaggcgtacaaagtcgatcgtgttttcggacttactttcgacgtcgccgcattcctcaatatcagcccggaccatatcagccccatcgagcatccgacattcgaggattacttccactgcaaacgtcagatcgtaaagaattgtcgttccttggttctcggcacggcatgcgcacacgccgatcttattcgtcaggatgctgcaatcgccgatattcccatcaccgcgttcgctcttggcgaagcatcggccgcggatgtgaccgcatggccggaatccgccgaccatagccgattcgccattgcggtggaaggcgaacagatcggctcgctcagcttgcaattggatggcgatttcaattatgcgaatgccgccgcagccattgccattgcgcatgccgttggattcgatttccatgaaaccaccgcgaaggaaacgctgcacaatatggaaccggtacgtatcgccggtcgtatggagcatttccacgatacgaagtcgaataccatcgccatcgtcgattatgcgcacaattacgcttccgtaacggcgttgctcgactatgtcgaccaacgctacggcaaggacgatcctgaagtcacgctggtcactggatccgcgggcaataaagcgtacgatcgcagatcggaaatcgtcagggccgcgcagaatcgcatcaaccatctgattctcaccttcgaagacacggatgacgagcctgtggaacacatctgccaagacatgctcggcagtgtcaccaatcccgatctggatgcgaggatcattctcgaccgtacggaagcagtggaatcgaccgtagtaatcgatcgcaaggatcccgaccgcctccatatcatccttatcatcggcaaaggcaacgagcgctggttcaaagaccacggcaagcatattcccttcgaaggcgacgaccatattgtgaaacgtatttttggacttgcctgacctgcagcaacagccaaccatcatcgagtaatcaccaaccataaggaacaatccaacaatcatgatcactcttgaattcaccgacgcagccaccatggaacagcaggctgtgcaggcgggtcttaccctgcccatcgaacagaccgcggtatgggccaaataccagaacaccattgacggacgtacgccgtggggtgcgtatgtggtgaagcaggacggcgctccaatcgcattcatcgcacttatcgattacgaaacccatggctaccactatttgaggtccgttcatggtccggcttggcttgacaagccttccacgcagctggaagcacaggttcgtgacctgcttgttgaggacgtacgcaaacgcgataaaaacgttgtgttcctgcgtatcgacttgtggaatttcgagggctcgttcccggtgctttccaccgttccttacaacgagaccgtgtatgtggacatcaccggtggcgatgaggcgattcttacacgcatgaagaagcgtggccgccgcgacgtgcgtaaggcgttgagggagagccccgccgtttgcgccgatgagaccgcgcaggcgatggctgatttttccgaatactacgaggtcatggttgataccgccaaccgtgacggattctcccccgctccgatgagcgactatgtcgatatgatcagcaatcttggtcctgatcatgcgcgcgtattcgcggcacgtatcgacggcaaggttgtggcatggtccatcgtcaccatcaacggcgatcacgcggtctattactatgcgtgcatgcgtacggaaatcatgcgccagcatgttcccgacaagctgatttacgttatatgctgcacgcttggcgagcaaggttgcacagtgctcgatttgatgggtatcggcaacgatttcgcgccttcattgaagagtctgaacggattcaagacgaaattctccgaaagcatcgcacagatttccgcaggtcgtgacattccggtcaagaaggcattctaccgttcgctcacgctgctgcagtcgctgcgtcgcaaactgcgcaagtaataatcgcgcctcacgacggatagcgcgaaatatcgtacgaaggaggatgcagcgaatcgatatcgccgcatcctcctttgtattgcatcacagatcgttggatcgatggaccgtcgacaacaaccgacgatccatcatcgccatgcatatgcgattaccgcacatcttcagaagatgcagcatccgcatgctcaacttcggaagcatcagcatcttcatcttcagcaagatccggaccgacactgccgaaatcgttgatatcgaaatcaggattggcatcggattcgaaatcgagatccgcctcgtcctgatccttacgcggttccggctcaacagcctcctggaagacacgttccgacttcggcttcttcaaatcgggattgaccttctcttccagcatgagacgcgcatcgccagccgtagtgaagctaccgcaaatcagcacaccgtgaccatagccaacaccaagctcatcatcggcgtcaaccatattaacagcctcctgaatggcatccggcagttcaggaacacacgtaaccctttccgcaccaaacacgcgttcagcaaccgttttcaggtcttccgcgggcatcacacgatcacgccacgagttttcagtgacaaccacatggctcagcaatggttcgagcacgcccaaatactcttcgacctgcttgtctcccatcatggcgatcacgccgacgagttgctggaaatcgtaattttcctcaatcgcggcacgcaacgattctgccgcattcacattatgcccgccatccagaatgatcgttggcgatgtgcgaatctgctcgatgcggcctggaatcctcaccgtgctcaacgcctcagccacaagatcaccgtcaagcgcaccgttgacgggaatcaccacttccgccgcgcacagggccgcgagcgcattatgggcctgatgttcgccgaatttggcgatcggcacttccgcgtacgtgccattcggcgtacgcagggtcgcaacctgaccgccgactgccggaatgcgggtcacaacttccgcttcgatgccatccctcaccagattggcatggttctgcctcgccgcttcctcgataatcggcatgacggcctcttcatgcggttgacgcccaataaccgcggtgcagcccggcttgataatgccgactttttcggatgcgatctgttccacggtattgccaagccatgccatatgatccatgtcgatcggtccgataatggccgcatcggcatcgagcacgttggtggcatcccagcggccgcccataccgacctccacgatggccacatcgaccggagcgtcggcgaacttccagatggccatggcggtgagcacttcgaagaagctcatttttggcttgtcgagttcttccatcttcatgtcgaccatggctacaaggtctttgatttgatcccaggtatcaacgaaatcatcgtcggaaagctgctggccgtcgatggcgatgcgctcgttgacatgttcaagatgcggtgacgtgtataaaccggttcgcatgccgtaggcacggcagatcgcctcggccatgcgcgcggtagaccctttgccgttggttccggtgatgtgaatcacacggaacgactgctcgggatgtcccatgatgtcgaggatcatcttcatgcgttgcaggtcaagattggtggtattgcgctctgatgggcggctcatgatgtcgcgttcgacgtcgatcatgctttcattgttgcgattcggatgttcgaatgacatattctttcggattcctcccctaccttgggattgctcactcaatctcccttattctatgtgcttgcatgaacgttgcgcggcgcaaaaagttataggatggtttgcggtaattgcgtaagcatggacaaccatattcaggagatgtgatgaacgaagtcattaccgataaagacaaggagtatgaagccatggagcagtccagcgctcccggccctgatcaggcgatgagcgaccgtgtgaacaatcgttcgctgcgcccgcgttccgaggcgttcaaggagttcatgaccaccggttgggatgataatgagccggctattgaaccgttggaatcttcccattacattcaggctcgtcttgacacgctgggtaaggcttttcccggagagcgtattgtgatcccggccggtcagccgaaggtgcgcaacaacgactgcgattatgcgttccgtccggatacgacgttttcgtattacaccggtttgggtgaagactacgaagccggtgcagtgctggtgttgaatccggttgatcccgattctccggaggctgcggccggcaagacgcatgtgccggaattgtttgtggctccgcgtgcgaaccattacacgcaggactttttcatgaatgcccattatggcgaatattgggttggacctcgtgccggcttgcaggagatgactgcaatgaccggtattgagaccaatgacattgcgcagttggctgacgcactgagcaaggatgtcggttctgaagctggtgccgtgcgtgtgcgtgtgattcgcgaggctgatccgcagatcaccgaaatggtggaggatattcgcgaggcgaacggtttcgccgatccggatggcaatacgcatgccgatgacaagcttcatgagtttgccgccgaggctcgcatgtgcaaggacgaatatgagattcgtgaaatgcgcaaggccgttgccgcaaccaagcatggtttcgacaatattctgcgcaagctgccgtcgtcgctcgacaagcctcgttcggaacgtatgctggaaggcgcgttcaatgccatttcccgtgaggaaggcaatgaggtcggctacgatacgatcatcgcttccggcgctcatgcgccgattctgcattggatgcgtaacaccggtaccgtggagtccggcgatctgctgctgattgatgccggcgtggaagtcaatagcttgtatacggccgatatcacgcgcacgttcccgaccaacgggaagttcactgatttccagaaaaagctgtatcaggcggttttggactcccagcaggctggttttgaagctgccaagccgggtgccacgtattccgacattcatcatgcgtgcatgcgtgtgatcgccgagcgtctgcatgattggggcattcttccggtcgatgtcgaggagtcgctttctccggaaggacagcagcatcgccgttggctcgcctgtggtgtggcccatcatcttggtttggatgtgcatgattgcgctcaggcacgttatgagtcgtatcagggtgctgcgattcgtcctggcatgattttcacgattgagccgggtctgtatttccgtgaggatgatctgttgattccgccggagtatcgcggcatcggcattcgcgttgaggatgatgtactgatgactgaggatggtccggaatggatttccgccggcattccaaagcagatcgatgaggtcgaagagtggatggccagcatggctgccgaaggtgcaaaggcctgatatgccaacgcctgaattcattctcgagttacgcaagaaagtcggtcacgatctcctgtggctgatgggcgtctccggctatgttgaagacgagcggggtcgtgtgcttcttggcaggcgttccgataccggcgaatgggccatggtgtatggcattaatgagcccggcgaagagcctgccgacacggtggcacgtgaagtcaaagaagagactggcgtggatgtcatcgtcaccgatttggtgtcggtgaagtcctcccatagggtgcttacgtatgcgaatggcgacaacaccatgtatatggatcacctgttcgtgtgcaagcccgatccgaatggtaataccgaaccgttcgtaggtgacgaggaaagcctcaacgtgggttggttctcccctgatgacctgcctcagcccctggccgacaccacagtggaacgcatgggctacgtgcgtgagtacctcaagaacaaggcgaacggcgacgcacacgcgcaattctccttcaacggtacgattcgctgaatacagtcacaattgaatatataaactaagagctggcgtgacgatcatgaaccgtcacaccagctcttgtgtatgtcaggaagccacgaaactcacttcggcatcaaattcctttggcgagcaactcgtgcagctgggcgcgatgttctcgctgttcacgcggatcaggcaccggcagcgatgccaacaacttctgcgtgtagggattctgcgggttattcataacctgatcggcatcaccatgttccacaatctcgcccttatgcatcaccataatgcgatcggccagcatatcgaccacggcaagatcatgggtgatgaacaggcatgcgaaacctatttccgcctgcagtttcttgaacagctccaacaccttcgcctgtaccgacacatccaatgcagaagtcggctcgtcggcgatcagcaggctcggcttaagcgccagcgctcgtgccaaggaggcacgctgacgctgaccgccggaaagctcatgcgggaaccggttcatatatgcacgcggcaactgcaccatttcgagcagatctcccacatagtcgctcgcttccgacacagacgagtactttttatgcacgatcagcggttctgccacattctccgcgatggtcatcagcggattgaatgaactacccggatcttggaacacaaaaccaatatcagcacgcttgggtttgaattgacgttccttgacaccgttcatttccacacccaacacgttcagggagccgccggacactttctgcaaacccgcgatggcacgaccggtagtggatttgccggaaccggattcgccgaccaatcccagcacttcggaacggtgaatagtgaaatcaataccattgaccgccttgaaatcaggctgcgtcaaatgcccaggataggtgatagtcagtcccttggcctcgacggcaatgggttggtcatgccaatccttgctgcgttcaatcaccttgccctgctcatcacgaacgaccagtttctgcccgatacgcggcacggccgcgagcaaccgcttggtgtaatcgtctttcggcgagtagaagatctgttcgacgcttccctgctcgaccacatgacctcgatacatgaccaccacttcatcggcgatatcggcgatcacacccatattatgggtgataatcagcacggaggcgccgaattcgtcgcgggcaagacgcaacaagtcaagaatttctgcctgcacggtcacgtcgagcgcggtagtcggttcgtcagccagaatcagacctggattgagcaccaacgccatggcgatgacgatacgttgtttttggccgcccgagaactgatgcggatagtagtcaattcgagtttcggcatcaggaatgcctacttttttgaggatatccacggacttggcacgaagctccttcttgtctttcatgccgtgcgcgcgaagtccctcttcgatttgccatccgatggtgtacaccggattaagtaccgaattaggttcctggaacaccatggccgcttctgatccgcgcatacggcgcagatcttctccggaaagagacagtacgtcaagctgctcattgccttcacggttcgacagataaatcgcgccggaagtggttgccgtctccggcaacagcttgataatcgaacgtgcggtcacggattttccggaacctgattcgccaaccacacccaccacggttttgcgtgggatggtgaagctaatcttgtcgatggctttgatggatcctgcgtcggtcatgaaggaaacgctcagatccttgacttgcgcaagattggtttgttcgtcactcattgcgtcactcttcttccttggagccccattcggaggcggtaaatgacgggtcgcgatccgtaacggtcactggctgatcgctggctcccattggattcttggcggccgcgagctcggctatcacctcgttgcgaacgcccggcttctggctgggatcaaccgaagtatcttcgatggatccaaccacctcaccagcggatttgcgcgcacgcagacgcgggtcggcaaggtcattgagggattcgcccaccaaggtgatacccagaacaatcaatacgatggcgatacctgggaacactgcggtccaccaaatgcccgcggttacatccgacacggaacgattcagatcgtaaccccattcagcggctgcggtaggttcgatgccgaatccgaggaagcccaatcccgcaagagtcagaatcgcttcggacgagttcaacgtcagaataaccggtaacgttctggtggagttcttaagaaggtgcttggtcatgatgcgccatgtcgacgcgcccaccacgcgagcggaatcaacgtaagcggattccttgattcgaatgacctcggatcgaatggtacggaaatactgcggaatatagaccacggtgatggagatacccgaagcgagaatgccactccacagaccagactgaccgccggaaatcataatggccatcagaatcgcaagcagcagcgaggggaaagagtagatggcgtcggcgatcatgacaagcacacgatccacccaaccaccgaaatatccggaaaccaaaccgagcaatacacccgcgaaaatagaaagcagcacagcgatcacaatcgcaatgaccgcggtacgagagccccaaatcacacggctgaacacgtcataaccacctgcggtggtaccccaaatatgctcggatgagggtgctgcctgggctgggaatgaaactccattggcatctttgagctgcgcatagccgtacggtgcaattacgggcgcgaacaaggccacgagcaggaagaacgccgtgagcaacaggccggtaatcagcatgcctttctgccagccgaccgctacgcgaagatccttgatgatcggaatcttggcccagaacggagctttcctgttgactttgagatcgttcagacgagtgtcacccgggacggtgacgttatttgctgatgcagtcatgtcagtacctcactctcggatccaccaacgcggcgataacgtcaacgatgaagttgacgacggccacgatgatggcgatcagaatcacaatgccctgcacagctacgaagtcacgcgctttcagatattgggacaacatgaatccgagtcccttccattcgaaggtggtttcggtaagcaccgcgccggcgagcatcaatgcgatctgcatgcccataacggtgatgattggaataagcgccggcctccatgcgtgcttgctgagcagacgtttttcggcgacgccacgcgaacgcgcagcctcgacatagccggaattgtaggtggaaatcacattggtgcgcaccaaacgaataaacacgcctgcggtgagcaatcccaacgccagcgcaggaagtacggcgtgacgcaacacgtcggccagcacgctcatatcacccagctgcagtgcatcgataatgtagaagcctgtcggagagacgagccgggtgaactgcatttccgaagacaacgagcatcgaccggatgccggcaacacgttcagccagatggcgaaaatgagtttcaggaccaatcccaagaagaacacgggggtggcgtagcacagaatggcaaaggttcgaatgcctgcatcggcagcgtgatcgcgtctgcacgcagctacacgacctaagccgatacctacgatcaaagcaacaatgagcgataggagtgccaactcgaaagtcgctgatccgtaatgaacaagaatgctgataaccggctgattatcagtcaacgtagtgccgagatccccatggagcaaacccccaaggtaatcgatatattgcacaataagaggacggtcgtagccggccgcatgaacacgcttttgcaactcgtcaggggtaagacgaccacccaatgccgcagaaataggatcgcctgtagctcgcatcacgaaaaacacgacggtgacgagaatgaaaacggttggaataatgagcaggaatcgagtcaggacgaaacggaaaaatccgcctgacaaatgattctttttggcttgtttcggcttcgcctcctgagagacggccggagctgctgtgtctgacacgcgatgctccttgataagaagcctgtacggctttgatttacaacaatatcgaatcactgcgccgtttcaggcagataattcgggaaatggggacctccggccatagaccggggatccccagtggttttctatgcaggctgcggcaggtcatgccgcacatccgcacacatcacgccttggtgacagatgcgaaacggaaacggaaggaagcgtcgagcacaacacccttcacgttggcgccggtaactgcaacctgcgcaccctgcagcagcgggatggtggacaggtcttcggtttcaagggtctgaatcttcttgagcagatcctcacgggcgctttcgtcggtttcaccagcctgctccataatcaaatcgttgatttcggagttggagtaagcgttgttcacgaagttgccgtcacggaagaacggagacagatagttatccgggtcggagtaatccgggaaccagccgagctggtagaccgggtaggatccatcagagtcctcggtaacaacacggtctttgttgtactgggtccattcggtggactgcaggtcgaccttgaacagaccaccctcctcgagctgagccttgagagccgcatactcgtcggcggaagaggatccatagtggtccggattgtactgcagcttgagctcaaccggagtggaaacgcctgcgtcctcaagaaccttcttggccttgtcggcgctcggcttgccgttgccgtcaccatacgcggtcttgaaggtgtcttcgtgaccaactaaaccgtccggaatgtaggagtacatcggggtgtacgtgtccttatagaccttggtcgccaactcctcgcggtcgatgaggttagcaacggcctgacgcacagccttggccttgtcggcattcggttcatcggacttggtgccgtacggctggatgttgaagttgaagaccaggaagcgttcctcaccgcccggacccttgacgaccttgaccttggaatccttggacagatcatcgatgtcggtcggagtcagagaacggtaggccacgtcgacctgtccctgctgcacggccatcttcaggttggaagaatcggcaaagtacttgacctgaacagtgctgttcttggccggggtcagaccctgataagagtcgttcttggagtagcctgcaacctcattggccttgtaggaggtcagaatgtacggaccggcgaaagccttctccttgatgatggtgtcagcatcagtgagcttgtcggcggagaagacctcttcgtcgacaatcggaccagccgggctggaaagcacctgcttgagggtcacatcgttcttgactttggaatggaacaccacagtggtgtcatctggcgtatcgatggattcgatgttggccagcaacgaactcggaccattctcatcgttgatcgtgttgacacggtcgaaggagaacttgacatcggacgaagtcaggtcgtgaccattggcgaacttcaggccagacttgatcttaacggtgaactcagtgccgtcgtcactccaggtaccgtcatccgcagcgatgtccggagacagttcagaggtgttgtagtcctgcgcatacaggaacgggaacacgttgatttgaacggcataggaaccgttgtcataggagccggcagggtcaacgctagtaaccttgtccgtggtgccgacggtaatgacatccgcatcccccgatgcggaaccgctatcctttacgccgccgcatgccgcgagcgaggccagtgcggcaatcgaaacagccgcagccataatcttcttgtgattcactatggaatcctttctcttcctgctgtcgtaattggtactccaaaacgacgtgccataagggtagggcacactttgttagcgaaacatttcacggaagctcattttgcgacatcaccctttctcgatccaacgaaaactcagcaatcacaacggttttgcagttaatttttttccgaaaagagtgtgtcaaataatgagacagcgaatcccatattgagaatcgacggtcctcgtgacacgccgaaagacggaacttgcatcaactaattaacggcgttaatatatcaactagttcaacgaagggtccgtgcactggcgcaaggaggtgtcatgagtagttacagcgctcagcaatcatcgatttcagaaaacaatcgttccagaattctgcaatacctctaccacaacggcatcagctcacgtgcgcaaatcgccaaagccatcgaactcacacccgcggccattacgaaaattaccgcaaaactactgttccgagacgttatcgaagaaaccggagacatggaaggcgataagaatcgtcgttccatcggcctgaatctcaattgcgcgaaataccatgtcgtcggcgtgaaattcgcacgaagtctggtgcagatcgcagtgttcgacctgaaatgcaatcgtatttccctcaccgacctgcccaccgttgacgaggagcatattcccgaaacggtagaacagatccgggccaccgtacgacagctcattgcggacgattcgagcatcgtagccgtcggcatggccgttcccggtccgtatctggtggaggaaggtcgcaccgcgctcgtctcatccatgcagggttggcggcaggtcaacttcatcaaggagttcagcgaagcgttcaacgtacccgtattcgttgaacaggacgcacgcgcaggcgccttggcgcagttcctgttcaacccggaactgtccgagggatcgctcgcctactatctgcttggcgagggcatcggcctcggcatcatcgacaatggttcgatctattacggcgcgcacggcacggccaccgaaatcggacacatctccgttgacgtcaacggcaagccttgcgactgcggcaatatcgggtgcctggaacgttactgctcagccaacgcaatccacgaacggctcaacgaacagccgagcattgtgcccggatgcgaggcaatgacgcacgcgcaggcatgcaccgcgctgttcgccaaagctgcggcaggagacaaagcggccatggatctgacttccgaggtcgctcgatatatcggatatggcgcggtcaatatcatcaacgccttcaatccgacgcatatcgtactcggcgacatcatctcccaagccggacagcccttgcttgacgaggtcaaaaaagtcgttcgggaacgtaccatccccgaagtcgggcacgataccaaaatcaccttgtccaacctcccaacggacgccaccgtcagcggtgccgcggccgtggccatcaccaattttctggaacatccttcgatgttctttgacgtcgcatagcacgccacaaccaaagaaaggaacaccatgtccaagccaatcgtcatttctctcggcgaaatcctgtgggatatgctccccaccggcaagcgtgccggcggcgcacccgtcaatttcgcataccatgcgtcccagaacggcgcggaaagcttcgccatcagcgccgtcggcaacgacgagctgggtaccgaactgctctccgacgctcacaaggccggcatcaacacgctggtgcagaccaacgaatacccgaccggcacggttgacgtggccctgaccaacggcattccggaatacaccatcgtcgaaaacgtggcttgggaccacatcaagctcaccgacgagctcgtcgaagccgtgtccaaggccgacgccgtctgcttcggcaccttgggtctgcgctcccccgaatcccacgacaccatcgtcgaactgctcaagcacaccaaggaaggcgctctgaagttcttcgacatcaacctgcgtgcgaacttctactccaacgaactcatcgaagaactgctcggctatgcgaacatcttcaagatcaacgacgaagagctgatcatgatgcgcgacatgttctccattcctgagtgcaacgacgaagaggcatgcaagtggttcatcgaccgcttcgaccttgagtacaccattctgaccggcggcgccacgttcagcaccatcaccgccaagaatggcgaggtttccacgctgctgacccctcacgtcgaggttgccgataccgttggtgcaggcgactccttctccggttccttcaccggcaagctgctgagcggcgcaccgctcagggaagcgcatcgtgcggctgtgaacaccgccgcctacgtgtgcaccaaggaaggcggctggccaacctaccctgtggaaggcgttccggattatctcgccgaagccggcaagtaagcccagattttcctttcatcatcatcaacgaggccatgtctgccatcatggcctcgtttttcatacccatattcaatccgcaattggtgcaatcacgattgtcacgatatacgcacctcaacgaagaatgatgccatgaacgacaccagcaacaccacaaacgccgcttcacaatccgatattccgcagtcagtttccgatttcatgcggcatatcaccgacttgtgtggcggcgaacacgcaagatgggccgaaaacttcaacgcaggattcgccaatacactcaccaccaccgtgagacggcatgatgacggcacgacgtttctgctaacgggagacatacctgccatgtggctgcgcgactcctcagcgcaattccgaccatatctcgccgtagccgtagatgatcccgagctcaccgcgcttattaccgggcttgttcggcagcaattcaggttcatcaatatcgatccatacgcaaacgcgttcaacgaaacacccagcggcgctacctgggatccgaacgatcagaccgattcgttcggaccatggttgtgggaacgcaaatacgaggtggactccctgtgctaccccattcagctggcgtggctgttgtatcgcaatacaggaaccaccagccatttcgatgatgcgtttgtaagcggcatccgtcgaatccttgacgtgttcgaaaccgagcttgaccattcgaattcgcattaccgcttcttccgtccgaacgacgatccgcgcgacagcgtgcccaaccatggtaccggaggaccttttgccgtcaccggcatgacatggtccggattccgccccagcgacgacgcctgcgtctacccatatctcgtgccgtccaacatgttcgccagcgtggtcatgggatatgtgcaaaggattttcatcgacgtgcttgacgatcgtgaaatcgccggtcgtgccgcggcgctgcagcattccatcgatgatggtcttgcccatcacgcaaccatccgcaatgcggccggaaacgctatctacgcatacgaagtggacggtctcggcaacgcgttgcttatggatgacagcaatgtgccgaatcttatgtcggcaccttatctcggattctgcgaagcggacgatccgctgtatctcgaaacgcgcaatactttgctgagtcaggagaatccttactatttcgagggtgactatgcacatgccatcggttctccgcatacgccagaaggttatgtttggccgatcgccatggccatgcaaggattgacaagccacgacaaagccgaaaaagaacgtattcttgatcaacttgtcgccgccgacgccggcacgcatctcatgcatgaaagctttgacgcgaacgacccgaactcctatacccgtccgtggttcagctgggccaatatgatgttctgtgaattggtcatggattatttcggtattcacgtcaagctgtgagtggctatcagtttaagctttggcttcgctcacagcgcaagaattacggtagatgatttgcacttattgacattccatgatatcttgaaaagtccggtcttgcaccgggtgcttgataattcaagattggggatgatcggtttcgacggtgacctgttcgtcgcagggaagcgtgccgagaacgtagggtccgctcgtggatgccccctacaaaagaataagtgctaaatctaaccgcactgagttcgctctcgctgcctgagcttcgcgccaggattaaccagtgagcagctgctccgttcactccttctcgtctttggaaggatgctgagcgtcgtttagaagacttgctttgtcgactgagccacagggccggcaagggacttttactgtagatatgcccgccatcagttgtctgcgatatcgatgggagcagaaaaaccgccgcacggccagcagactacgcacgtagaagactgagggttcggttatcggaccggggttcaattccccgcatctccacgagttgaaagccgccagaaatggcggcttttcttgtatttccaacggttttcgaagattcctgggtttactccaaattacccccgatgtgccggatgttctaaaaaatgtgggcaaaaatccctcctccggcttgcttaatctcttccaaattccatctgtctaccaccctaaacagcatgcaaggtacgtttttaggtactcctcttcacaagacaacctcgtcaaatcaacatacgaaaaatccagctctcccccatcacaaatcatcagaatcccaccatcaaattccgcgtgtcgatttgcattaaccgcttaagtggttaacatagttaatacatcaacctagttatcacgtcacagcagacgacgtcaaggaaggacttgatcgatgacctgcacttactctcccgaagcctacgtgttcggctccgaagaaaaccacgccctgctcgaggcggaaaccaacgagctcctgcatttcggacacaatttccccgccccgcagggtggctcctactggctggacgataccggcaatccggatctgacccaaaacatccacacgtggatcacctgccgcatggcgcacgtgtattccttggggttcctgcacggcgagccgggcgccgcagaactggttgacaaggccatcgccggcctgcgcggtccgctgcatgacgatgaaaacggcggatggtatccgtccatttccgcagacggctccacccatgaagcaggcaaggtctgctacgcccacgctttcgtgattcttgccgccacttccgccaagcttatcggccgcccggacgcggacgagctgctcgaagaggctctggcaacctacgacaagcatttctgggatgacgagatcggtctggccgtcgatacttggaacacggaattcaccgagcttgactcctatcgcggcatcaatgccaatatgcacaccaccgaagcattccttgccgttgccgatgtggccggaaacgaggaataccgcgagcgcgctggtcgtatcatcgatcatgtggtcggatgggcagccaacaataactggcgtattcctgagcatttcaccgccgattggcagccggatctcgaatgcaaccatgacaagccggatgaccagttcaagccgtacggcgccactccgggccatggcatcgagtgggcacgtctcatcacccagtatgcgttgagctccaagcagcgttccgaagaaggcaagcagcagcttatcgaagccgccgagaacctgttcgctcaggcacttgccgacgcctggaacgccgaaggcaccatcggtttggcttacaccaccgattggaacggcaagcccgttgtcaccgaccgcatgcactggacgcttgccgaatccgtgaacacctcggccacactggccaccgtcaccggcaagcaggtgtacaaggattggtatgcgaccttctggaagtacattgacgaatacctgatcgaccataagaacggttcttggttccaccagctgaacaaagacaacgaggtcatcggtaccgtctggccgggcaagtccgacctgtaccatgccacgcagtgcacgctgattccgcgtctcgatcccgcggtctccgtcgctcctgcgttgaaggccaatccgaacgcctgacggcctccaataatcgaacttctccttctctcctcctattcgcgaagaacccaggtaccgcaaggcaaccggggttcttcgtatatcaacgcgactatttgatgattggacgcaacggcgcagacacgtcgacgttatgcttgtctccgatcacattcggatcattgatgattttatcgacgacagctttcttcaacttgagaccggatgaatcgccccatacgatcacacggtctcccccattgatttccgtggtgatggaatcctgggtttcggcagtcaccttggtgatggagttgcgcatcgattccggcaatgagctgaggatcttcaacgcctccttgatggaacgattgctcagacttgtttcgacatccttcacttcaatgacgggaattccttccacggaagctccgctgacggaattcaatatacgccccttgctgtcgaccgcggtcatgctgtcctcgcctgtcttgagcatcgcagcaggcttttgcgccttgatggtcacttcaagggagtcgggcagttttttcttggattgcgcggaagtgactccaggaatctccttgattttcttttccacgtcattgttcgacacgagaagaatcgattttcctgcttgctggcccgcaatatccaacacctgagactcactcacccattcgttggcgccgacaacgctaatattgccggactcgagacggaataccgatgagaagaaaaacagccataccaacgcgcctgcaacaacaatgacagcagcggaaacgcacgcgcgcatggcgacgacacgcgcgttcgccttgcgtcgttctttcagacgcgcactgaaatcaaccaccttcgggcgcgttaccacgcccaacgtgcctatggtttcctccaatgtcttcgaaacgaaatcctcgccggcaagattgcgcgcgtccacgaaatcgcctgatctcgaacgactcacgctgcctttgttgccactctcaaccgtattttcctgcgtcttcttcccggaagaagacgcgcgtcccgctccaccagcgacggaacggcctttcggctgaacctgctttccggcatcgctgtgtttccggctttggatggttctaccatgcgacgtctgattttcaggcgtcgttgcggaaccatccgaacccgtacctgaactgatgacccttcgcgtcatcagccctcacaatcccaacgatgagcctgaagggagtgcagcatcacctcgtccatctgtgtgatgtcgcctgcgccaacagtgaagatgacatcgccatgatgagcacgcatcgtcatcatctgtgccgcggtatgcatatcctccactccgcgaatccaatcctcggcaggcgtgtggtcaagcttaagcgcctcgtccacaatggtggcggagctaatcgtcggatagtcctcctgcttttcacgtgcggggaaaatgccggtgacgatcacatcatccgccttggccaatgcttcagcgaattcactcgcaaagaacatggtccgggagaacaggtgcggctggaagatcacgcgaatcaccgactgcgggtacctgcggcgcgccgcatccagcaatgccgaaatctccgtaggatgatgcgcgtaatcatcaacgacagtcacttggccgaccataccacgcacttggaaacgacgggcagctccaaggaacgacgtggcggcttgggcagcgttctcgacatcgacgcccaacaacgcggccgcaataatcgcagcggaggcattgcgcgcgttgtgaatgcctggaacggtaagcgtcaccggaaccatacgctcatgttcgcccaacaatcccgcgggcatgtgtaaggtgaaatgttcggcaccgctttgcgcgctttcgctttccgattcgatatgcacgaacgcggcaccgttcaaatcacccaacgaaaccgtatcctgcgtcgcatacacgaccgtacgcttggccgtctgcggatcgagagcacgcaataccgcaagattgccttcatcatcgccgcacatcaccaccgatttttcggcatgctgaacatgattgacaaaagccgcacgatagttttcctgcgtgccgtaatggtcgagatgatcggcttcggagttggtgacaatggcgatttccggatgatacttggcaaagctgccatcggattcgtccgcttccgccacaagaacgtcgcccttaccagcatggcctccgtcaatcgtcacaccatccttgccttggatggatccgccgatggcatagcttggatcggccagatttccctcaccggcatgggtgaggatatgggccagcatggaactggtcgtggttttgccatgagctcctgcgaccgtcaccgcacgttttgcgttcatcagcaatgcgagaatgtcgctgcggtgcacgatgcgttcgcctgcttcgtatgctgcgacgatttccggattgtcggatttgatggcgctggagaatacgacggtatgtttgccttcgacgttttctgcgcgctgcccgaattcgacggtaatgccgattccctgcagacgatcggttttggcgctgggttcacgatctgaaccgtccacttcaacgccctgttcgtgcagcatttcagcgagcacgctcatgcccgcgcctccaatgccgatgaaatgggttgcccccaaatcattcacgccttcctgcggactgaacgacgcatgggttggatcaagaacgatggtaccggcttcacgctggttgtcagacacgactgctcctcttgcatgttttttctagcttgttccattatggtctcacccatggtctcgcatatggccgatcatgggtgggattttggaatgcgacgaacgcacctgccgtcgccgcagcctacttttcgtcaatcatggaaagcacgcgcttggccatgacttcggcggcatctcgaataccgtattgccaggcgttgtcgccatacttggcaagcagatccgaatcggcaagcagcttcggcacatgctgtttgacccattcggcggtgaattcgcgatcagccaccatcagaccgccttccgcatcgacgacaggctgggcgttgaatcgctgctcgccgttgccgattggcagcggaacataaatcgcggggagtcccaaagccgtcaattccgatacggtgccggccccagagcgacagataatcaggtcggcgcaagcgaatgcgagatcaatacgttccaaatacggcgcaacacgataatcgccatcattgccatggtccgggccaagctcgccaagcacctgttcgccggcgctcaccgacaccaatgaacgcacttcatcatctttgcctttcccagtcagatgaatcacctgggcgtgttccagcagctccctagcggaagccgccaccgcacggttcacgttcaccgcgcccagcgaccctccagtcaccaccaccagtggacggttcggatcgacaccgagttgcgctgcggccgattgtcttgtggcaatgcggtcatgttccatgccatgggctatcgctgcgatttcggcacgcaatggcaatcccacacgctcggcttcaacacccttgcgtggcttcaagccggtttgcgcataggcggtgccaatcatggacgcccagcgagctcccaatttgttggccattccggcacgggcattctgctcatgcatcgcgatcggaatgcccatcttgtgcgctgccgcatatacgggagcggacgtgtatccgccgaagccgacaaccacctgcgcctcatgacgggtgagaatgtcacggactttggccgtttcggccttccactgcgcgggaaacttcagcgccgccatattgggcctgcgtgggaaaggaaccttctcaatggtttccagttcgaaaccggcctggggaaccaaatcgtgttccaagccgacgacagtgcccaccactgcgatatcggcgtctggttcaagctcgcgaatcacatgcgccacggcgagcagaggattgacatgacctgccgtaccaccgccggcaagaacgatatgcttctgattgctcatagtgtacgagcttagcccacggcaccccagtacgccgcgcgccataccgtcgcacacgcggatgctcacatttcatctacgtttgcacaccgcaatacgcggtagcgtatactgcggtcgcagccgacactcagacccgctgcatctccgcttggatctgcggctgctgcttcatcatgctgatggttacgcctgcagcgcccaaacacagaatcaacgacgaaccgcccgcggacacaaacggcaatggcacacccatcaccggaaacaatcccaccacaacgccgatgttcacgaatgcctggccgacgatccacacggtaatgctggccaataccaaagtgatgtacctgtcctgcgattgcaaagccaccacgagcatgcaccatccaagcaccaagaacagcagaatgacgagagaggcgcctacaaagcccgtttcctcaccgatgatggcgaaaatgaaatcgttgtgcgcttccggcagatatccccatttttctccggaattgccgacgcccactccaagcaaacctccggaggccatggcgtatttgccatgcaccgcctgatagcagaccccctgcatgtcggatgcggagcaagtttggtatgtggccatgatacggctgagtcggttcggactggtgataacgagtccgccaaccaaaaccgcaccgccgcatgccacgatagccaaccatttgccaggaaaatctcccaacagcaacgcggcacctgcgatcgcgaacagaatcatggccgtgccaagatccttgccactcacaaccaacagcaatgcaagaccaagccacgcaatcaacttgagatatgccttatatggtccgactttgtttatctgcttctgcgcgtagatcagttcccgcggcagccatatgcacaacgcaagcttaacgacttcggcgggctggaaggtaaatccaaaaaggccgatccaacctttgttgccttggacatcgatgcccaagggggtaaacgtcagcgactgcaaaagcaaagcgataatcaggaagacgaaactgaatttcctgatgagctccgccggaatcatcatgcaggcaacacccacgataagtccaagaacgcagaatcccccctgtttcagtgcttgggaccacggagactgtccgttggcaatcatgtttaccgaagagctggaaaacaccatgatcacaccgaaaatggtgagaatgatcaccgcggttctgaacccatgaaaacaccaaatcggattaagcaggcttcgcagaccgacataaccatgaaaatcgtcgacctgctttccgacggcggccttctttttctgacgactactatcaacctgcctggttttaggcttttccatgctcgttcacccaacgctgagcctgctgtgcgaactggtttccacgatcggcatacgacttgaactgatccatcgacgcacatgcaggcgccatcagcaccacatcaccggattggacatactcgcccgcggcatcaaccgcccgttccataatgaccccattatccgccggatcgatgatggtcagaggaatgttgggagcgcccgtcttgaacgcatccagcatcggctgctgatccctgccgatgatgaccgcggctttgatggtatgcgcctgatcagccaccaattgctcgaaactgctgcctttggccagtcctccggcaatccacaccacggatttatcggcaaaactattgagcgaggccttggccgcatgcgcgttggtcgccttggagtcgtcaacgaaacgaatggctcccccatccgccgtagtggcggtggcgacggtctggatacggtggccacctggagtgaactgcttcagggatgcgatcgccttctccttatccgcgccaagtcccaacaccaacgccaatgcggtcaatgcgtcggcgagcaaatgcggatataccgtgccatccggctcggtcagatgtgtgaactcggcaactttggcaacctgttcaggcttgcccgcctcaccgcccgcgatgccggacatgtcgacgatccagccgtccttcacgccaatctggccatcttgcggttccgacaatgtgaatccaaccctacggcagccttccgcggtttcggctgcgaatgccagcttggtcacgcgctcatcatccgcgttgtacaccaacgccttcttggcatggtggaagaccttcgctttatcggacgcgtaattgtcgataccgccatgccaatcaagatggtcgtcagcgatattggtgatcgccgcgcaatccaactcaagagaatcggtgaaatgcaattggaaagaactgagctcaacacacagcacatcatttgccggatcgactgcggcatgggacaccgctttgccgatattgccgacagcaggtgcggtcaaaccgcaagccgtcaacatctccgaagtcatttccgtagtggaggtcttgccattggtaccggtgatgccaatccattgcgcaggatgcccagtggcatcgcaatccacccgcagctgccaggcaagctcgacctcgctcatcaccggaatgccacgacgttgcgcttcgagaatgaacggggtcctcggattgaataccggagaagtcatcaccaagtcgacatgatcccaatcaatgtggtcgaaagagtgcagatcggcatcaggcttcttctcatccacgcccaacaccttttcggcgcgggaacccaacacctccatcatgctctggccagaaactccaagacccgccacaatcgcggtcttaccgctcatatccatatccatcatccttcgatcgtcagaacctcatacgccttaatatcacagtcatattgcgttcattcgcaacggcaacagaccgagcatcgactgtcacaagccggaacgggcaacccaatcgccatagaaaagcaccaaggcgaccagcacgaacagcagttcaatcatccagaagcgaatcacaaccttgacttcgggccatcccttcaattcgaaatgatggtggatcggagccatcttgaacacacgcttatgcgtcatcttgaaatagccgacctgaatgacatcgctcaacgtttccatgacgaacaggccgccgagaataatcgcgaggaattccgtatgcgtggcgatggacatggcagcgaacaggccgccaagcgccaacgaaccggtatctcccatgaaaattgaagccggattggagttgtaccacaggaacccgaagcatgctaccgccgcgcaagccgcgataatggtcagatcaagtggatcagataccgcgtaggtaaagccctcatgccccgatcccttaaggtggtagaactcccaaaaagcgatcaccgcatatcccatgaacgcaatcatcgaagagccagctgccaaaccgtcaagaccatcagtcagattgatggcattggtccacgcggtcatcaggaagttcacccaaatcacgaacagcacgatagccacgaccttacccgcgaattcgaaactgaagaacggctcctcaatgaagctcatgccggcctgggcactggggaaaccggaattcgtaggcagaatcaacgccagcaccgcatatatggtagccagaatgaactgaccgatgaacttgcccttaaccgtcaatccctcgctctgcttcttacgaaccttcgcgaaatcatcaataaaaccaagcaatcccatcgacaacatggcaaacagcaccagcaccgcagaccacgacggagtctcaccccgcgtgacgaagcggtacagcgccgacgagccccagcccaacacaaccgccaaattgatgaccacgccacccaacgtaggcgtgccacgcttgactagatgggatttcggaccatcctgacgtatgtattgcccataattcagcttgtgcaccaaacgaatcagcagcggggtgcccacgatcgtcacaaccagcgacaccacaattccgatgatgagcgaaatcacctgatgttctccgtttcagtcagacattcttcagataacgtcgtttattcgattattcgaatcttgccaaatattcttgttctattgtgcagccagggcctgccaacgttcggccaaagcgctcaagccggaagcgtgggagcccttaagcagcaccacagcgcccggatgttccacggcgagttgcgtcaccagacgatcggcctcgtcaatgtcgtgcacccaatcaatatgggaagcacatcccgcagcggatgcaccttcagccatggcaccggccagagcgtccaaagaggcatcggatgtgctgccgaccgtcagcaacgcgtcaacgtcgccttccaccgcataccggccgatgccagcatgcaaatccttttcatccggaccaagctcaagcatggcacccaacaccgcaatacggaacggttgggtctcagcacccgccttccaacgcaacaatccgtcaagccccgccttcatggaatcgggattggcattaaacgaatcgtcgatcaaggtgaacgatgtttcaggcttgtgcaccgtggaaacagccatacgatgaggactgatggccgtgacgtcagacaacgcggacgcgacctcatccatcgacatacccaaatgcatcgctaccgaagcagccgccaacgcattcataacgttatgctgaccgcaaatgcccagagtgacctcggcatgctcgccatcaccattgtccaaaatgaagctcggatggtccaattcgtcgcaatgcacatgttgcgcgctgattgccggcttgccgtcattgttctgcggaagtccgaaccacatcacgtcgcccggagcgatggcgctcatcgcagccacatgctcgtcattcgcgttcagtacggaaagaccacctggaacaagaccacggatgatttccgatttagcttgtgcgatgcgttccggcgagccgaattcccctagatgcgcgacgccgactttcaacacgaccgcaatatccggcggcaccagcgacgtcaaattcgcgatttccccaacatgattggcacccatttccgcaaccagaaagcgagtttccgcatgtactttgagcgaagtcaacggcagtccgatttcattgttgaacgatccgaccggcgcaatcgtcggtcctatgtgcgccagcaacgccttcatgagatccttggtagtggtttttccgacggaaccggtgatgccaatcaccgtaaacggcgtttccaacgcacgccggcgttcgatattgtgcttggccaacgcgcccaaggcaagcaccgtatcttccaccacgatctgaggcactccggcaccgtcgatctcatggtcgactattgcggcaacagcgccctgagcgcctaccttcgacacataatcgtggccatccacgcgttctccggcaatcgccacgaataccgatccttcaacaatctgtcgtgaatcagtgaatgtgctggtggccacaggcgtatcaatcgccgcggtgccggcaatcagccgtccctgaaccgcctgggcgatttcctccaagctcattggcatcatggtcgggctgctcactctgatttctcctctgtgttgatgtactgcatattgttcacgttgtttacgattatcactattcgacgtccgcatccgttccgatcgagactagttcagatctcgagatacacgcaatgcgcttttaatattggctttacgtacgccggccgcaagcaccatggcgatggacaatgacaacgcgctgctgtccgtctgcccgtatgcctccgtcgcttgcgctgcgagcgcatcggattcctgcgtacgacctgcgatgtgggtctgcttgccgacagtgcatccaaaccgtgcgaccgacttgacgatctcagcctcgctgagacccttgtcgtcgcagccaagcacatcaacattcaccgactgcaacgcatcgtcattcaacgtttcctcgctgagcgcaaggatcacagcggcggcgccgtcttcggcgcacacagccatcgtacgctgcacgtcaagaatcgacaatggatagttcagatcaaggaatcgttccaacgattgcgaattgccggcactaatcacgccgaccggattgccgagcatgtgcaggaaatccgcgagatccctcacaccctgttccaccgtttgcgtattgctgccagccacggcgaacaccgccagcgaatcggatgggctgcccgccatctcgctggcaagcttgcccaactgttgcgcagtcggttcggcataaatcaaaggaatctgaacgccatccgtttttcctcgcaacgcatgcggcaccaccgcaccatacgcaccaagcgcttgcacctgccgtaactgttgctcatccacctgcatggacggcatgaacaacgctcccggccgcaccgaatcgatgtcgtcggcaatggacgtgaccgtcacttcggtagcgaacgcgggatcaaggtcaaagccatatctgctggcaagcagacccaacgtcattcgcctattcatggattcgctgaccgcgctcatctttccgcccctccgttcttcatgctcacacactcaccaagtcactggaatagcatcagttcgcggacttgacgccggcacttcgtacttctgcataaggaattcaccaatctccgcagtgaccgggcctgccgtcagaccaccataaacgccttgcggatctttcaacaccaccgtaacgacgaaacgaggattatccgcaggaataatcgcagaataatcgctgataatcgatgacagacgtctgtccgcaccggcaacttccgcggtaccggactttgccacgacacggtaaccatccactttgacgaactgggaatagtggtcggacacggattccatggcattcatcacctgtgaggccacctgctcgtcaatcacgcgcgtcgcttcgccttcaggcttctgctcttcggaatgcccttcggcatcgctgatcgccttgatgatgcgctgcggctttttgacgcccttgttggcgatcacggcaaccgcgttcgtcaactggagcgcattggtcgtatacgcctggccgaacagcacggtgttctgggttcgcagatcccattgatcggccgaatacagcagaccatccgcttcgccgggaagaccaagcccattgtcttgtccgataccgaatttgctgatgaactcatatcgctgctcgttagacatcttctccgcggcgatgatcatgccgacattcgacgattgctcgagaatgcctgccagcgtccaatgctcatcgccgtgggtcgtcgcatcgctgtaggtctgcccgttcgtcgtaatgtggtccggcaccgtgaatttatccgatgcctggtgcaatccaagctgaatcatgcctgacatggtgaaaaccttgccgatggaaccgggttcaaacgtttcgctgacggccctggaaaccgtcattttcgcctggtcgctgccggcttcgatttcgtcgctatcggcgagcgcgagaatgtcccctgtttgtgtgtcctgcaccacggcgactccccacggtgaactatatttcgtgcagctttccttcagcactttttcgacgtaccactgcacgtcatggtcgatggtcagtgtgacatcggagccgttgaccgcgtcttttgattcggtcatggttccggggatttcgacgccgttgttgccttgttggtagacttggtacccgtcttcgcctgtcaacgtcttgttttccatctgttcgatgcccgctacgcctttgccttcaccgtcgacacctcccagcagtgcgcccatcagggttccgttggaatagatgcgctcgttgctgagttccgcgtagacgataccgcccagattgagtttggagatcttgcgcttaacggccggcgtcacatcttttttgagtaccgcatattggcctgttcccgaaagcatggcacccaattcggtggcgtccatgtccagtaccggagcgaggagtctagctaccgccgcagctccggtagcacctaccggcttgccatcgatctgatggcagttgtctccggcctgtttggtgcaggttgtgggagtgaaggcctgtgcttcctcggggttgccgatgatggtgtagcgctccacgctttgcgcgagaatcgagccgttcgtgtccatgattttgccgcgccgtgccttcaaagtcacggtaatcgtgcggctttgcgccgcggcctgcgccatggttttgccattgatcaactggatgttggccaattgaataaggcaagccgtgcccatcaacgccagaatgacgccgatggccatggttttcgtaagcagtttcttgtggaaacgtgcgtaagtgcggtgaaaaggattcactgagcgtcgtctccgcttggctggtagccgttcagatcaatcgttagagcgcctttttggggcaccatgcccatttcctcggccttgctcggcagcgaggcttcaagttcgtcaagcttggcctggtcatcttccacgtcctgggtcaggcgggtaatgttcgactcaatctggttcgcctcgaaggaatgctgcaccatttgggtacgcagcgttaaggatcccagaagacatccgccgaggaacaccacggcgataaccagatgcaacaatggagtgcttctggtgcgcgtccatgtgatgagctgttcgaatcctcgcttgacgctgttgccttcggcccgcgttcctttgacgacgtgcaattcagggcgagtggtgccagcggtttcggtttggtcccggcgtcctgcgggagccgcgtttgatgcgatcgttcttggtgcggccacgttcagcccctccttccttgtcgtttcatgcttgcgtaatcattgccttggtcgaatcgttttcgccagcgttcaggaattggtctagtcagttccactgcgcgcagtcgcacagaggccgaccttggattcatggcgatttcttcctcggccgctttgatggcgcctcgcgtcagttctttgaagaacggcatcatatccgggggtattaccggcatatctgcgggcacgtcagctttcagaccttgattcataaatgttttgacggtcttgtcttccagcgaatggtacgactccaccaccaaacgtcctcccaccgcaagatggttggcgatctgcggtagcgtccccgccaatttgtcgagctcgccgttgacttcgatacgtaatgcctggaacacacgtttcgcgggatttcccgcaggacggtgcgcttgcggcacaacctcatccaccaatcggttgagctgccccgatgtggtcaatggttcgatctcacgcctacgcacgatttcgcgggctatctgcttggagaagcgttcctcaccatatgtacggaaaatgcgtaccagatcagcgaacgaatattcagcaagtatctgttcggcggtcaatggctgggtcacgtccatacgcatgtccaaaggcgcatcgtgagaataggagaatccccgctccgtctcatcaatctgcaaactcgacaatcccaaatccatgaacacggcgtttacctggtcgatcccctgatcatcaagcacttgcgcgaaatcgtcgaatgcggcgtgcacgggtatgaagcggtcggcaagaccttccatccgcattcgctgcgtggcgagcgaaagcgcctccgtgtctcgatcgatgccgatcagacgcgcttgcggactcgctttgagaaaagccgtggaatgccccgccaaaccaagcgtgcaatccaccgcaatcgaccctggcctcgccaacgccgggaccaccagatccacgcagtcgcgcagcaacactggctgatgtatggtcgttacatctgtcatcagaattccaccgccggtaatacgtcatcggcaatatcggaatatccctgctcctgctcggcgagatattcctcccatgcctgcttgttccaaatctccgctcgggtccccacgccaatcaccacgatgtcgcttcccaaattcgcgtaatcgcgcaacatctgcggcacgagcacacgtccttgcctgtctggctcctgatcaaccgcgccggaaaggaacacgcgcaaataatcacgtgcagccttgtttcccatggatgtgcgctggatctgcaatgcgatccggcgaaattccgattggggcaacagatagacacatcgctcctgaccacgggccatcaccatgcccggtcccagctggctgcgaaattttgcaggcaatgtcatacgtcctttggcgtcgatttttggagtgtatgttcccaacagcagcggaggcagtccagccatcacaccgctcgcttgcgtcgaaccatcgtcggagaagggctcggtttcaacgctttgaaccatcgccacacctccttacatgatgcgcgggaacacctagacccaaaactctttccccactttaccccacgcatcaccataaatccccacataaatggaaaaaatcagcaaatgctgaggttgattttccccacattgaacgaatggcatcaaatcaactaccgtaaattcatccttgcttcgctatgtcgcactcgccctcgtcggttttcgtagaagcctcggggtacattggagtgcctaagttttgtgaggaagggattgcagatgtcgagttattccgcccagttgcgtgaagaacaacaggccgtcagccgcgcgtacggccgcttggatgatctgcgggcccaagctcgtgcccgtctcgacaccgtgcgtgctgccggctcgcacggatcgcccacgcaacgcaccgaacgcgattccttcgccaccatgtacgaggatcgcctcacccagctgcgtgccgtcgaagatcgcctggtgttcggcagactcgacgatgtccacggtgcgcacagatacatcgggcgtatcggactgtccaacgaaaaccacgagccgatcctcaccgattggcgagccgacgcggcacgtccgttctacgaagcgacgccttccaatcatggcgatatcgtaatgcgccgccatatcacactcagcttccgtgaagtggtcggcgttgaagacgaggtgctcgatgtgcactccgaccaggtcgggcaggcgtcttcggacggcactctgaccggcgaaggcgcgctgctcgcatcgttgaacgccaagcgcaccggcaagatgaccgatatcgtggcaaccatccaagccgagcaggatcgcattattcgcgccgacctcaaccaggccgtggtggtgcagggtggaccgggtaccggcaaaaccgccgtggcgctgcaccgtgcggcatatctgctctacacgcatcggcgaatgctcgaacgctccggtgtgctcgtggtcggaccgagctcaaccttcctgcattacatcgatcaggtgctcccctccctcggcgagaccggagtggtcagccgaaccatcgccgatctgatccccggcgtgatcgcgacggcgcatgacaacccgttcgccgcgaaattgaagggcgaacgtcgtatgtccaaagccatcgccaatgccgttgccgcacgagaacgcgtccccgcatcattgccgtcgatccgcatcaacggattcgcagtgcccatcgtgcgcgcggatatcgaacaggccatcaccgatgccaagcgcacgcgacagcagcacaacaaagcacgcgaaactttcgtgcatagcatgttgatcgccatgcgcaaccgttatgtggacaagcttgattacgagccggagcaggcggagttgacggatgtgatgcagcagttgcgcatgaatgacaccttgcgcaagacgttgaatctcgcatggttgccgatgaccggcgaatggcttatcgaccaactgttctgcaagccgcagcagcttcgtcgcttcgcaccatggcttgaggaacgcgatatcgaagcattggttcgccccaaagggtcgccgtttaccgtcagcgatattccgctgctggatgaagccatggaactgcttggccccgaccccaaagcggtcgcccgccaaaaggcgttggacgccaagcgcgccgaggaggagcagttcgcgcaagatacgctggctcaggctggcatcggctccggcatcgtcacttcgcagatgttggtcgacaatatcaacgggatggacgcggaactcaccgcgcagcgcgccgccgcagaccgtgaatggacatatgggcatatcgttgtcgatgaagctcaggaactcaccgccatggattggcgcatgctcatccgccgttgcccgtcgcgttcgttcaccattgtgggcgatgttgcgcaaacctccgcattgggcggcacccgttcgtggcgacgtatgatggatccgttgttcggaccccacaattggcaactcaacgaattgacgattaattaccgcaatccgaaggaagtgtcgcagctcgcctgtgatttcgcggcaacggagggattgtacatctccaccgtcaatgcggtgcgtggcgtgccggattcggtcaagcgcctcactctggccgacgacagtctgattgccgatgccgtggcacagcagaccgtcgatctggtccgcgcattcgtctcctccgatggcaccggacgcgtggccatcatcgcacctgacgatatggtcaagccgttgcgcaggcgggtgtacgaacagcttcgcgaaacattgacggcgaaggagttcgaccgtctcgatgcgcagagctcttgggatgaacaggtcaccgtttgttccacgcaaatggtgaaaggcttggaatacgacgcagtgatggtggtgcagccgggaagcatcgaggagaatgccccctcacgcattgtggccgcagccgatttatacgtcgccatgaccagaccgacacaacgtctgcttatagtccggacaaatgcagacgaaaaactgctcaagctataaggtaggaaccatgcctaaagcattgttacttgaaaatattcatcctgacgcggcacagtcactgcgtgaccacggcttcgaagtcgagtgcctcaggggcgccctcaacgaagatgaactcatcgacgccttggaagacgttgatctgctgggcattcgctccaaaaccagcgtgaccagcaaagtcatcgacgcacgtccgacgctcacggccgtcggctgcttctgcatcggcaccaatcaggtcgatctcgactatgcgggcaagcacggcatcgccgtgttcaatgccccatattccaacactcgctccgtggtggaactggttatcggcgacatcatttgcctgatgcgccgcattcctgcgcacacccatcatatgaagcacggtatgtgggacaagtctgcttccggctctcatgaagtgcgaggcaagacgctcggcatcatcggctacggcaatatcggatctcagctttccgtcatcgccgaggcacttggcatgcgcgtggtgttctacgacattgaagagaagcttgccatgggcaatgcccatcgttgctctacactgaacgaactgctcgaacagtccgatgtggtcacactgcatgtcgatggccgcaagtccaataccggtttcttcggtgaggaccagttcgcgcatatgaagcaggattcgatcttcatcaatctttcccgcggttttgtggctgatttggacgctctgaagaagcatttggactccggccacatttcgggcgccgcagtggatgtgttccctgtcgagccgaagaagagcggcgacgagtttttgacgagccttgcggatgaagacaatatgattctgaccccgcatattggcgggtctacgcttgaagcccagaagtccatcggacagttcgtctcacagcgtcttgaggattattggttcaggggatccaccatgttgtccgtgaatcttccgcagatcacactgtctgatattcgttcgaacttccgcatcgcgcatcttcacgcgaatttgcctggcgtacttgccaaggtgaaccgtgtgctcggagaagagaatatcaacatcgcggcacaggcactgggcaccgaaggcgaaatcggctatgtggtcaccgatgtggcccagcgccccagccagaaggctttggacgaactcgcagccatcgaaggcacgatccgtatgcgtgtgatcagctgacgatcccaatccggcaaacgccactacgatacgaatgcattgtgggggttccaatcacttattggctggaacccccacaatgcatgaaccctaatgccgtttgccgtaatcgcccagttttgcgctaccaagtccatttcagccaaaacaaacgcattatcatatgcgttcgcaaccgttcgaacctacttcagcgcatcggccttcagctcgtcgatcgcgttctggaaatcctcaagattctcaaaattctggtatacactggcgaatcgcatatacgcgacctcatcaagatcacgcaacggtttcaaaatggccctgccgacctcgtcggatttgacttgagccagtcctcgggcacgaagatcctcttcgacctgctggccaagagccttcaaatcgtcttccttgatcggacggccctggcatgccttgcgaacaccagaaatcaccttgttcctatcgaactgctcaacgttgccggaacgcttcaccaccaacaacatagtggtctctagcgtggtgaaacgcttggagcatttcgggcattcacgcctacggcggatggaatggccgtcatcgctgatgcgggtatcgaccaccttggtatctggattctgacaaaaagggcaatgcatggtgtcaagaatagcctgaaccattgaactaggccaatcttgcgcgggttcatacctcgtcgggaacgataagtctttgaccggcccgaagcgatactgaatccagattattcagtcgtaccagctcgtccacagtatccgcaacattgccaccatcaggcgtaatacgcgcagcgtacccccacaacgtatcgcccggctggacggtatataccaccaccggcgtcgctccgggatctgactgcgcgcgtgcaggcatcatcaatccagccaaacaccatgcgagcaccatcagcatcatgattacggccagtcgatccgcccagactttgaaatcaacgccatgagccttcggcacacgatccatcacgccactccttctcgaacagctgttctatcgaacgcatgttctgagtatggcacaaatgttcgataattgcagacacacctcgaacagatgtttgattttctcggcgtttcgcgttatgcttgcctaagacctgaaaggagcccaccgtgagcaccgtcccattcacgcccaaaaaggatgccgagcgtccggatgaaagcacgctgaccgaccgtcagcgcaaggtgcttggcgccatcaaaaaacatctcgtcgagcaggggttcgctccctcattccgcgaaatcggcgaagccgcagggcttaaaagtccgtcatccgtcaaacaccagttgcaagtgcttgacgacaagggcttcattcgcatgaacgcgaacaagggcagagccatcgaagtcgtgagtttcgacgatgacgaggtttcgcccggcaaagtagcgcaggtcatcccattcccgagccaatctgattccagcggatccatcatggcttcccgcgatgtccccttggtgggacgcatcgcggcaggcgtgcccatcaccgccgagcagcatgtggacgatgtgatgcgtctgccggaacgtctcactggcaccggcaatctgtttatgcttgaagtgcatggcgactccatgattgacgcggctatctgcgatggtgattttgtggtggtacgcgagcagaacaccgcggaaaatggagatattgtggcggcgctgctcgacgatgaagccacggtgaaaacgttccgcaaggatcatggccatgtctggctcattccgcacaatcccgcctactcccctatcgatggcacgcatgctgagatcatgggcaaggtggtcaccgtgctccgcaaaatctgacgttagactattcaacgccattgaaatcgcgcccacaaagatgaagccataaacaaagactccatctttgtgggcgcgattcttttccggtaaacgcaccggtcatttaagaatgtttaggaatgcatttcggatttgctggtcgaactgtatccttccggttcgagttggaaggtggtatgaggtacggatacggggaaatgttcgcgcaggcaatcttgtagttgtgcgagtatttccgccgcttctttcatggtgagtccttgttcgaccacaacatgcgccatgaagatcggcatgcctgtggatacgatgctcgcgtggatgtcgtgtaccgccacaacatgcggcacttgttccaagtgggaacgcacttcatcgagatcaagaccgttgggggtttcttcgagaagcacgcgaaccgcgttgcgcaacagtttgatggctcgcgggatcatcatgagtgcgatgatgccacctgccacagcgtcgaatccggcccagccggtgcagatgagcacgcttgccgatacgattacggcaacggaccctaaagcgtcattcatgacttcaaggaatgccgctttcatgttcatgttgtcttcgctttgcgatgcgaggataaagattgatccgatattggccgcgaggccgagtatgcccatgaagagcagcaatcgcacgtcgtttacttcgtcggcagatccgccgaaaagtctcatgccggcttccacaagcgcatagatacctacgatgaggaggatgagggctccgactgccgctgttagcacttcgagccttgcccagccccaggtgcgtttgttgctgggcttgcgttgcatcagtattgcggtgacggttgatgcgatgagtacggacatgtcggtgagcatgtgtccggcatcaacgagcagcgccaacgattctgtgatgaccgcgctgatgacttccgctatgaataccgtcgaggtgagaccgagcgacatcatgagccgtttttgatgttccgctcctgtgttcgctatcgatccgtgcgcgtggtcatgtgccatatgcttaatctttcagcccgattaagaaacttattgaaattgtttctcaataccattttcattgctctcaaaacgcaagaaaccccagccataggccggggtttcctttatttctttttgcagtctaacgactgatcaatcgcctgtcaatacccaagcaaccaaaaagcggtaacgcagctggcactccgttgccgccagaaaacaataaaaaacgcggtaacgcatgtgacagcaaggcgcacggaatgaaggcgtacagaggtacgtcgaattccgtgtaacgcagctagcactccgttaccgcgttttttatcagaagccgaactgggcagcggtttccttcagcgtctctgcggaacgcgtaagggctgcaagctcgcggtcggacaccggggtgttgatggcggtgttgacgccggaacggttgaggagggtcggcacggacatgcagacgtcggagatgccgtggaagtcgtggagcatggagctcaccggcaggatgcggttggagtcgcgcatgacggcttcgatgatgtcaacgccggacatgccgatggcgtagttggttgcgcccttgccgttgatgatcttgtaggcggcgttcttgacgtcctggtgaatctgctcacgaacttcggcgtcgagcggagcgtgacccggcagcggggtccagtcgcacatcgggacgccaccgatggtggcggaggcccacagcggcacttcggagtcgccgtgttcgccagcaatgtaggcgtgcacgttcttgacgttgacgccggtctgctgggcgatcaggaagcgcagacgtgcggagtcaaggttggtaccggagccgaagacctggtttgccggcaggccggagatcttctgggcaacatgggttgcgatatcaaccgggttggtgatgagcatgtagatggcgttcggagcgaccttcacgaggccaggaatgatggccttgagaatgttgatggtggcaccgaccagttcgagacgggactgacccggcttctgacgcggacctgcggtgatgacgatcatgtcggcgtcgcggcagatttccggatcatcggagcctgcgatggacacggtcgggaagaagctggagccgtgctgcatgtcgagtacttcggcttcgacgcgttccttggcaatgtcttcgagcacgatctcacgtgcgacgccacgctgagcggcagcgaaagcgagagtggagccgactgcaccggcaccgatgatagcgagctttgtgggcttgattggtgaatccaccatgtgcttacctctcttataagaaagaatgtcccgctggtagcaggttttctcttagaatttcatctttactttatccacacagcatgacgtttcaaggcgttataacacgacttgcaaataatgaaaagtgatatgcatcacaaaagatgtgagcgctcacaaacgctgtgtccgttgcgttgcactgttttgcaaggttttcagccgattgactgttccacgatttgcgcagccaaatgatcgtccacttccgcttcgagcatcataccgtcgtcacggtattcgacgttgatcactttgccgtattcacgtacgcgcgacaccagcgaaccggcagtgtatggcagcaacgcctcgacatgcacgttcggcgtcggcagcatggattccacctgcatacgcagctcgtcgacgccttcgccggaaaacgccgatacgatgtacgcttccggcatcaacgcctcgatacgctcgcgtgtggcctcatccatacggtcggccttgttgaacacgataatcgtgggaatggtttcgacgccgtcgatgtcggaaagcacatcgtcgaccgcgtcgatttgcgagaacgggtccggatgcgatccgtccaccacatgcacgatcagatcggcttcggaaacctcctccagcgtggatttgaacgcttcaatcagctgcgtaggcagtcgacgcacgaacccgacggtatcgacgtacgcatattgacgtccatctttggcacgcgccctgcgcactgcggtgtccaatgtggcgaatagcgcgttctccaccaattccgctgatccggtcaaccgattcgtcaacgacgatttgcccgcgttcgtatatccaaccacagcaacggtcggcaatccgaaacgacggcgagcgccacgtttgacgtcacgcgcgggagccatctgttcgatctgtttgcggagtttggcgatgcggcttcggatcacacggcggtccatttcgattttcgtttcgccaggtcctcgcgagccgatgcccgcgtctcctgcggcgcggccacctgcctgtcgcgacagtgatccgccccagcctcgcagtcgtggcagcatgtactggagttgtgccagttccacttgggctttgccttcgcgtgaggtcgcatgttgggcgaaaatgtcgaggatcacggcagtgcgatccacgaccttcactttggtggcgtcttccaaggcacggcgttggcttggcggcaggtcgtcgtccacaacgatggtgtcggcttcctcttgcgccacgattccggcgagttcgcgggctttaccggagccaacgtatgtagctgcgtccggcttgatacgatgctgcagcaggccgtcgcataccacggcgccggcggtttcggcaagcgcggcaagttctctcaatgattcttcggcctgtgcctgtgtggtttcacggctggaccacacgccgacgagcacaacgcgttcgaggcggacttttcggtattcgacttcggtgacgtcttgcatttcgccgagtccggacacatgcttcaacgcattgcgggattcgcgttcctgccattgttcgtcatgggattcgttgaaatggttctcgccgttggtatcaagcagcacctcggactggtcggcgagcacgcctgacacgtcgttggcgctcatgctatgctcgatgtcgttttcttggctcaatggcacctctcacggttaaactatggtgtctttattatcatcattctctagagacatgggtatcgggcattcgccacgtggatgagcgtggtttgcgtgatgccggaggcgagcgtttgtaaggagtgggtatggcacaggccgaacagtatttcgcggctgatccgcagtcgaaggatgtacgtaagaggctgcatgttgtgttgcgaggcaatgaggccgatgttgaggtttccaatggcgtgttttccggcaatcgcgtggatttgggaacgtccgtgctgcttcgtcaggctccggagcctcctgaggagggtacgttccttgatttgggttgcggttggggtccgattgcgttggcacttggctttgcttcgccgaaggctgatatttgggcattggatgtgaatgaacgcgcgttggatctgacgcgtcgcaatgccgagctcaatggtgtgaggaacgttcatgcggtcaccgccgatgagatcccttcggatgtgacgtttgatctgatttggtcgaatccgccgattcgtgttggcaaggatgtgctgcatgagttgttgatgacgtggctgccacgtttgaatgcgggtggtaccgcctatttggtggtgcagaagaatctggggtcggattcgttgattccgtggcttgccacgcagcttggcgatggttatgaggtaagtaagtacgcgagttcgaagggcttccgcgttatcgaggttatgaaggcatgaaattcgaatatccttcccaactgccggtttccgctgcacgtagcgatattgccgaggcggtgaagtcgagccaagtcgtgattgtgtctggtcagacgggttccggtaagaccacgcagctgccgaagattctgttggaattgggccgtggatcgcatgacaggcagattgtgcacacgcagccgcgtaggctggccgctcgtaccgtggccgaacgtatcgccgcggagatgggcgtgcgtttgggcgacgaggtcggctatcaggtgcgtttcaccgatgagagctcaccgaagacccgtcttcgcgtggtgaccgacggtattctgttggcgcagattcaacgcgatccgaaactaatgcaatacgatacgatcgttatcgacgaggcgcacgaacgtagtctcaatattgactttctgctcggttatttgactgcgctattgccgaaacgacgtgacctgaaattggtaatcacgtcggcgacgattgattcggtgaagttccaggagcatttcgagcacgctttgcatacgaaagtgccggttatcgaggtttcgggacgaacctaccccgtgcaggtcgtgtatgagccgctgggcaccgctccggcgttgatgcgttccgtacccggttttgaaacgggcgcgatgccgggcgatgccgactatgaaacgttgtcggccgctcccgacgcgaaggattcccatgagccgaacgttgacatgccgacggcggtggcgcgcgcctgtgccgagttggtgattcattcgagtcatgaccgtggcccgcgcgatattctcgtgttcgcttcgggcgagcgcgacattcatgattttgagaatgcgctgcgccatcattatggtccgcgtgccattgatatgcgtcgtcctgatgcgattgagatcgtgccgttgttcgcgcggttgtcctccaaggagcagcatcgcgtgtttgagccgcatgaccatcagcgtattgtgatcgctacgaatgtggccgaaacgtcgttgacggtgccgggcattcgttatgtggtcgaccctggcaccgctcgtatttcacgttattcgaagagcgcgaaagtgcaacggcttccgattgaaccgatcagtcaggcgagcgcgaaccaacgttcgggtcgttgcggccgtattgcagatggtattgcgattcgcttgtattctcgcgaggatttcgagacgcgcccggaattcacggagcctgagattctgcgcacgtcgttgggtgcggtcgtattgcatatgctgtcggtgggtgtggctcgtaccgcgcaggatgttacggatttcggctttatcgatccgcctgatatgaaggcggtgtctgatggtttcaatgagttgaccgagttgaaggccgtggcgcgcaagcatggcgaggttgtgctgacgcatacaggtcgcatgcttgcacgcattccgatcgacgtgcgtttgggccgtatgatcatcgaggctgcgaagtcgaccacgccgaacacgttggccgcagtgctggtggtggtcgcgttcctaagtttgcaggatccccgcgaacgtccggatgagaatcgtgaggaggccgaccgcattcataaccggtatgccgatccgtccagtgattttctgaccgcgttgaacttgtgggatcgcgtgttccaagctgatggcgagccgagcaattccgcgcttcgtaggatttgcaagactgaatatttgagttggctgcgcatccgtcagtggaaggatctggtcacgcagttgcgtgagatgtgcaaggaattcaagttcaaggttggcgatccgattccggcttcgcgtccaccgcttgagattcgtcagcttccgtcgaatcagcaggctgcgcattcgttgtgttgttcgtgggatgcgcagggtattcatacgtcgatgctttcgggcttgttgtcgatgatgggcatgcagatcgtgcgtgaaccgaaggcatctgatttcgctggcttgaagggcgctgcccgtgcgcgtgccatgaagcgtgcgcagaagatggcgaagaatgattatcagggtgcgcgtggcacgcatttcgcattgttcccggcttccgcggttgccaagtcgacaccgcaatgggtgatgagcacggagttggtggaaacgagccgcttgtgggcgcgatattccgcccagatcgatcctgcttgggctgaaccgttggcgggttcgttgacgcgaaccacgtatgcggatccgcattggtctggttcgcgtggctccgcggtggcgagcgcgaaggtactgttgtatggtttgccaatcgtacaggatcgtacggtgcagtggggtcgtatcaatccgctggaggcccgtgattttctgattcgtcagggtttggtcgagggtgatattcagcagcggttctcgtatgacgatttcattgcgaagaatcgcgatgtgttggaggacgccgccgacgatgcgagtcgcacacgtcagatggcgcaggcggtcagtgatgaggatctgttcgatttttataattcggtgattcccaatactgtcacgtcggttgcggatcttgcgaaatggtggaagtcaaagcatgatgagcagccggatttgttggattttgatccggagaaggtggaacgtcttgctgatgccgagtcagtgtcgttggctgattatccggatcattggcatacgttgggtacggacggctcccctatcgatttgcggttgagttatgtgtatgacccgcatgatccaaacgatggcgtgaccgtgcatgtgccgttgaaggtgttgtctcgtttgacaccggaacaattcacgtggaatgttcccggattgttggatgagttgattgtcggcatgatcaaatcgttgccgaagacgttgcgcgtgcagtttgttcccgcccctgatacggctcgtaagattcgtgcgtggattgatgagaggtatccggatctgcctggttccggtagccagcagaagccgaatcttactcctgccaatgcggagggtgtggccgcgtggccggatttgcctcatacgttcacgcaggcggcaatcagcattgttggcgcgcagattcaccctgaagtgttgactggtgaattgtggagcaagctcacgccgtatttgcgcgtgacgttctcggtggagcagcagttgcctccgagtcgcaagagtcagcatggcaggcgtcatgcgcggggccctgtcaaggtgcttggctcgggcaaatcgttggtggagttgcagcgcaagtttgcggagcaggccgaggcttccgcacggcagatggtgaagaagcaggcggaaaacgctggaaatcagggcaagcttgtggagcaggccaatctgctgcataaggctggtgccactaccgaagctcgttccaccatgctgtggcgcggtgcgcttgatgttttgcgtatgccgagcgagcgtatttcgtcgcgttggttgggtgcggaggcgttgatgttggcgtccgcaccatatcagtccacgaaggatcttactgaggatctgcagttggctgcggtgaagcgtttgctgccgaatgttgacgaattgccggatgatgaggcgttggcgaatgcggtgcttgatgtgcgtgaagtgttcgaagataccgtgtatgcggtcgcgcatgatgtgatcgccattttgaagcggtatgcggaggttgataaagccgtgtcaggcaaggccgatctgccgatgttgagcgttttgcagtcgattcgtgagcatatcgccacgctggtgtatccgggattcattggtaagactcccccggatgcgttggcgtcgattgaacggtatctgcatgctgacgtgcttcgtttaggtaaggcgaagaacgacaagaatcgtgatgtgcgttgggcttgggaggctgatgaggccaagcagttggccgacaaggccatggcgaaggccgaacgtgagcctgcaggtccgcgtcatgaggcgttgatgaagcaggcggtcaccgcacgttggatgcttgaggaattctacgtatcattgtgggcgcaggaactcggcacgccgaagccgatcagcctgcagcgcatcaagaaagcgttgagctaacgcatcatcatctttcgcattccattgccgtcgatactggcggttttccagtatcgacggcaatgggacctaatgaaatcatcctcagccgaaccatggttagcacactctagcgttgcttgaagaaacggaacaactgcgtttcatgtatcgtcataccgacgagcacgcttgataccatcactccagcgaatatcgcacatggcgcgcgcatcgcacccaaccatacggtcattgaatcggcgatgctcatgcgaacgcaatacgcacccaacagcgcggccgaagaggcacacgccaagccgctccaaatcaacgtttccacagcgatttccagcaattgcgcacctttggactgccctgaatgcaatgcgccagcatattccaatctacgacgacgcacgccgaacgcgccgaacatcagccccacagccaatcccagccacggcatccaacgagtcatacgctgcccgtacgaagcttgcgcatcgtaatgcgaatcgaaactcttattcacctgcgtcacgccggcattggatgacgaacccgacgcaaccagcgtggaaaacaacacatcctccgtctgcccgctttgcggccactgtctgacccaacattcgtcgaacgtgccattcgacgcagatacgggcacaaggagagcgtaggcgaatcgcgtgtcacgaccatcgttcggccaataaaacacgcctgcgacgctcatcgttccctgttcggtctgcattacgctgcctttggtgagaccaaaatccttggccacgtcggtagatacccacacgccggacacatcggacttcgcgctcccggcgatcatcctgatcatgccgggcgtcacttcatacgacgatatatccttgccgggcgtggcaagcggcacaatctgttgaccggcacgcatcgcaccggccaaggtgcccatcacaccgccgccagcgtcggcgagcctgtcacatgcggctccgtccaccgttcccccaacgatggcgccaacgtcggcataggcgttgatgcgttgcaccgcctcggtttcgagccccaccacattggcggcctcatatccgccgagcaatgtagacgcgaacaataccgctgcaaacataagcagcgcatgactcactcccgcgccaatattgcgcaacgcttcggaaagcaccgatcgtaatcgcataatcgcctactcgcaggtgagattgttaagtccgctgccgatttccacattggagatcgaagcgatgtcttcgctgtcggcttgcacgaggctcacgcccagttcgcctcccacgatcgacactttcacgggagtgttgccatggttattggatgtgggcacgatgcagccggttgaaccgttgatgccgaataccgcgccggctggaacgcgcagcactcgcatccgttcgctcaaggccagagtggcgtccaatcccgcttttctggattccacgtccacggattggtagctgtcgttcgcttcgacttgttgcaggaacccggcatccgtgatttcagtggtattggctggcaatgttcccgtaatgccgaatatcgtcaacgtgcggtcctgcgcggatgcggtgccgtttttgatggtgagtttcgtcaatgatccggggattttgccgattgcggtgccgcccgtcaccatggatccggcggttgcgttccactcgtcaacggcgacttcgtgttcgggaatccacaatgtgtcggccaatgacaacgatccatccgacgtattgccgttgtcggccatcaactgcttccacccgtccgatgtggcccgccaataggtatccgatccgggaacgctgttgtagccaagtaagctgagttcattattcagggcgagcacatcgccgccggtgtctccggtcttcaaatcgcgatacaagggggttgcggtattcaacgccactaccgtgcgatcgttcacctggtaggcacctttgcctgaggtcaggccgttgccggaccagtccgcggtgaccatgccactcgcattgccggaaagatcacggtcactggaaatggtgggcaccacagtaacctgctgcatgcccgtatattcttgcacactggcgggagccacggtcctctccaccgccgagctcagtaatgtcggagtgcggtcaggcagccacaatgcgcaggatccgaccgcaatacaggctgccgtgacagccgccagcaaagtccaagtcacagcagtgcacttcgaacgcttccctcccgtcctttgcttcattccgaatcgtcgcgtcatactcacatataccccttcaatcacgaccaacaagcaccatccgcgaatacatcaccatgattcccctggaatcacttaccttctcaccacaactgttccgtatcgtcggtcgcatatcccacgttgtagccgttcgacacaaggcaactgcgcacttgcaggttctgcatgtcaaacgaagtgttgccatccgttccggaaaactccttgttgaaccggcttacggtatagtccttcggcacgagcgagtctctatgcaaacaatcgaccacggcctgcgcttgatcggcatacagattcggattgcctacgataatgccgtacacatcctgcacatctgcaacatactcatcgccgcattccgtggaatcatcggaatatcgggattcctgaatggtcgttccctgtttgtgtccagcttcggcatagagtccgctcggatatttgatgagtttgatttccttatatcctttgtcgatcatgcattgccggtaatcggaccaggctttctcataatccgacgttgaaatctcacccgtacttttggctttgtccaatatcgttttctgcgattcagcgatattaccttgcgattcccgctgttcaatccattcactcaacgacgccgccaatttctgtccgcccgccgacccattttcggatgatgattccgatgtggcagaatcagaagatgcgcctgtggcatccccattaattgagcatcccgccaaaagcattgacaatgcgacggcaagaacgcaagtcttgcaaaatgacatccaagaagtcaccatcttcacccccgtactaatgtgtcataacgagtgtagcaccgcatgataatgtgcatagcaggcggcatttccgaaaaacttgcttgcatatacgcaaatgaggtagggtgggtgttgcgtggttgcgattaggggactacaaatgattggcaagggtgcgtcggtaaggtgattgcctcgtgaaaggttggctatgcgcgttgcggttgaggggttggctcatcgatttgagggaaccgatctgctgttcgagaatttgagtttcgtggccgaacctggtgtgaccattgcgatatgcggtccgtcgggatgcggcaagtcaacattgctgtcgattcttgcaggatgggagcagccttacgctggcacggtgacgcgagaaggtgtggatcgtgttggatggatgtttcagaatccgtatggtgttgcggaacgcacagcgctcgaccatgtggtgtttccactgctcgccaagggaatgagccgccgcgaagcggaaccaaaggctttggaagcgatggaactgttcgatctggaatatgcggcagacaggcgtttctgcgctttgtccggaggcgaggcgcagcgtcttatgctcgcgcgtgcggtatgttccaggccgaacatgctgctggtcgacgagccgaccgcccagttggatacgcgtacatcacattccgtaagccatgtgctcggcaatctggccggtcaaggcatgatcgtgctggtggcaacccatgatccggacacgcgggacgcctgcgatcgcgtaatcgatctagccgactacgctccgcaagtcggcgggtccactgcccagcccgccaacatcgcagtccactaatcgctttccgcaatctcaacgaattacagataaaacttctataactttgccgctttcagaaaccgctcgttcaaacccgaccaaatgccatcaggcttgctgtttggcgtagaaatcgcgttctcgagctgcgaacgggcgcagcagggttgtggtgccaaccgcacacagcaggaagatcgcgcccacagggccaagccacatcagtcccaaatgggcgttgaccagtccaccaaccgcggagccgaccgcgatgccgatgttgaacgacatggaattgagcgatgcggccagattcagcgatcccggatgcgactgagaggcaacatccatatatagcacctgcgaggcggaattctgcagatacatgaacatgccaagcaccaccagcagcaacgcaccatacaccggcacccaatgcgttacgatcagcgatgccatgagcacggcgtgcgcgcagtagatcggacgaatatgcgtcagtggttccactcccctgccacggtcggcaagcttgccgccatacaggttgctccacaggcaggccgcgccgaaaatcaccaggccgacgcttaaatactgttcgggaacatgcacttcgtctcgcatgatcggcgtcagatacgtatagaacacgtaagttgccgccgcgccaaacaccacggcaagcacgcccaactgaatacgacggtcgaaaaacaggcggaactgcggcagaaaaccaatcttcacaatacggctgttgcgcggcaacaccatcaccatgagcacaataagcaccactgtgagcacgttcaccaaatggaacgcccaacgccagccgaacgtgttcgcaacccacgtgccaaccggcacacccaccacggatgcgatggagaagccggaaaacacccatgcgatgaacttcgtgcggtactgttcagttgttacatcgggcgcgtacgtcatggcaatggccaccagcgtgccggacaccagcgcgatgagaattcgcgccaccacgagcacgccataattcgacgcgaacgcgcacagcacgttgccgataaggaacaccccaaccagcgtcagatgcgtggcaaaacgcggaaaacgagccgacagcgccgatccgagcggcgtgaccggcgcatacacgaacgcgaacagcgacacaagattgccgaccgtcacctccgacaccttcaagccagccgcgatatccggcagaacgccaacgacaatgaactcgctcatgcccagcatgaaactcagcgagatcagcacaatcacaggcagattgaaaaaccgttccttcgccacatcactcttcgccatacacttctcctccatagcccctcgaactccccacgcctcgccaaactcgcattgtcattaaagcttctcacgtcaatcgattgacgaatcaatcgtcaaacaaacgataagccaaacgcgatacaatgacgcgcgatgacacgcaaaacaaccaccacagcaaaaaacaaccgcaaacccaagaaaaacaagcagccaagcctcaccaaactccgtaacgcctggaaaaaagcaaacaccccaaaacgcatcctcatagtcggcgaaacactgatagccagtatcgtcgcgctcgcgttgatcgttggattggtgcgattcgtcggttggcgtgtgcaagtggatgaagcggtcgcatcgcaggaacaattgcagacgcaatacgatttcaatccgggcaacatcatttcagatggtctgttcttcaacgggaacgcgttgagcgagcagcaggtgaacgccatcatcgaaaaacagggtgccgcatgcagcggcgagaaatgcttgaaatccatgacgtttagcaccgaatcgcaacccgccaacgaatactgcgaagcatatgagggagagccgaacgaaagcgccgcggcgatcatctacaagtcgggaaaggcgtgcgacatcagtcaaaaagtgctgctcaccgtgctgcaaaaggagcagcatctgcttaccgccaccgatccaagcgacttccaattcaagtcggccatgggattgagctgcccggacgacgcgaactgtgacccggaatatgcaggttttttcaaacaggtgtatggcgcggcgaaacgctaccagtattacgtgcaacatgaggatcgctatggataccatgcgggcacgctcaactatattcaatacaatccggacgccagctgcggtggcagcaacgtgtacatcgaaaacaaggcgactgcactgctgtacatttacacgccttatcagccgaatgcagccgcattggatgcgggagtcggcgaaggcgacgcctgttcgacttacggcaatcgtaatttcgcaatcatctacaattcgatgttcggctctcctcgaggctgatttttcgatacaattgctcatggaagggactgaccagaaggagcctttcatgggcctactcaacaacaacgactatatcgacccattcaagggttccgattacatcgatcccagcagcaacgccgaacgcctgtctaatcaggtgaaccgtgaccatgcacggcgtgaatcctatgtccagcggcgatatgtgaaacccgcgcagagcgatcaggcatcgcgcgacaggcaggccccacaaaacacccgatccaagcaagacggtagatctcaacaggcgcaaggcgatcagtccacacgaggagacacgctccaaaccatgttgaacgactggtccacgcaaaccatgcggtatgcccagtccatgcagcaaagcttgcaacaggcgttgcggcaaaatcagcaaaacccgcagaacccgcaaggacgcccatcgcagccctataatccgccgcgcatacaaacggaatgagccacacgcgagttccaatccacttccgacaagaagcaacgccgccataaaaacggcttcgtcaccgttttggagatcgttatcatcatcgctgtaatagcgtcgattggcggaatgctttctgacagcatgtcaaacatcatctccgatttcgatggatccacaagccagttcgaggagctgtccacacaggaaaccgtcagcgaagacgttggaaagctctactccaccggaggaaaagcattggaagtgaacatcgaaggcgtgcagacaggtccggaggatttgaacggcgacgccacgctcacggttttgctcacctgcacgaacatcggcaagaaaacgatgtatcctcatgccgtcgcagatctgatggtcatgcaaaacggcatcgagcttgcccctgcattcacttccaacgaggattccgaccgcacggagttctccggcgccgaaatgaaaccgaagaaaagctcgcagaccaccagcagtttcgttcttacggacaccaattcaccagttgtggttcagctgatgaattattcgcagcataatgttgttcgcgccgcgttttcctttgacgaagtcgacatagaaggatccttgaaacatattgattatgcggccgtccctcagcccgagcaagtggacgcttcgaatttcgacgaagacggatccgtaaccgattatgacgaaagcaccctgcatttccgcgtagactccattgagaagacaagcccctcatatgccgatcatgacatagcgttcgcacgcatatcctggtatgtcgaaaatggaagcaaataccgggctttcctgaactatatggatgtttccgcgacccaagacggcactgagttgcatagcacgtatcttgacgatgatagctattccacaacacgcaaggtcactcccggcgtgaaaatgacgacgacagtcgcttttgaaacgcaaagcaactcgcctgtgacattcatattttctgactatggtgatgagattcttcgcaaaaccgttaatttacggtcaattgagtcattggaactttaatccgatacttgcagaaacatcaaaagaagattcaaataatcattcggaaagcaaaagaccgttgttgcaatcagttttctcatgattgcaacaacggtctttgatgaaacgattgcggttcgcttacagcttcggcaggtacttcttcagttcgaaaggagtgacctgcttgcggtattcctcccattcctgacgcttgttgcgcaggaagtattcgaaggcatgctcgccgagcactccggccacgaagtcggacttctccataaccttcaacgcctcgtcaagagactccggcaatggctggatgcccatggcctgacgttccgcatcggtaagctcccacacgtcgtcgctggtcggctcgcccaactgcatctgcttgtcgatgccgtcaaggcctgctgccaagagcaccgaatatgcgaggtatgggttggcgaccgggtcgagcgcacggaattccatgcgggcggaattgcccttgcctggcttgtactgcggaatgcgcagcagcgcggaacggttgttgtggccccagcagatgtagctcggagcctcgttgccgccccacaggcgcttgtaggagttgacgtactggtcagtgaccgcgcagatttcagccgcatggtacagaatgccggccgcgaactggcgtgcggtgacggacatgttgaattcctggcccgcctcgtagaacgcgttggcgtcgccttcgaacaggctcaagtgggtatgcatgccggaacctggagcgtcggaaagcggcttcggcatgaagctggcgtgaatgccgcgctccagcgaaatctctttgacgacggtacggaaggtcatgatgttgtcggccgtggtgagcgcgtccgcataacgcagatcgatctcgttctggcctggacccgcctcatgatgcgagtattccaccgaaatgcccatctgttcgagcatgttgacggtggcgcggcggaagtccatgcctgggctgcgcggcacatggtcgaaatagccgccttcatcgattggggttggcgtctgggaccaatcatcctgtctttcgaacagatagaattcgatttccggatgcacgtagaaggtgaagcctttttccttggctttcgacagagcctgcttcagcacatgacgcggatcgcccaacgacggctcgccatcaggggtaagcacgtcgcagaacatgcgcgcggtgccttgcgggcctccacgccacggcagaatctggaatgtcgacgggtcgggcttgacgatcatatcgtcttcggacacacgggtgaggccttccaccgcggaaccgtcgaatccgagcccttcctcgaacgcagcttccaattcagccggtgcgatagccacggacttcagcgttcccaacacatccgtgaaccacaaacgaatgaagcgcacgtcgcgttcttcgactgtgcgcaaagcaaactcttgctgtttatccatagtgccccatcgttccatgcgcatgttacgaaagtcgttaacacgcgccgaatatgacgagaccgtccacgttgtggacggccgtatcgtcatgggtttgcgaacaatgctcaacgtgcgacttcaagcgcctcttccaaagtgaaggcgcgcgcatacagcgatttgccgagaatcgcggaatccacacccagatcggcaagttccttgatggcgcgcaggtcatcgagcttggaaatgccaccggacgcggtgaccttcgcatcagtgcgttccgcaacctcacgcagcagatcgatgttcggaccgctcatcatgccgtcgcgagccacgtcggtgaccacgtaacgagagcagccaacggaatccaggaacgccatggtttcgaacagatcaccgccttccttcacccatccgcgggctgcgagggtgtggccgcgcacgtcaaggccaacggccacgcgatcgccgtacttcttgatgacggaagcggtccaatccggattctcaagcgctgccgtgccaatgttcacacgggcggcgcctgcttccaaagctgcgtcgagggatgcgtcgtcgcgcacgccaccggacatttcgatattgaccttgtcgccaagctccttgacgatggcgcgcagctggtcacggttgttgcccgtgccgaatgccgcgtcaaggtcgaccagatgaatccattccgcaccggactcgacccacgtgcgggcagcctccagcggcgaaccgtaatcgatttccgaaccggattcgccctggcgcaagcgaacggccttgccatcacgaacatcgactgcgggaagcaatgtcaaagacatgtctgtacctctctgtgatcaaccgaccgccactaaacggcaatcgcaaataaatgtaccaagtggtcgttttaaaagcgtatatgtcaaagcatcgtcgaaacaatcatcggcgatctcgcaccatcagaacgtcgcaatccaattgcgcagcagctgcgagcccgcttcggcggatttttcagggtggaactgcgtggcgaacagcggaccacgctcgtaggccgccacgaaacggctacgtccgtacgtgcaccaggtcacgcgctcctcggcgtcaccgaaatcaagctggtcgccggacgtgtcggcgggagcggcactcatcgcggcgaaggaatgtacgaaatagaaacgttcaccttccacacccttcatgagcacggaaccttccggcgcctcgacggtgtcccatcccatgtgaggcaccacatcggcgtcaagcagttccacgtcgcccttgatcaggccaaggcccggagtgccggtgccgtgttccataccgcgttcgaacatgatctgctcgcccacgcacacgccgagcaccggtcgcccggcacgcagacgatccttgatcacggtgtctccgcccaccgacttgagtccttccatgcatgcgccgaaagcgcccacgccgggcactaccagaccgttggcttccaaggcctgccgatggtcggaagtgagggtcacgtcaaggtcgagatcagccagtgcacgaaccatggaacgcacgttgccgaaaccataatcgaaaaccaccacggaagtcatgggcgttctccttcttgtgtcattcgttgttctgtgacgcgagtcgtcttgtgtcgcataacgcatgttcggcaggatgactcgcgtttaccgtcgttaactgatgcttgatgtgccgcgtccgaaccgcgtatgctcggcgataatgctcatcgccgcatcccgatcaaggtcagcggaatcgaaaatggtcatatccgcctgttccagcgcgttcatatcggtgatgcccagcatgagatcctcaacgaacggcgcggtggaggtgaatagcaccggcggagcgaaggttttgcccgctctgccttccacgtacatcgtcgcttcgagcttgtccgcacggttgacggcaagaatcgcgggcatgccggcaacgacgatcgtcatgtctttgaccgccgcttccggaccgtctccgtcgagattgcgcagcaccgcgacagcaccttgcgccgatccgatgcattgcgcggaaatgtcggacaattcacagaatgccgacagcaatcgtggcgaggtcagtctggtgatgatcaccgccactttcgcgcgattgccaagcagtccctgcagctcgtcttcgaatttcaacgaatcctcagccgcgttgagcatgtcgtcgacttccgaggattcggaggattcggaggattccgcgttatcggaagcttcggaggaatcgaaagcttcagatggcggattgtccgcccgctcatgcttggacgcttcggcatccttgaattcctgctcgaagccggccatggccgcttccagttcctcttcgctgaaatgcatgccgtcggcgttgaggtcaccgaaatcgtttgatccatcgaatccttggaaatcgtcgaaatcgttatttcgatcgtcgctcatcacagagcgcccttcgtgctcggaataccgtcgacacgcggatccgactcgatggcgaaacgaagcgcacgtgccaaggccttgaactcggcttcggcgatgtggtgcggatcacggccggagatcacctgcagatgcaggcagattccggcatgcatggcgatggattccataacgtgacgcacgagggagccggtgaaatggccgccgatcatgcagtattcgaagccttccggctcgccggtgcacacgcagtacggacgcccggaaatatcgaccacggccttggcaagcgcctcgtccaacggcacggtcgcatcagcgaagcgacggatgccgcgcttgttccccagcgcctgcttcaacgcctcaccgaacacgatggcgatgtcttcgacggtatggtgcgcgtcgatgtcggtgtcacccgtggccttgatggtcaggtcaatcagcgaatgcttgccgagcgccgtcatcatatggttgtagaacggcaccgacgtgtcgatgtcagttttgccggtgccgtcgagattcaggctcagttcgaccttggattcgctggtttcacgaacgatggttgcggtacgcgccatgttgcgactccttttggaaaatgttcggtcctgttgtgttggttcagtcccgtatgtgctcagtcttgttccacaatacgcaacacttcgaccaaggcttcacggaaacgcgccatttcctcgtcggtgcccatgcatacgcgcatccagccgtcagggccgacggtgcggatgagcacaccacgcttgagcagttcgtcgaagatgcggtcgcgatcgtcgaaatgaccgccgaacagaatgaagttggactgcgtctcggccacttcgagcggctggcccttgtaggtttgttccttgagccatgccgcggtctgattgcgggtgtcacgcagatgcgccacacggctgagctgttcgtcggtatgttcgaacgcggcaagcgcggctgcctgggtgacggccgacaggtggtacggcatacgcacgatgcgcacacagtcgataatgcccttgttggcggccagatagccgactcgcgcgcctgcgaaggcgaacgccttgctcatggttcggctcacggcgagattctcatactcgccgatgagttcgagcgcggtgggcgtgcccggatcacggaattcgatgtaggcttcgtccaccacgaccaccggatgcacgccttcggcggcaccggccacttcagcggtttcggcggcgccgagcacgcgcttgagatcgtccatcttcagcggtgtgccggtcggattgttcgggctggtgagcacgatcatggccggcttgacgtcttcgatggccttgatggtggcgtcgacgttcagcgagaaatcctcgttgcggtgcgccagcttccatgtggtgaacgtgtcgcgggcgtattccggatacatcgaatacgtcggatcgcagccgagcgcaatgcgtcctggaccgccgaaagcttggaacagctgcagcatgatctcgttggatccgttggcaccccacaactggtcgacttccagcttgacgccggactcgcgttcgagatagtcgcagaatgcctgacgcaacgcgatatgctcacgatccgggtaacggttgagcgtcagagcgatttccttgactcgctgcgcgatggtttcgaccactgccggttccggcgcatacggattctcgttgacgttgaggcataccggcacgtccaattgcggcgcaccgtacggctcctcaccgatcagatcgttgcgcagcggaagatatgccggaatggcgttgctggaagtctcactcatcgaaggcctgcctgctcttcctgttccttgatggtttccttgttgtacggatcgtcgatgaaacggctcagcacgctttcaccgtgtgccggcagatcttcggaaacggcgaaggcgttcacacgagcagcgagggtcttcaatccctgctcgtcgtattcgatgacttcgaccggcttcatgaaggtgtgcacgcccagaccggaggcgaagcgtgcagtgccggaagtcggcagcacgtggttggagccggacatgtagtcgcccagcggcaccggagagtacgggccacggaagatggcaccggcgttgcgaatcttggcgatcacggcatccgggtcggcggtctggacctcaaggtgttcggcggcatacgcattggccgcgtcaatggactgctcgatgccatcggtgaggatgatgccggactggcgtccgcgtagcgacgtgttcacacgctcggagtgctcggtgcgcggcacacggtacttgaggttctcctgcacctgttcggcaatctcttcgctgtcggtgatgagcacggaaccggcgagttcgtcatgctcggcctgaccgatcagatcggcggccagccagctcgggttggcacccttgtctgcgatgatggcgatttcggtcggtcctgccacggcgtcgatgccgacgatgccggacaccatgcgcttggcggtagcaacgaagatgttacccggaccggtgatcttgtcgaccggatcgcacaggatttcgccgtcctgcggttcggatcccttggcgccgtaagcgaacatggccacggcctgagcgccgccgaccgcatacacttcgtcaacgccgagaatggcgcaggtggcgagaatggtcttgtcaggcagaccgtcggcattgttacggctcggcggggttgcgatggcgagggattccacgccggcggcctgtgccggaaccacgttcatgatgacggagctcgggtagacggccttgccacccggcacatacaggccgacacgctgcaccggaatccaacgctcggaaacgcgcgcgccttcagccagatcggtgtggaacggcgccggcacctgggaagcggacacggcgcgggagcggcgcacggattcttcgatggcggcacgcacttccggatccaactcgtcgacggcggccttcatggcttccaccggcacgcgcaggttctccggacgaatatggtcgaatttctccgcgaagtcacgcagggccgcagcaccgcgggccttcacatcgtcaaggatgggctgcacgagatcggtggcctcgttggtgcccatctcggcgcgaggcatagcctccagcatttcagctcgggtcagcttcttgccacgcaggtcaatgattcgcatatagttttcttcgctcataacgccccatggtaacaacgtgatgtcacgagaacgcccgcgcgtctcaagttcagccgcatagtgagatattcggctgaactttcggcatcatccccacgaccggtcagcccaaaggcagagaactgggaccgaaaaggattttgatttcggcgaacagactcgtgtcgcggcgtacgcggaaacggtcgccgaacgtcagtaccttggcgttgcccttatcgtccatcaaggcgagcttcacttcgcagggtccaggatgatttgaaagaatctgccccaactgctgcacatgcgattggtcaagcgcaatcggcggcagcataatcgtcaccggcttctcatcctgcgcttccaacgtcggcacgttgaattccgtggcacgcatgcttaccgtctcatcgcgtttctcaacctgtccgcgaatctgcaccaccgtgtcgaccgccagttcgggagcggcggcctcatacactttgccgaagaacatgcactggatggagctttccaaatcctcgatggtcacaatcgcccaaggattgcccttcttcgacatacgacggtccacgttcgtgatcaaacccgccaccgtcacctgctggccgtcaggcatattcgccgcgcgatcgatcagatgcgcgatcgacatttcacgcaacgacaccagaatcgactgcataccgctcaacggatggtcggacacatacaagccaagcatttcacgttcgaaattcagcttggttttcttatcccactcctccacatcgggcacattcaccatggcatcgcccatgcccgcatcgtcttcgccggcatcttccaaatcggagaacaaatcaaactggccttcggcctgcttgcgtttcaaaccgaccaccgaattaatcgcagcctcatgaatcgtaaacaaggcacgacggttcggatcgatcgaatcaaacgcaccggccttgatcaacgattcaaccaatcgacgattcaacgcctccatcggcacacgcctgatgaaatcagggaaattcacatacttgccatgatcgttctcacgttccttgacaatcgcatcaaccgcagccttgccaacgttacggatggcgccaagaccgaaacgcaccacatcgccgacagcggaatactcgtacaccgactcgttcacgtcaggagacaacacctggatgcccatgcgacgagcctcgcccaaatacaacgcggtcttgtctttgttcgtactcgcaccctgcagcaacgcggccatgaattccaccggataatgcgttttcagatatgcagtccaatatgagatcaaaccgtatgcggccgaatgcgccttgttgaacgcatagcccgaaaacggcacaagaatatcccacacggcctgcgccgcctcctgggaatacccatgctccttcatgcccgcgaagaacggcaccttctccttggccagcacctcgggcttcttcttgcccattgctcgacgcaacacgtctgccttgcccaacgaataacccgccagaatacgcgcggccgactgcacctgctcctgatacacgatcagaccatacgtttcgtcaagcacttccttcaacggctcggccacttcaggatgaatcggcgtgatcttctgcaaaccattcttacgcttcgcataattcgtatgcgaatccatatccatcggaccaggacgatacaacgcgatcaatgcggaaatatcgttgaagttattcggcttcaacgttttcagcaacgaacgcataccatcagaatccaactggaacacgccaagcgtgtcacctcgcgacaacagatcgtacgtggcacgatcgtccaatggaatcttcgtatggtcgatacgcgtcttgccattcgcctcgatattgttcaacgtatcgcgaataaccgtcaagttggaaagaccaaggaagtccatcttgactaaaccaagcgtttcacacgtatgatactccaacgtggtcgtaaccgtaccatcggtacgttccagcagcggcgacgtattcgaaatcggctcgctacccatgatcgtggcgcacgcatgcacaccggtctgacggatcaagccttcgatacccatcgcctcatccgtgacgcgcttcacatccggatcggaatcataaagctcacggaattcgcgggcctccgcataacgcttcgaactcggctcgaaaatatcatgcagcggaatatccttgccacccgtctgcgccggcggcaacgccttggtgatgcgctcgcccatggagaattcgtagcccatgattcgtgcggagtccttcagcgcctgtttggttttgatggtgccgtagatcacgcattgcgcgaccttgtctcgcccgtacttgtctccgacatagtcaagcacgcgaccgcggccgtccggatcgaaatcgacgtcgatatcaggcagcgacacacgttccgggttaaggaatcgttcgaagatcaagccgtgcttgattggatcgagttcggtgatgcccatggcatacgccaccatggcgcctgccgcggagccacggccaggcccgaccatcacaccatgcgatttggcccagttgatgtagtcggccaccacaaggaagtatccgcagaactgcatctgacagatcacaccgcattcgtaatcggcctgcttgagcacttcgatcggcggatgcccgtcataacgccgttccaagccttcctcgacctttttcaggaacagcgacgtctcatcccaaccttccgggcagtcgaattggggcatgaacgcgccatcttcatgatcgtcgaacatgacattgcagcgttcggcgatttccaacgtattgtcgcatgcttcgggaatgtctttgaacagctcacgcatttcttcggcggatttcagatagtagccggtgccgtcaaatttgaatcgtcccggctcgtcaagcgtggatcccgaattgatgcacagcatggcatcctgagagccggcgtcttcggcgcgcacgtaatgggaatcgttggtggcgagcagcggcgcgttcagttttttcgcaatgtccagcagaccgtcggtcacctgtttttcgattttcagaccgtggtccatgaattcgatatagaaattgtcacgtccgaaaatatcctgcaattcgcctgccgcacgtaatgcctcgtcgaattggccgagcagcagtcgcgtttggatgatgcccgacgggcatccggaagatgcgataatgcctttcgaatatttggcaaggatttccttatccattcgggggtatcgcatgacacgtccctcgagattcgcgtcagtggacgccttcatcagattgacaaggccctcatcggtttccgcccacatcgtaaggtgggtgatcaggccaccgccggatacgtcgttggggttgcgcctgcgatgttgcggatcgatatcgggattccagttggtatcccagctgacgcgggtttgatcttggcgtgcggtttccggcgtcacatacgcttcaatgccgataatcggtttgacgccttccttgaccgcagtgctccacatttcgtatgcgccatgcatgttgccgtgatcggtgatgccgacggccggcatgttgagttctttggcacgcttgaccagatccggaatctttgacgccccgtcaagcagtgaataatgcgtgtgattatgcagttgcacgaaatttccggaagtagccatacgttccaatctaccggtgattggtgacgtgcgatcacacttcaggcttgtcttgtgtgtcgtgcctgccgcgcatcacgtcgagcgcatgctgcaaatcagctggataatgcgatttcaccgtggtccacacatgggttcgcggatggcggaattcaagttgcttggcgtgcagccactgccgttccaatcccaatgcctcacccagctgcggattggcaccgtacatggcgtctcccgcaagcggatgcccgatggacgagaaatgcacgcggatctgatgggttcgaccggtttccagattcacggaaaccagcgtcgcctcaccgaaacgttccatcacatcccaatgggtgatggcttctttgccggcgggcgtaacgcaaaaacgaaaatcggagactttggcacgtccgatcggcgcttcgatcgtggccttgttttccttgagattgccttgcacgagcgcatgataggttttgacgacttcatgttcggcgaactgcctgcgcatttccacgtaggcgaggtcagatttgcacacgagcatcaatccggatgtgcccacgtcgaggcgggatacgataccctgacgtcccgcggcgccgtaggaggtgatgtgcactcccctgtcaagcagactgccgagcaccgtcggaccggtccaaccgacggaagcgtgagcagccacacccactggcttgtcgaccactatgacgtcatcgtcttcgtagaccactgccatatctcgtgcgatcggttcaggctcggtccgttcctcgacaatatcgaattcgacggtttcgcctgattgcagagtcgatgatttggaaatgtcacgaccaagcacgcgcgcctgtccactttcgatgagttccgcggccttggctcgggagataccaagcatcttggccacggccacatcgaatcgtttgccgacaagcgcgtcgggtgcgggaacaagacggctcatgcgttctggtctccggtcgtctgtttcgtctgttctgcggcctgttcgtcaagatccttctggctgaagggctctccgacaaacagcagtacgacggcagcgacgcccgccaccatcaggaaaatatccgcaacattgccgaccgaccatccgtaattgaggaaatcgacgaccttgccattaaggaaaccttcggcatacatcacacgatcgatgagattgcccaatgctcctgcgaaagcaagagcgaacaccaccgtccatttcatggaaatggtacggattgccagtacggccaacgccacgcacgccacgatggcaagcaacgaaatcaaccaggtcatgttggatcccatgcccaaggacgcacccggattatgcaccagcgtgaatgagaggatgcccggaatcacacgtaccgtctgcccgtcggcaagcgccgactgcgcccatgccttgctgatctggtcgagtaccagtgccacaacggcgatacacgcaaagacggccacgcgggtgcgcagccgtctttgatcatttgtcatgatgtcagacacagcctaatctcagtcgtcctgggagtcctgatcatagttgttcgtgtcggacacctgggacacgagctggccgaggaattcggtaagacgtgcacggtattcggtttcgaactgcttgaggccctgaatgttgccttcgatgaccttggtctgcgcttcgagattgtcgcggacctgctgggcgtagtcgtcggctgcggtacgggtcttcgaatcgtagtcgaaggcgcgcttctgcacttcggactcgtattcgtcggcttcgttgtgcttcgtggagaagtaggtatcaccatcctgggtcttctgagcaaggtaggcgtcgccttcctgagtcttctgatccaagtaggtatcaccctcctgcgtctctgggttacggaatcccacaaagcataccgtttattgaacaaccgcactggcgttccggcagtgatgccggtcagcgggatgcgccagaggggcatgtacgcgtccgcggccccgttaagaattttcgcggatggtatcgtcggatcaacggccgcagcatcgctaggaacgcccttgaacgccaccagttccactttttccacaccagttgacgtctcgcggtgataatgcgcgcatatgatgtcattgcggttcttgccgctcgacccggactgtatcgtgacggtctcaggattggtgatatgccaatccaatccctggatcgacgcgcaccctgtgccgatgacggccttgttcgccgactgcatggtgcacgacatcgcgtcgccccattcgaacaccatgtcgccggcgccgaatttagcctggtggattatcgctttgtcctcgctgctgatatgcgcggttccggctttgccatccacaagttcaatcgtcatgactgtccctccctttcggcgtccttcacccatttctcgaactccacgtccgctgtggcggcgaaagactggaacgccttatagcagtccccgcaaagcgtgtatgtgctcggcggttgggccgaagccgccgaggcggatgtcagatggttgacgtcgtaccatgattgagcgtcggcgtttcctgattgcagaaacgccattctgccgcacctgtcgcacgtcagtttcgaataaccggtctgccttcccatacggaaagcctccttctaacttgttctttgatacgtgaatgggccggtcgacggcagttccacccaggttccaccgaaagtcccggcaaggtcgatggccgttccggacatgtagatgcttccgaccggccatgcggtaaggaatatctcctcgtcggtcatgcccgcgctgttgccgggaggtcccttcgggccctgtgggccagggtctcccttctcgcctttgtctcctttgctgccggtcagtgtcgtgttgctcacgcatttgatcgtgacgtccgccacgtcgaccttagagaccgtgaaatacgtcagggtcttcccacctccggtcagtgcgaagaatctctcaccgaccgtcggaatcctgttgaggcatagcgtgtccgccgagaacaccgatgtcgcgtccagatcccatgagccgtaataggtccggccggcggtcaatgcgggcagtcccgtctctccacgcagtccccgctcgcctgtctcgccacgtggaatgcttagattgagggtcttgtcgctgccggcgcccgtcaatgtggccaacgctgacgcgcctggctggagcgtcgtcacggatccgatggagagacccgataggtacgagcccttgacttggtatttggcgtccgattgcgtccggaatgattcaaggtctgcattggcgacttccgcgctgatgacgttgccggcgatgtcgattcccttgcccgccgtgtacgttccgccggacgtcgccgggacagacgatcccgatgatctgctccccgacgactcggtatcgtccggctggcctacctcgtatgtgatgtcgaggatgccgccgttgaccttcgcgatgcgtttggtgaccttcgcggtcaggctcagaccggagttcctgtcagacacgaccacgccgtcaccaagcatgagcgagtcggcatcgttcggcagggtcacgtcgaccttgccgcccgactgaagctcctgcaatcgtttgcgcgtattgtcggacagcgtctgcatctcagcgcacgaataatcgtagacctctgccacttcgtcgacaccgaaaagcgtctgcttctgcgagacctttccgtccttgtccgcgtaccattcgctcacaagcctgttggcaagttcctgctgtcccaagccgatcagatggttcaccgtccgatggcatgtctccgcggtgaaatcgactaggtcggaatccaaggtgccgtcgatggtgcgtaccggctggccggacatgacgatgcggttgtccttggcggtgaagtccaatcgcatgccgcaggattccagcatcgcgctgatgccggtgtaggcgtcgacgtagcgtggattctggaatttgtatccggacagggtggggttcttcgttccggcgcgcaccgtgaacactttctccaatccgattcttttgaccagcgaggaaagcacttcggacaggctgccggaaacgacgaggtaatcctgtttcggatccggggaaagtattttcccgcacaacagtccggtccagctcgttccgagccatgagacgtccgacgtcgctcccgatacgacgcttcttcgatcggtcactcgccctccgatatcggtgccgtcgatccagaaataccatccgagttcgcattcagttcccggaatggacagttcgaaatcgttctcaccgctccccgccgcccaatctagggccgcgccggcggagcagcagaccggtttcatattcgcgtcggctaggataacgtcgaccatggtggtgcccccgagctttcgtacaagtcgaattcgatggtgaatcccccggaccatgtcaggatgttctcaccggagggtatcggctcgaaacagtatgttccacatcccttcccgactcctcgcgccccactggagaaacagtccgccacatccccgttcgcgtcggtcaccttgatgcttttctccaatggcgtgcctatgaccgtcatgtacccgtcggacggcaccgtcacgtcgtcgaagcggtagaggttcccaccgacggtgaactgcgggttcgtggcctgtccgaagatcctgcagacgaatccgcacggggaaaccatgggattcgaaatcagctggatcgttttgggacaggccaggtcggctggcagatcatatggcatgtcaagcacgcttcccgaatccgcggccatcggggcgaaccgctgcgtcggcagacgatgatgccacaggccgtcgcacaacacgatcctgaacgtgacgacggcgagcgctgggctgggtgttggcgtttgcacgttggttccgacgatgaatgctttttgcgtccattcgttgttgatggtgagtgttccgggtgagagcgcctcgacgtccgtgtcggccagtgcttggagttggtcgaggtcgttggggttgagtgttgtgacggttatggtggtttccgtcgcggttctgctggatcctgtgattcctctggtgccgagtgtgtagttccattgtgtggatctgatttcggtgaggttcggtgtccatgttcgttcgcagtagaggtcgacggcgtgtccgtcgtggctgcggtacgtcagcgcatgcatttgcggaccatccttacgagatcgcgatatgtgacgttttctcccccgtcgtgttcggagatgatgttgccgaggtcggcgtgcagtcttgtgatcgcggcgacgacgctggccgtgtccacggtcactgacacgttttgcgtgttggtgggtgtgaggacttcgcgtgggatggcgcgccggttcagcgcgtccatgaagtcgacgccgtaatagctggtggcgagcgcgttttcgacgtattcgccgcgtgcgatgcggccgttgtcgaggtagacgctgtcgctggtcgcggtgcctggcgcccatttcgggtcgacgtagccgttgaaggcgtagcctccgttggcgtatcggaatcggtcgccgtcgtagaggccgccggtggctcctgtcggaatgttgcctttggcgtttttcggacggtatccgctggatgagtatgtgccccctgattcgtcgacgtagcttccgtggatttggaagtatttgtcggcgatctggtagttgctcaggttggtgagcacgctcatggcgggtgagccgtctgcgttgacgatgaatcctttgtcgttgagtttccatccttgggtttggaggaatttgttcatcgcgtcggtgttgtcgcctttgaggtagccggttttgtcgtcgattttggctccgttcgcgatggcgagggcgatcatgtattggtcgctgtccagagtgagggtgccggttttcgggtcgatttccacgtttgcggcttgggcgatctttttcatcaggtcggtgttgtctccgctgatggtgacgtgcttgccgtccggtgtctccttggccgcaagtttgacctgttcgaatttggcgacggcgtcgccggtgactgtgacttcgatggttttcgaatccggcgtgttctgcaggctggcgacgaggtcgtcgaccgctttgcgcgtgagtccgtaggcttgtgcggcggcctcggcttcctccggtgttttgccgagggattgcatgaggttagtgaacgcgtcgtgcgccttgtcgatgttcgggtagatgtcgttgaggctgtctccgttctgggcttgcgctttggcgcatttgagcgccgcgtcggcgatgtcgttcaacgcgctctggtttttccgtccggcttccgtgttcaggtcgagggtcttggcgttcttcccgatggtgtcgttcgcggatgcgatcttgtctgcgaggtcgatttgcgcgtccgacgagctgatggcgaacccgtagtaggtcttcatcgcgtcgatgacttcggagagcgcgccggcggtgtcgctggcggcgtctttggtcgctccgaacgcttcagcgaggatgtcgtcggcgctggccgcgtcttgggagctggatgccgactggtcggcggcgtcggctcctgtcaggagcgctccggtcttgtcgaggcttgcctgcgtggtctccttgtcggcttgtgcgaggttggctgctgagatttcggcgtttttgtagttgccttgcagttccgtgagactttgggagatgacgtggtattcgttgcccgtgaccatattgccttggtcggcgagtttactgcggtatgcgtcgatctccttgtagacttcgctgacggcgtttttctcgccttggatggctttgatatacgtgctgtgtttgataccgaccttgtcgatggcctgccacaagttgtcgtagccggtggtgagacgaccgagccagttgtcggtgaccctcgcgccggacgagtcggacagcgccttctcgtagtattgcgcggcggaggttccctcctgcagggcgttcgacagttgcgtggaccgctcctgggctttctgctgttcggagatgaacgctccgaggaccgccgttgccgcagtgatcgcgacgccccacgggccgccgagcaggtcgatgacgcccgcgccggcctgcttcacgccgttgatcgctgtctcgcccttgccgagggtgacggttccgttggcgatgtcgccgactgtggcccccatggccgagttgatctgggtcagaccggctgcgagctgcggggcggcggtcttggcgcgctggatcgggtcgacgagcagggcgatcgcgtcgccggccgtaccggatgacgcttccaatggcgtcagtgccttgtgcaatgcgacggctccgccgatcgcggcggtcagagcgatcgcgccctgctggacgggagctggcagagacgcgaacgcgtcgacgagcgtgtcgacgccttgcacgagggtgcggagcgctccctgcgagccttcgccgagattgatcatgagggtttcgaaactgccggagagctgttcgaggtcgcctttgaggttgtcgttcttcttcgcggccacgtccgcagcgaatccactgtcggacacagccttcgtccatccggcgatgccctccgagccttccgaataaagcacgttcgcagctcgcaccgcgtcggagccgaagatgacgctcaacgcggcgttgcgctgctcctgcgtcagaccgcccagagacgtcttcagctggccggcgaagttctccagtccgacgaactggccggacgcgtcgtatgcgctgatgcccagctcgtccatctgcgcctgcgcctccttggtagggttggacaggcgttggagcatcgtcttcaacgaagtgcccgcgtcggaaccgatcatgccggcgttggcgaacgcggacagcgtgccgaccgtctcggtcatgcccacgcccatgctgttcgccatcagaccggcctggttcaatgcgaggcctaggtcgtgcgcggatccgacggccttgccggcgccggcggccagcgcgtccgcgaccttgccggcgtcagctccttcgaggttgaactgcttgagcgtggtgctcatcagttctgcggcctcgccgacctgcattccgtcggacgcggccaagttcaacgctccggacaggccgccggagaggatgtccgcggtggacaggccggccttacccaacgcgtcgatgccctcggcggcctcgttcgcgctgtagacggtgtcggcgcccgcctggatggcggcggcgcgcagtttctgcatgtcgccgtcggacgcctgcaggtcggcttggatggtgctcatgctctggtcgaagtcggcggccatcttcgtggctgacacgcccaacgccacggcggccacgcccatgcccgccatgatgttcgtggcgatccggctcttgctgcccggcttctccaacgcggtggagagcttctccgcctgcgtgctcgcggcggccatcttcgtggaatagttggaggtgtcggccgacaggcggatcatgatgttctcgttcaacgccattgtcggcatctccttcttctagtttctcggtatgaggctcgcggtctgcgcgtgcggtgcgagcaccgtgccggattcctcgtatttgcgcatggcccgttcgcgttggaacgtgatccagcaggtctccacctgcgctccggcgaacagccggtccactttgccctggtcatggcacaggtcggtgctcaatccgcacagcgggcattcgtggagccgctcgtacaggtcgagggcacgcatccatccgcgttccgtctcgtcccattcggcggggtcgtcttccgacggtgtccagccgagccatcgtttcaggctgatgccgagacgtcgcgcgcaccgcaggtcgttgagcagggccggcgcgtgctcaagcctgtccgctaggccagccgcgtcagttcttttgggatttcgaccaccggggtgttgagctcctgcacggtctgcatgagcgcgttgacctggctgtcggtcatcgaatcgatgagcttggcgaactcggcgccggtgaactccacgtcatcgccgtcggcccattcggcggattcgagcatgagcggtgcggcctccttggcgatggcaggaaggtccttgaccacacgcccctgcacggtcttggagtttttgagggtgatctgcgcccactggctggagttcagtccgcggaacgtgaccacgagcgtcttgtgttcgacgatcttcagcagcgagtccagctgtttgcggacggcgtcctgctccctgcgacgttcggacgcctccgattcggtagcatccgccgtggcgtcaagttcgagaatcctgttgccgaggcgcacgctttccgcgagcgtctgcatgtcggtgatgatgcggtgttgtgccgtgggtcgtgtgatggtgatttccaagtgttcgtccttgtctgtccttcggtccgttcggtgttgcctcgtcccgcgtcggactggtctggcgcgggacagggcgtgcgtgtcggtcatgcgacggtgatggtttcctctttgctgcatgggtcggcgctgaagttgatggtgctcatctggcggctgttgatgctgtgggctacggggattttgatgccgatggtcacgaggtagacggagatcacgtctcctgccacgaatggggcgtccacggtctttcctcggcggcggacgatccagcagcgtttgccgcaggtgagtgtgtcgacggctttgttgaagttggcggcgtcggaggtgttgacgttgtcgatgaggtccatgctgccgtcggagaatttctcctgtccgggaatctggccgacggtggcggaggattcgcggtcgtcatcgaccatgtcctggctgtgggtgaggtgccagccggtggcggacaggtatgggctcaggtcgaggttggagccgctgttgagttcggaggcggttggtttcagatagtttttgatgccggattcctcgaccatgatggttcggaattcgccgtctccgaggtgtgctgggactttttgcatggtgtttcctttcatgttgtttccggccagccgatccgccatgtgagcacgcgcatcatgtatggcgtgccggtgtccgggtcggtcaggtcgcttgggttgctgccggtgtccacgtctccgatgagcggggacaatcccggcatgtcggagagggctccgtcgagtctttccgtgagatgcgaggcgagtgtgtcgacgcttgtctggcttcgtgcgacgatgcggatgtcgagtctgccgatgtgcaggtcagtggattggctttccgtgtgcgttcggctggtttcggtcagtccgatgacgacccatggtggggttttgccggctggagcgatgccgtccgtgtacacgtcccagccgcggatctcgccgacgagccggaggacggattccctgaccttcaggaagtcggtcataggctcgtcccggcttcctcgacgtatcgggcggtggtctcgaactcctgttcaccgtgttcgtagaagcggtgggtgcctcctccgccatgggcgcctccgaagaacgcgatgttggcgaggccgccggtggtcttgaccggcgcgatgtctgcctcgaccctcatgccttcggttttgatctcgtaggcgatgggtattcggcggaagctcgaatggctgctcgacgcgagatccgctttgaccgcggttttgatgttctgtgcgcctttcttgacggcgttggccgctttgatcggcgcgcggacgctcacgacggtgagttttctcgccagttcgtcgagctcatgggagtcgatgcgcactatgagcctccttccatcgggatctcctgcacgttccatcttctggcggtggagtgcgtcttttcggattgcatgttcacgagccggtatcggcgtccgacgagtgccgggtcggccgattccacgacggtcgcctcgtatccctcgcgcggcgtcgtggccgtgacgggaaggtggaggtagaggccccattccgggacgaacgctccgactgagccgtcgccgttcacgttgtgctgctgtccggcgatgccgccggccgtctgcacttttcccttgccgtcgtagacgacttgctgtgacacggtttcggctccggtggccgggtcgaccgtgaccgtgccgggcgcggtgacgcgtatccggtcggtcatgaggttttccgcccatcggcgcattctcgtcagcgtcctgttgctcatcccgtcaccttcatcatgaggaacggttcgccgtcctcgtcgtccgtccaataccggttcatgtccgtgttggcggattcgtttctggtggagtgcaggattccgaggccggcgatgaccggggactggtcggccacgagctggtcgagcgtctccttctcgctggcggtcaggtaggcgccggcctcgtcgaccttccggcttccgccgtccatggcgtcgtcgatctggcgcgtccactgcgtttccgcgttcggattgctccacaggcggccggcgcaggtgatgcacacgtcctgcaggtcctccggcaggtccggtccggaccattcgcgccgcgtgtatgcacggatgcggttggacgcgaatctgagcgccatggcggcgcgtttgccgtcggccgacttctcgtcgatgtcctcgccgagccattcggccagctgcgagacggtggcgaatggttcacgcgccatcatgcgcctccccgtcatttggattcggaagcggcgaccgcgtccgggacgatgaatccggcgggatactgcgtgcccttcttggccacgcgggtgacggggttagcgacctggaagccgacgcgcatgaccactcgcatgatctggctgtcctgctgcatcgcgttgtacacgatggcgccggcggagttggagatgacgccctggtcgaacaccttgtaggtgatgtcctgtcggatgccgacgatgaatttcgaccagtcggcggccagaagcaccgccttggaatcgtcccagctgccgttgaggacctcgttgcacgggtatccgtacaggttggccgactgcttgtcggtcaggttcggcgtgtagatgggacggttgttcgcgtcgcgcagttcggtcagctcccagttgaggccgggcttgctggcgaagccgttgattgcgtagccttccttcgcgagggtcttgccgagggacgccacgtcggcggcgaggtccttgccggtgccctgggtgatggtgttcttggcgttcttcgcgccggcgaggatgtcattgccccacgtggacggcttgtccacgccgaagatggcggcttggtcgatcttcttgccgaacgcctcggcgatcagcggcttcatggtctcgaacaggttgatggacgcgtcctcgcgtacggagtccggaatcgggacgagtaccgcgagttcctcggcggtgatgttcacgtcctcccaaccgctcttggtggtctccttgagtccgccttcggacacccagtacgcttccggaagggtggcgaggaccggctgggtcttcttcttggcactcatcctcatacgcttcgcgcgggtgagcatgacgctcttctccggcatggtctggatgatctcctggctgatctcgtcggggatgagggcctgtccgaggtcgttgcgctggatgctggaattgaaattgtctgccattgtctgctccttgtatagcggtcagtcgttgttgtcgaaggcgtcgcgcatccagtcggacggacgtgacggcttggtcgggtccattcctcccgtgggcttcgcccggttcgccggattgcgaagatccggcttctgctgcgccgtggcctgcgcggcgtatcgcgcggcgagcttcgccgccctcgcctcgatttgctccggggttccctctcccaccagttcgcggtcttcggccgtcaactgcgggtgagcggcgagcgcgcggctccaggcgttgtcggcttcgaggcgtgcgatcttctggttggcttcgtcgaggtctcgttgggttttctccgtttcggtgagtttggcgtcctcgtatgcgcggttcttgtcggcgagttcgccgttcttgtgtttgagggtgccgttttcctcgcggaggttctggatgagtttccatgcggtggctgggtcgaactgttgtccttcgcgttcccatggggcttgcggctcctgctggccgtccgtctgtccttccgcgttgttcgcgtccggttcggactgttgggcgccgtcgggttcgttctggacgttgctgtcctgctggttgtcgtctgccactgtgggctccttccttttgttgccgcccgtcctgcgggcatgaaaaaagcccgtcggggcttcccgatgggctaaagatgtgatgttcggcttttaggcttccggcattggcttgaggtttctgcggacctcgttggagatgtacttgtcgaggtccgtgttggcttcccactgcgcttcgccggtttcgacgttgacgaggatgtatgccggcggaccgtagcatccgccttttgccattcccggccaggtgtagtagtagagtgccagtccgccgtagattccttcgggctcgtgcagtatgacgccgtgatgcttggcgaattcgtcggcggccttgtccagttcgcgtcttgttttcatcgtcgcatcgccttcttcggtttgatgatctcgtacgcgtggtccctgacgatgtccttgtcgtcgacacggaacatgcgcacgcttctcacatcgatgatatccctatcgaggtagtcatccaatctggatattttgccgttctgcgggtctatgacgatgggttcgcctccgttggtgcgtgccgaggggcgttcgatgatgacgatgtggccctgctcgtgattgttcacgtatccgaaatgcatgcaccagcgctggccgatgccgacatgccgttcgatcctgtcaacgacattgccgcggttcgggctgccgacggcgaggatacgtggatgcagcccggtcgcgcggtccacccacatgctgttcgggttttccgacagtctgtcctgcgttgagctggtcctcgccctggcctcgacgtcgtagcctttccttcgggcgtcatatgcgacgacgcacgactggcagttggtggagcatccccacttgtggtcggcgaatccgggattggacgttcccctgtcggcctgcgtgatgctcatcggctttccgggatgcgcgaggaccttggagagttcggtttcgcgtttcctgaggacctccctgcgtttttcggcgcgttccttgctggttttcgcacggtattcgggcgtgcttctgtaactatgcgagtcacggtagtctccggtcctgcgcatgaccggcagaatctggtcgtatgttctcgcggtgcctttgggcaggctttcggcggcctcgtagtagttgtcgatccactgtttctccttgtcggaggggttccagtcgccgtacaccacttcgacggtgcatccgcaatgcggatggaacttctcgccgtccgtctggcggcgcagggccttctgttcgctcgtgtacacggggccgcggctgcagagcatcgcgcagaacgcgcatggatgcccgtcggacacgcgccgccatccgatggcgcgcgcgtccttggcggcccactgttgcagggtgaggcgtcctccggtgagcacggcctcgtggaacatgccgatgaacagttcgcgtgcggccgcgtacgcggcctcctgcgtctgccccatggccacatgccacaggatgttcgccacgcctccccattcgaactgtttccccgtttggctccggttgaagcggggcactccgacctgtatgtcgccgtcgcccgtctcggctttgcggaagcgaggcaggtattgtgcggccgtgtcggcgctgaccttccaccattgtccgagcaggtcgagcatcgccttcttccagatcggctgcgtacggtcgagatcattcacgtcgagggtgttgtcccacacgcgtcgcatctggctgtccgcggtgatggcgagcgcgacctgtcgtctgcggtgctggtcggtcaggagggtgcctttagctgttgatgccatcgtatgccccgtttccgttgagttgtccgatttggatttgggttgcgatgtcgtcggctgtggggtgttgtgcggcgtattcgcgccatgcgtcggcttgtggtttggagatgccggggatcatgtcccagacgagttggtcggggacgtggagcatttggacggctttgccgagtgcgtcgactgcttggctgatggttcttgtgtcggtgtcttcccatttggggaagaggtggaagttggcggcgtcgtcgggtcggttttcggcggctgaggcgagtcggagcgtgtccatgtggctgatgccgaaggcgcggcggcgttcgttgcgtttcgcgtagaagcccgctctggattcctcgatgccggcgtcgccgacgttggtcatcttgccgaacgccgtggtcggggtttggctgacggcggcgagttcctcgacgtcgctggtttttgctgcgacgatgttggcgaggtcggtttcggggaggcttccgaatttcacgtccatgcctccggcgaggacgctgtcgtgttcgatctggagttttttggcttccttttccgcttcggtcagtccgctcatgtcgaggccggtggcggttttgactttccagctgttgtagtgctgggcgagcatgcggtcgtagttgtccttgttcaggcggctggccatgcggatgtatggttcgacctctccgggcacgcggccctgcaggtcgcgttggttgcagtacctgacgatcgggcataccgggttgccgtccggcgcggtcacgccgtgtggcgtctggccgtcgaattgccatgtgccgccggtcttgcgccatgtccagatgttccgtgagtcccagagctggtattcgacggcatggtcgtcgagtttgcggcgtcgcatgaagatctgcggccagttgtcggatgcggggtcgtcgtagagggcgatcgcgtcgcggggactccagcagtcgatgcgggcgtggagttcgtccgacgattcctcgccccggaccgccgtgtatgcggtgccgtaggcgatggcctcgcggtgcagtgcgatctggcgttcgcccatgcggttgcgctgccatggctcccagaagcgttgagcgtccccggtgtcctgcgtctcggagtccacgccttccaggtagagggtctgggcgagcgtggtgacgacgaggccgagccatggggtctcgcccatgtcgcgcagcatgcggtgttccatggtcgccccggcgttcaggcggatgggcttggggttccaccgccaccagcggtcgattctgttgagtttcggcgtctcgttgtcgaacgccgggatgagcagcgtgctcagcgcttcgaacgcctgcttctcgttgtcgtagccggtggtcaccatagctgtcctcctccgcttctggagttcctgttcaggtattcgcgtctgaccatgcgcgctccgatggcgcatatcgcgaggtcgatcttgcgtttcgactcgcggctttccttggcgatgctcatgccgacccttgtgggctggcgtctggcgttgagcatatgcaggcgcagcctggcgtcgccgtcgtgggggaagtctccctccgcgatgtcggtgtacgcctggtcgacggcggtgacgaacctgcgttggatgtccgtgttgatcatgtcgaacatgacggcgtgcctgtcccggccggacgggacggcccatgtcttgagccggcgcccgtagtcgcggtgccaccggtcgaacagggcatcccagtatctcaggcctgtttcggagtccagcacgtggctggggtcaccgaagaatccgaccacgtcgtacgcgtggaacgccgcgcgcaccgcgtcgtcgacgctttccctgggcacgcgccagtcctttcctcgctcaccggccggtttctgccacaagcccaatggtttgacgaatccgtcggagacgcggcaggccacgagcgccgtgctgtcgtcgttgagcgagcagtcgaggaacatgctgatgcgctcaccgtgttcgagcgaaagctccgggtgttcgttctggtcccattcctggtgggtgacgaacgcgtcttccggcgcggtggactggttgtaccatttgcgccgggattcgctcaccgggttcttcgggttgaggatttccttgctgatgcgttcgatggacagccaggtgctgtcgccgcgcacgtcctcgatgaccttgcctatcgtgtcctcggtcatcggactgtccggcgcagcttccaacgagtcgtagagcagtccgaagtccatgtatttcggacgcttgccctcgtcgtcgctgtcggggtcgccttgggttccgtcccatgcctcgcgcaccctctgtccgacgctgtcctcgccatcgcggtaggcgttgcagatgtcgagcatcttgaccgcgacgccctcctcgcgtttggccgcgttgccggaaagcacgccgtccatgtcgctgccgccgttggacgagttccagttctgcgtctcgttgcggatcacgaatgtcggacgtccgccctccaacgccaacggcgagctggtgaccgcctcgatctgccggctgtcccccatcgcgtacatgttgagcttgcccaattggatgccgtagtacttgcgtgtggacgccggcaggaggccgggcagaagcttcatggtgttcttggtctgttcctggctgaccgcgcacacctgcacccacgcgttcggctcgtccctgccgaccggatctccgctctcgggatcccaatggtcgaacgtcaatggggcgaagcacgcgccgcatgcccctccggccgccatcgggtccttgccccagcctttgagccgctgcagcacggcgttgtcgtgcaatgggcgtccatggtcgtccagggcccagaaccacagccagaaacgcgcttgttcgctggtccacttccacggcagtcctttggatgagtcgcgaagccagtagccgctccatccgaggaactgccagccgagcgtcacccgcggaaggatccacccatgctcgtcacggcgccatgtcggtccgatgagtatcgggtcagtgttccattgcggcgccggctcgtcggcgagcatgtcccgataccagtcggagatctcgcggatctcgctttcgcggcttgggatgaacgcggcggccttcaggttgctgcgtagtcttgccatcagccgtaggctttctcccatttgctgtcgtgccatcgtttgttgacggtggcgcgcatctggctggatctgccgccgtccgccgaggcgtcctcggactgttcctcgggttccggcatgtcgatgcgtttgagcaggtcggccagatgggtctcgtcgcggcgcagttcgggcaggagcgggtgcacgacgagctgtccctgacttccctcggtggtgagctcgtcgccgagggccctgcgaatgcgtccgatgcggtcggcggtgtagcaggcgttctccagtgtgcggtactcgctttcggtgagctcccatttcgcggtgatgtcgcgccagagccgttggccgcggccgtttttgatcagtccggccggcatacggtgggaggccgcgtccttggccatgcttcctcccttcgtaaggtcatccgagtctgtcgagcaggctgaaaaggaacgtgaggtcggccagtctggccggcgaatcgcggaacgtgcgtcctgtgaccgtgatgtagcgtccttggctgtaggcttcggcgttcatgatgccccgcaccctgattccggcgcgttccggcatcagtccccagatgtgcaggccgtcgccgccggggcttatctcgatccatgtctttccctcgaccggcgcgatgaggcatttggcccagtcggcgaggtatccgcgcgagtcgtagcagtggtcgaggtcgatgcaggcgattccaccgcccagcgcgaagcccagtccgtcgcctgcggtggacgcctcggccgcctcgaacgtgctccacgtgtccggatcggtgctggacgccacggcgccgtctatcgtcagcggaattttcgtcgttccgtcgcctcggaccaccttgcgccatctgacccatcggtcgaccaatgccatgcgcgccggagggttgagccttttgcggttggcctgcttccggcatgcgtcggagcagtagcggcggcgtctgccgcgaccggtctgttcggggagctcgattccgcatgtttcgcaagcgttcatactccccattatatttgtttttctctcagaaaacgctgtataccagtattttcaaccgtttttattatttcgtgacatcagtaaaaaacgtttgtccggaaaaacgtggaaggcgtcgcgaaaagctgtgccatgcccgtacgtcgcaaaaacagggatatgcggaactatctcgatgaaacgatggaaaaacgtcgaagcgcgaaaaacgggacggagaagcgtacgtacgacctgagttgctatcggcggttggggccttggcgccggcggagtcctcccccaccggtatcgacacctcagtcagcggccgatcaggccagggtgacgttcattcggatgctttctcagtctcttgtatcttctgttcctttcagcgctctcgcgcgccgtcttcgccttgtggcaagcataactcaaccattgcagattctccaaggaatggttgtctccaggaataatgtgatcgcaatccgttccgattccatcacaatccctcgcatgaatcctcgcttcgcagcgtccatgcgcccgagccttgaccatggccctgcggctctcccaatcgtcgggcagtctgaatcttctgtcgctgctgttccaatgcatctgattgcgcatatgccaccatccgtccaccaaggtcaggtgggataggtgccttcggcgggattcgaacccgcgcatacacgtagccgcaaggaagagagtttaagaactcgtggccagtgcgatctaccgctgatttctacgaaggcatggacaggcggtttgagcatcaccgcatcacgtaaacgcgggattggcttgcctgccgctgttggtgtatgcccactctgacgtgggtgggcggagcgtgtccgatatgccgttcggacaggacgggcaacaacccagggagttaggagaatccaaggtggatatgaaaagggttcaaaccgtatgtcttcggtttgaaccctctaatccactgacaattatgccttgcacttcgagaaacgtcaaatcgagtcgcgtcgggaaagctgcccgtgcacgtcggcgagacggtagagcggctgtcccttcccgttcctgccggccggttggatcctgccgcgactgcgccacgagtagatcgtgttcacgctgcattggaacccgcattcgcgcaggagtccggcgcattcctctgccgtgaacgctttgccggatgcgatgcactccttcaggaagccgagccgcacgtccaccacgcggtaagtgccgccgcatacggggcaggtgacctcgaccgcgtcgatgggcgccgacagttcgacaccgcacaatgggttcgggcatctgccgatgccgtgcttggaaggcggcacgtcgatgatggacaaggtcttgcgcgccaaggattcccagtcgtgccagatgatgtcgatgtccggaagccggttcaaccgtggacatgcggcgcagacgctcaaacattccagcagggacgggtggatccggccgttcgcccatggcatcgccgatggcgcgtacagtctgcgccacaatgcgaccgccatgtccccgatctcctgcatgtggtcgagcaccggcaatcggattggcgtcggtgcggctggaaggttgacgtgtccaggctggcggcctccgtagtgcgcggtcgagtccaggaactcatgcagcgaatccaaccatgatggatattcccgcagccagccgcgcatcagcccatcgcatttcgcgcacatggtgtcgccgacagcgcatcctccgccgcagacgaggcacacgccggcgagcgctggtgttgtttggctggtgtttgttgtggtgttggtgttgtttggctgggattcgttgttttgttcgttcatttgttcgattccctccggcgtgatagtctggtttgtggtaatgccagagcccggccggaaggtcgggttctttgtttattcggtggcggagtcctgttcttcaaggtcgacgtgttcgagcttggctctatggcggagcagaccggcgtattcgtccatgacgtcaagctgcctgctcaacagaccgatcggacagacgagctcgaagtcaatcgtgccatccgcataccgctgcagcatgtccctgagcctgccggcacgagcggtcaactcacggtattcgacgcgcatccgctcctcataatcggatccgtcggcgctcgcgggttgcacttggtcggcggccgtgagcacttcgatggcctgacggaggcatccttggcggatccattccggtgcggtcagccattcctcgtggatgatctcggtggagtccttgcgcagcgccaatctgagtccgaacaggcgttcggccgcagcttcggttctcgcgtcgataggcgggagcggcggttccagtgtttcctcgctcatttcgattcctttctctgttgattgtgcatggtcttccgggtcttgtgtcgcagcagccacaccgcccatccgggcggttcggtccagatggtcagatgcgaggacgcggcgtacagcttccaccacctgccgcagatgacgcaatgctctatcctgcgcaggctgacctcgtattgcgccggaccgatgccattgctcgcgcaaatgaatgtcccgaccgcgctccggcacgcatgcggcgagcgccgtttgttgcgactgatgctgttcatcattccgcctccttctcaaggacgtagacgattgtcggcgggaatgatggctcatagcatatgttcggcttcacctcgtactcgcctttgccgccgagtcccggcaacacgtcggtgcgcatcacgctccatccgtcggaaagcagaccggcgagcgcttccgtattctgcagcttcagcgtgtacacgtctccgcttgccgcgtacataaccggcactaccttaaatttcctgctcaccgctccgtctccttctgctcgtccaaccacttctcgaaaagccggtaaatgtccagcgggatggttttgaccggctggaatttgagccgtcgcatgcagtcggcgcacacctcggtgagtgtcttcgcctggccgccgtagatgaggcctatggaatagacggggctcgagcaccaccggccgcacaaatcgcaggtgtgcatgtccatcgtgaccaactcgtcacgctgcggcaggaacggattccccgcacccctttcatccacggctgcggcgagcgccttcctgatctcgtccctggcgtagaggaaggcgttgtgtcgggtctgggcgtagccgccgaaggtggcattgccgtcccttgtcgcggcgcggacggcttcgagttccgggtcgatgagtttgttgagcacgccgatggcgatgtctgcttcactgtctttcattgttgttccttttccttgtcgtgttccgccgaccatccgagcatggcgttgacggcgatttcgcacacctgccgttcatagtcgtcctctggtgcgatacatacggcgccgcattgcgaccagattttcactgtggctccttgtctgcaccgctcacatggctccagtcgcaggacaggccggcctgcttgccgttcgtcgagtagacgatgcagtccacttgcctcgtgtcggtcagggtgacgacgcattccgtgaatacgtcggcgccgacggagcactgcgagtcgacggacctgacctcatgcgctggcgtggaaggctccgacgcgcttccgcatcctgcgagcgcggtgcagaggatgagggttatggcggtgagggcggcgcagatggtgtttctcattggtttcattcctttccgtagatggcgaggcttctgatgccgtcgcccatgctgttggaacatgtgttcggatcgtggtcgatgatgtcgtttccgatgccctggaagcggaggctggcggtgccgtccggatgtcggatgagttcgagtcgtccgtcgatgatgacgtcctggtctgtttgggcgatgcagcggcggccgatcaggatggccgggtcggccgaccgccatttatgcagcgggacgttgacgctcaccgcggctcctcgctttcgtttccgccttgggcgtccttggccacgcgcctccatggctccttgccctccatgggcatctcgttccatgggcgtggatggcgggccccgttgctataccagcgcaggtagatggcctcggccaccttgttctgcgtctccagaccgatcggaatggtctcctggtctgccatgatggctcctttcagtatgtgtccggttccttggcgatgcgggccgcgacgatgtaggcggcgagcgcgacgcagaaggtgaggatgatgagcaggacatgcagggcgagccattggatggggatccagtgatggaggccgtagccgatgatcggccggatgatggcgtgcggcacgagcagcagcgcggcgagggagaacagcgtggcgaaccagtcgccgacgcggttgaagatgcggttgatggtctgtttcattccgaggttcctttcatagttggtttggcacggttcatggcctgttagccatccagccgatcaggatggcggcacataggaggatcactgccgagatgctcatcaccttgctgcttccgtggcgacgtatcggaccggatgtgcggccaggtggcggatgatgcgcgcgtattggcggatgtcgcggtcgaggcatgtgccggtgcggtgggcgctggccacaggcgtctcctcttccggtttcacatcccagccggcggcttcgagactgtcgcggagggtggccatgtcgatgcggtggtagtgcagcgggaggttcgggcagagtcggccgatgaagtcgaggtcgaactgcgggttgctgccggccggatggagggtgaacgattgcgcgaggctgtcgacgtattcctcgagcgcgttcgccgccgcctcctccgtatatccgccgtcgagagcgtcttcgagcagtccgttggcgcagtgcatgcgccacgccttgaagttctcatcggcgatggagacgtttcgttccgccaatccgatgacgcggtggaaacctccgacgcaccgcacgcctctcatgtcggtgcaacgcatttccacctcgaggatcctgtcatggtccgggtcgagccccgtagtctccacatccatccacagcagcatgtcaggcttgtcaatggtcattccgtttccctcccatcgatgtcgagtgtggcgacctccatggctgtcagacgggtcgcggtgccatcctggttgaggcgaagccatatcccctgccagtcacgcaccggggtggtgcgcggatccctgccgaacgggactatcagcccgaggcgttcggcctccttcacatgctgatggacccacccatggcagccggtcgtgcccgaaccgcacagctcgacgatgttggccggactatgcctcacatccggatccgccgcccgccgcaactgacggtgatggccggagcgtccaggccaacgagacgggtcatggatgttcgtcccacagcgcaggcaatgccaaccctgccgctccaaagcggcacgcttcgaatcatcgaactcactcacaacgcaccccctcctgcatcagaccgtcaaccaacaccaaacacgaagtgcaattggccctcagcccggccgccatcgccacaatgccgtcatccgccctgccaccggcgagcgctcgcagttcgattgtgctggcggtctgggcggtgtcggtgaggagttgggcgagtctttcgagttgtttcctggtcattggttgtcctcctcgtcttcttcgttttcgtcggagtcggcttcgctgatggcggcgatgagctggtcgaggtggctggtttcgtcgtcggtgggcgtgtagccgaggtcttggaggatctggtagtagccggggatgcgtctgctggtgtcgttgacggtggtccagtcggtcggggcaacgaaccattcgatgcgtgcggcgaggatctgcaccgcccataccgcccagtcgggttcgtcgaggtggtagcggagttcggcgagcgcccgttccggttcgatgccgctgatggtggcgaattgttcgacgccgcatttgtcgttccatgtgctcagcgcctgcgtgtagccctgcgggtccgggtcgatgatctgcaggagtccgagccgggccgtggtttcgacgagcttgtcgcgtttgacgccgtggaggttggcgtggagccatgccatgcgcttgtctgcggatgcggcggcgtattcctcgagcgcgtgccggcgggcgtcgcgttcggcctgttcggcggcccgtcgggcttccttttcggcgtcggcggtcttgtcgatgcgggtccagaggtagacctgctgcctgtggatggatacggctgcggggttcagttcgcggatcttctcgatggcttcttcgggggtgccggtggacgggaacatgcagccggcgtatcgccattccgggtcgctgtagggcttttcggggtcggggatgaggttgatgccgctgtcggactccacgaggagcgcggcgaccgattcgacccattgccggtcgttctcatcgcgttcgatgttgcggaggatgtagtcgaagttcgaggtgccggccgcctgcgcgagcttcttctgcctgtccggctggccgtcatatcgcgcgatggccacgagctgaccgatggagatctggccgaaatcgtcgcggaccgctctgacctcggtcttgatgctggcggccttggcgcggtcacgcacatagtcgccgcttcggccgagccggtgggcgacgttggcggtggtggctcccagatcgagcatgccctggatggcgtcagcctcctccaacacggtgagctgttcgcgctggcagttctcagtgaccatggcctccaactgctgcaacgggcctaagttaagcacgaaacacggcacggctccgattccggcctgcttgcatgcggcgagcctgcggtggccggcgatgaccctgtagcgctcgccgttggggacgacgctgaggggcgtgaggaggccgttggttttgatgctggcggcgaggtcggtcacgtcgccgatgttttttcgtggattgtcggggtgtgggtcgatcaggctcgtgttgatgagcttgatctggttgctttggtagctgctcattgcttctccttgctggtttcttggttgttgagttcttcggcgcacgcctggcatgccttccaccattcgcttgggttgccgttgcggaggcttccggtgtggtcgtattcgtcctcgtgtggatccatgagctggtggacgtgttcgcaggtccaggtgtgcttgtgctggtgcgtgggtgtgatgggttccggcgcccatgtctcccactggtcgcggagccatgtgttgagccgtgggatgtggccggtgcggatctggccgtcgttgacggcatgcttgtagcggcgcagcgcggattggagccgggcgagctggacgtggtttccggcgatagccgcgtacagggctctggcttcggcttcggtcttgcggcctttcgcgccgacggatccgggataggcttcggcgaaatggtcgaagccggattccggcgtggcgggttgcttcggtttgccggcgggaggggtcggagagggattatcggtataggtatcggttttatgccatgtttttgcttggctgtcctctagcaacttgctagacggtttgctacctgtctcgctactgttttgctctccgtttgcttggctgttttccggcaagtcgccagacgtttgcttggctttctggttggccgccttgcggcgtcctcccttgcttccggcctttctgcgcgcctcgcgttgctcttcggtcagcatcttcggctccctgcagatgccttcggcgtagacggggcgccatccgccgtcgtgctcttccatgaggcccgagtcgatgagctgctggagctgtttcggggtgccgccggcgtccttgagatcgagcttgtcgaagtatcctggatacgcggccgggtccttggcctgcatcgagacgcctttggagtggatgacgcacagcttgacccacagtcccacggtggcgagaggcaggcggcggatgcgcctgtcgtcggccatctggtcgtcgatgatgaaccacatctcttcttctccttcctgtggttcagtcgatctcgccggtgtccggatcgacggtcgcctccacgtcgccatcgtccatgtcgagactgcggcgcagatcgtcgatgaggatcatctgccgtgacgtggccggcttcgcgcacatgttctccatggccagtcccgcgtcgaggatgcgctgagcgaggtccgcgcagtcgtacacggcttcggtgatggcgtggatgccgccccacttgtcgatgtgctcctgcttgtttttggtgtccatgacggtgcggcatgccttgagcacgacggccgcggccttggtgacctgctgggtcttgccgatgaggtcgatgagtgtgtcgggcgtggcctcctgcgggatgagcgcctgttgttcgctggctttcattgctgctccttagaattccggttccgtgtcgggtttgccgaaacctccgaatgatgactggtcggacgccggcgcgccccacggatcatcggccggcggctgggcgggttgctgtgtctgcgccggctgttggctccagccgcctgcgccggtgttgacggtcggcgtctgcgcggcgggattgccgtagacgggaccttgcggccgtcggtcgatgcggctgacctgcgcggtggcgtagcgtaggctagggccgatctcgtcaacctgcagttccatgacggtgcggttggtgccgtcctgtgcctggtaggaatgctgttggaggcggccttgtgcgattacgcgcatgcccttcgcaaggctctgcgcgcaatgcgaggccatgtcacgccatgccgagcagcgcatgaatagcgccggcccatcctcgtactggccggtctgcttgttgtatacgcgcgcggtgtttgcgatggtgaagctggcgacctgcgcgccctggccggtggttctcagttccggatccgcggtgaggttgccgacgatggtgatgacggtctctccgatagccatgtcattcccctctcacgtatccggccggttccgggccgagctggcttggatccttggccttccacgcgcatttcgcgcgcaggcatccggcctcgcggtcgatgacgatctcgccgaagcgcgccggcgcgaccatggtgaggttccagccacggtcgcggttgagcgcgctgatggtttcatacagttcgccgatcagttcggcggctgtcatgccgacgctggcgggtgtgagtggccattcgaaccacttctcgccttccggtctgcttggtgttttgcttggcaacgtttgcctcctttggattgatgtcgtgccggggcgcggattcgaaccgcgcatccatccgccgacgtgacctcagcacgccgatccatggcgcccgcatcctgtcgcgggccccggcgaaaggccggacgggaggagaagagagaagatgacccgtccggctggttttaacgtcttttccttgacgcgcgggcggttccggcatggccgcgcatgacgaaccacgtccatgccgcaatgtgtgcggaaccgtccaagtccttcactgccgttgctcgtccagccatcgcatgaagcggggggtggagcacaggcgacgcatgatgacggccgtcgggatgagcaccgcgaacggcgcggcgatgaggtgttcgatcgggtgcgtgcacgccggcgtgcaatacagcacccacattgcggcgagccagagcgcgaacagcagctgtcgcaggatgatgcgggcaagagctctcatcgttttgcctctgctttagaatcggtggaatggatatcaatgtggtcaccggcgtcgttggcgccatcacgggattggttggcggtgtcgccggatgtgtcgccttgttccaggcgcgccatggcaacaagctctcggagcaggcgaacggctcggctgaggaagccaaccggatcgctgtcgaatcgaagcgtgccgccgagcaggccaaccgccttgcaggaaaggcgaacgagatagctgcagacgcgaactcgatcagccagcgggcgttgtccgtcaccgccgaccagacggtccacaagtggcgggtcgaatacgatggagaaacctcgaccgtcttccttgtcaacgattgccccgacatggcacgagacgtgtccgtgttcgtccgttgcaaagaccagaccgttgcgcaacggcacgtcgacgaggttgcgccgttcggagaggtcgcgctcgaaagcgagttcttctccaagcagatactcgaagaccaggccagtatcgaccgtctgaactcccaacccggcttcgcgttcatcggatgtggatcctgtcgtgtgacggtccacgtcgcttacactacggagctcggcgccagacgcaacgacgaagtcgagcagtgcctgaccaacagccaaaggcattgattccatcacagctccttgttgatggtgtcgatgacgatgtccacaatgtcgggcacgtcgaggtcgatgaatccgacgatgtgaccgagtgaacgccttgcttcgatgtcgtcccacccgtcggcataggccggacggatggcgtcgccttcgtcctccaattccctgaatatcgcttcgacgcaggctttgcggatggcgttcatttgtcctccttttcttcccatggatccggccacggggtatcggtatgccagtcgttgtcggtcatcacgcacccacctcttcctcgtattcggccgtgcactggtacaggtgttgcgcgaaataggcgatcatctgctccttcggatacatgacggtccgtcccaccttcacgaacttcgggccgatgcccgcgctacgccagtacgccagggtgccttccttgatgccgcagttgtccgcgatatccttcgtcgtgttcatcggcttcaacgccgccgccaatgcggcgaacacctctttgtcatccatcacgcgcccgcttccaacgacggctggaggcagtaccggcggatgaagtacgtctggcccttggcgacgaaccacggatcccccgcctcgtcggtcaaggtgcgcaatgacgcgcccttgaaatcgaacttctggatttcattgttcattggattctccttagaatcgttttcattggtggtcatgcattcccatgacgtgttgctgctgtatcgttgtgcacgttgaccgtgttccactgattgcggagtgaatttatgagcaccgatcccttatggctgacattgctgtcccctgccttgtcttttctggcattggctgtcaatgtgtggattacattccgcaattggcagcgcagggcagctgcgcattggacctgcatccccatacatggcaaggagggacgcgctgatttcaatcggtttctgaaagacgcgaatgacgatcttgagaaattcgatgggatcggtcacatgtttgcgttgacgaacaacggcgagatgcaggcagtcggagttaaactgttcgcttttgggtgctctgtgcaggcaatccaatacctggacacgccgcacggccaagcgaaagacataggcaccgaattcgcgttcgtggaaccgcgtggaaccgtctacgcatcgctcgacgatccggaatccaagcttttcctggatggtactactccggcgaaaagcggctggttccgcgtctattggatggattccccgacccgcaagccccaatatctcaagcaggatttccgatgggacatcgtcgatgggcaacgtctcgtggatcagctcgttccactcggcaaacccaccagagtgacccaaaaggagtatgatgcagggactccaatcgtcgataaccttgagatacatggtttcgtccaatccactagaagagaacgtatggcgcgattcctgttgcgccgttagccgttgagccacatattgatgcagacagtgatgatgctcgccaccgcgcagacaatggagaaccaggtcgctatcgtttccatgtgagaacaccttcctttcgattcatacgtcggcgagcgcctgattctgttctttgaattgaggcggaaggaaggcgcttggcgcttctcctgttgcttcagacagggcgatgactgtatcgagcgtcacggctcggtatcccttcagcatgctgttgagtgtgctgtatgggattccgcatttttccgacacggctcgttttgtcatacccttgtttttaatgattttttcggcgttgtgaccaaaccacgtttgtagactaacgtttctcatgtgagtaacattagggcataaataagagtccgtcaacttcggcgtttctcatttggataacaaataactatatacggaattgccgttactcaaatcgagtaatataatgcttgcatgagtgataacagagaatatcggagccgacgttttgcgcagctagtagggctcgagctaaaaggtgaattcgcaaaacattccatttcgcagacgaaagtcgctgagatccttggacattccaagggtgggtattccaaatggatcaacgcgaagccgtccatgccacttgaggcgttcttgaatacgtgcgagttgattgaggcagaccctaaagcggttattgacgcctcgtataaaaggctgctcgatgaacttggtacaccagatgaataccgcgagcgccaaaaccagatcaccgatgatctcatcgaccgtatcgccgcacaccccgaagactatgacgtggccgccaacagggatccgaacgcacgcctcgaagccgagacgccggacgattgatggattgaaaggaacacgaatgaccgaatacaacctgtattgcgatgagacatgtcaccttgagcatgatgattcgaacagcatggctctgggagccgtcatcgtgccaaaagaaaaacgcaaagagatatgcgtcagaatcaaagaaatcaagcagaaacatggcatatgcgccacgaatgaggtgaaatgggcaaaggcacgagaccgtatgctgccgctctatctggatctcgtggactacttcttcgatgacgatgacatatcgttccgcgcgctcctcatcccggacaagaatctacttgaccacgagaaatacaatcaggaccacaacacctggtattacaaaatgtacttcgagatgctcaaggtcatcttcgatccaaagcaaagctataacgtgttcgtcgacatcaaagacacacactcgagttttcgagtcagccaattatgggatgtctgttcgaacaacatgtacgattacgatcacagaatcatccagaaaatccagccgatacgttccgacgaagtacagatcatgcagctcaccgacatactcatcggcgcagtatgccgttcgcagcgaaaactgccggaacagcatcagagcatggcgaagcgccgaatcatcgaacgaatcattcaacggtcgggatacaaactagaccggagcacactgctgaaggaaaccaagttcaactatttcgtatggagggcgagatgaatccgcattggctgcccggattgattccttggaatcaagagcacggagagacatgggagcagtatgagcaacgactgttccatgtattccagaacgagttcagagagtccttccaatacgacgggaaacccgtacactacaaaagaatgccctacgacggaatctatccggaagccttcatgcatctgaccacatgcaatcaggacaactccggctcacggcttccggatgccgaacgcagcgaacgcatcagctggcccagaccggtagtggagcatcatccgttctgcgaaatatgcgaatacgcccaatgcacgcggccttgggtatggagaaaaaacgacaagaacaaggatcgagtgaagatatatcttccaaaccaacaatatctcgttgttctaggagaacgaagggattactgggtactcataaccgcgtactacgtaaaccgccaatggagcatagacaagctggaaaaggaatataactccagattcagcacaaaaatccaataaaaaactagagccgcccgttaaggacgactccgaagactccttctacaacatgtagatgagctgattcaaatatcacatacgacactccaactgtcaagcggaacttgacaaacagcaaaaaagtacttctcgaaaaacaatactttcggaagagaggaatgtggataacaagaccgttgcggaccttcatcggagcgcggaatccatgggactgtcaatcgtatcgcgcgacctcccacgcgacatatgtggcctgtacgacgaccggcacaggcttatcctgctggccgactggctcaaccagcgccaacgccgctgcacgttgtgccacgagctcatacacgccagacaccatgacccaggatgcggtacacgatacggaatcaaatgcgagcgccgttgccgtagggagacggcgttggcgttgatatcgccggtggattacggcatggccgagacggtgtacgagggcaatacgtggatgatggccgtggaattgggcgtgaccgtacaggtattgtccgactaccggcagctgctctacgattccggcgtgtgcgtgcaataaaagaagctcagcgtccacataccgcgacgggaaacaaaaagggttccgcccgaacacagtcggacggaacccaaggaaccaacaatcagcatttccgttttcaccaaaatgaggttccacgcacagtgtagcgcggatccttggaaagagacgaccatggccagagcgttcgtagacgacagatggctcaaaaacgacgaggacggcaacccgcccagcagggccgcgaaacagtcgctggccaacgctaaggatccgatgaaagccaatgtgcccgacaaatggcggtccgcgctgtacggccaaggctcacggtggagatgccgctggtacacgctccgagacggcaaacgcgtccagaaatcacggaacttcgccaagctccgtgacgctgaggaatacgcagcggccatcgaggacgacatcagacgcggcaaataccgcgacccgcagcaggaactacgcatcttccgggacgttgcctccgaatggacggacggcaagatggatatcaaacagggcactttgggcagataccgccgcgaattgcgcgtttatatcaaccccaagtggggcgatcgcacactgagggaaatccaacgcgacgaactgcaacagtgggtcacgcagctcaccgaaggcgggtatcccgccgaactgcaggacgatcgcgaatcgaagccattgagtccacgcagcatccgcaacatcgtcaaggtcgtcatgggcggtgtcatggaattcgctttggagcacggctggatcggagagaaccccattgaaaaggtcaccgtgccgcgcatcacgcaatccgatgacgacatggtgttccttaccgtcgaggaggtggagttgctggccggcatggccgaacgggcaggacggccggtagacgggctgatcgtccgctggcaggcatacaccggtgcccgcattggcgagacgctggcactcaaatgcggcgacgtggatgtggattcacgcagggcgcgcatccgccgcacttggaccgacgacggcaaaggcaggcttgtgctgggcacgccgaagaacggcaaaccgcgcagcatcgccatacccagattcctcataccgtccatcgaacggcagatggagggcatgggcgacgacgactggctgttccgcgcggcaagaggcgggaacctgtggacgaacacgtggcggacgcgtgtctggcgaaaggccgtccgactggccggcatggaggacgagggcgtgaccatccatagtttgaggcatagctatgcgagctttgcaattgctcaaggcgcggacgtgaagaccctacagatgcagctcggccactcctcacccagcatcacgctgaacacatacacggctctctggccggaacgattggacgatgtggcggacgcgattggcgagctgcgcgctgaacagttgaagaccgtctagacgcggaggttgcgcggtcatcgtgtcgaatcgtgtcgatagcctacggccaagaaaaaataaagccttggaaacataatgtttccaaggcttccggtcgggctgacaggatttgaacctgcgacattctgctattgactataaagaagtagtacaaatacgctcttgagttctcaaaccaccaccacaccagcagaccgttccgaacctcaggagcggaaccgccgtgctgagcagcgagatgtaaacttacacgtccttgccgatccacgcaaatcgaccttccgcaaacaccgtgtaaaccgttgaaaaataacgtatctctcggcgtgtcgaaatcgcaggaaaatcgagtgatgagcaccatttcacagcacaatcccgctggaaaaacctcaacatacctcgcgacaggtcaacatccgggcgtgtcgcacacgagacgaacgaatgacagaaaggtacaagacaaacagcgggcaaaacatccagcgggaacagacacaacacgactacgcctgacacacatccagcaacgtcaattcgtccgaccaacttacgccttgccacacaacctgcgagcgactccgtctaccagcgcttgccacagcgcttgccaccattgccgggcctgccaccggcgccccacggcccgcgtccctcagcatgcagcacacccagatgatgcttcatggcgaccagcatgatgtgcgtatcttccaagccaagatgtcgttcgcttttggatgcatccaacgcgccctgacgtttggcatacgcatccaacgtattgttgccgtgcggatgctcatcatcgggaatcgacccctcatcccaacgacggctcatcggcaatgtgtcgatgatcgtgatattgccggcacgatagctttccgcatatccggcgacgttcagcatgaaaaagctatgctcgaaccgggcgttatgcgcaacatatggctgctgttcgagtcgttgcagcaatccgatctgagcttcgggccattcgtcgaacagacgaaagtccgcgctggcgcgatcgcgcacgtcaataccggtaaggtcgagaatcagaggattgccaagcagcgcattctgcgcgggaacgccgaaggaaagacgtgcctggccatatgcatcgccggtctcgtaataatcctgttcgtagcggtagcccgcgggctcgccggcaggacgaggcgagatcatgttcatgaattcgaatccggcatcgatgatgtacacgcgagccggatccgtacccgtagtttcgatatcaatgcccatcaccgtgtcgacgtcacggccgggaaggtaggcgtcacgccaatccgactttttgtaatccgccaaacgtcggtcctgcgcggcttccgccgagtcagcggaaccgccagcggatccgagggagccatagtcgaacaccttcgagcctcccggactcgtcaccccgctcaaattcgcgcgtgacatggcgtaatcgctggcacgcttctgctcacgttccgcggcacgacgttcggcacggccattgacgatctgcgcggtacgatcctgaatatcgttaagattcacgaggctttccgctccggcaacagactgcagcacgggcactatcacccgctcccgccgctcttcggcaatcgtccacaatcccatcgcagcaccaatgcgccgcaacacggcaatttcgtcgcacaacctacggttcgcataggcgagcgcgcgaggcaaacggtatgaagcgatcagacggtcgaaatccgtcatgaaggtggtattgcattgcgcgatgatggattcgagccggtcacggaccgctaaatcctttttcagcagattatgcaactgttggacggatagtaccgaatcctgcatgggatccgttttctccgaggtcgacgaaaacgtggtatccgcggcattcagaacggcgatcagttcgatgccttggcttttggcggctccgatgccgtgttccaagtcgagagacatgacccaatgccagtcgatgcgctcattgtcggcgtttttcggcatcgatgccgaccattggctgatgtcttgtttggcttcggtaagccaggaacggcccgtctttgcttcgttcatactttgcatggtagccgagagggggcgcagtacacgtcggcgcgtacaaaaaaccatgatgcttctcggatagcgcaatcttaagttttttgagattcgaaaggttatcttgggttcgttttatttcgttgattttcggtaagagaaagaacaatgctacgaaaaacgattatgttcaccaagcattcgtcgtcaggatacgatcatgcgcgttgcagacggagcacgacgtcgcgtacgaaatcattccatcgcaacgcgaacgccgatattgtcgataatgctgcgaaatgcaaacatggttacgctcatacgtgcgtctgccgtggggagtgtgatgcgtgcgcgcgttgcactggttatgcgcatggtggtatgacgaaaaaatgacggtatgacaaaaagggagaggcctgtgggcctctccccctgcaggatattccgcggattgcgcaacgataggattccgtgacaatcggattccgcagcgtttttcgccgcgcatgtatgcgctttgcgacgtgcgctcctggtttacagttcgaatccgagttcggcggcggcttcggtgggaaccggatcgtcgcaccagaaatcctcaagattctcgttggtggcgaggctgcggatttccgccttgtcgatatacagttcgccgctcagatggtcggtttcgtgctggaagatgcgggccggccagccgtgcagatgttcctcatgctgtttgccatcttcatcctgccagcgggcggtgatgtcgagccagcgcttgcgtaccgcctgatagccgtcgaagctcaggcagccttcgtagaagctgcgggtttcggtgccgatcggctcatagctggggttgatgatgacgtggaatgggaattcggccgcttcgcgcgggtcatcgtcatcgtcgtcgcgcacatggtcttccaccacggcaagcgccagtccgaggccgatctgggttgcggcgagacctacgcccggcgcttcgatcatggtgacgcgcatggtttcgatgagcttgtcaagtgtcttgcggctcagttggccttcgtaggctgcggtctgctggcgcagtaccggttcacctgcctgcacgatgggaagcagctgttccttgccgccggttttgatgagtttttcgacctcgcggttgagctcgaggttgactttcgagttacgtccaaacatggggttccttcgcggattggttcgggattttggattgccaaatactgtgtatcggcggtgtgattacaaggcgagttcttcggccacgactttggcgagacggtcgcagacctcgtcggcctgctgctgggtttccgcttcagccatgacgcgcacgagcggttcggtgccggagggacgcaagagcacgcggccggtgtcgccgagcattttctcttcgcgttcgacggccgcctgcactttggcgttggttttggctgcgagcttgtcgacgtttggcacattgatgagggtttgcggcagttgcgggaagtcggatgcgagttctttgagactcttgccggagttgaccacttcgttgcacaaggtcagtgcggtgagtgtaccgtcgccggtggtggcgaattcgcggttgatcacgtggccggactgttcgccgccgagcgaatagtcgccgcgcagcatttcctcaagcacgtaacggtcgcccacgccggtttgcacggttttgatgcccatggaacgcagggcgagcttcaggccgaggttgctcatcacggttaccacgagggtgtcgtggttgagtttgcccgcgtttttcttggcacgtgcaagaatacccatgatctgatcgccgttgaccatattgccttcgccgtctacggcaaggcaacggtcggcgtcaccgtcgaatgccacgcccaagtcggctccggaggctttgaccatggcctgcagctgttcggggtgtgtggatccggcgttcttgttgatgttgtagccgtctggcgaagcgttgatcacgatcacgtcggctcctgcgcggcgcaacgcttccggcgcgaccacggaggtggcgccgttggcgcagtcagccacgactttcaagcctttcaacggtgtcggctgggacttgtcaggcccgatgggggcgattgtggataccagatggtcgatatacaggttggttgcggttgccgtgtcgtggctgatacgtcccacgcctgcaccggtcgggcgttcccaatcctggccgagcacgttttcgatttcgtcttctttggtgtcaggcagtttgaatccgccgcgtgcgaagaatttgatgccgttgtcgggcatgggattgtgggatgcggagatcacggcacccatttccacgttcagcacggaggtcaggtatgcgacgccaggggttggaataatgcccgcgtcgatcacatcgaaaccgcctgcggacatgcctgcggacagtgccgctgcaagaaaatcgccggaaacgcgagtatcgcggccgaccagtgcacggcgacgaccgtcgaattcgcttttgtctccatcatcgccaagcacgcgcaccgcagcatcgcccaaatccaacgcaagctgtgcggtcaaagccctattcgccaatcctcgaacaccgtctgttccgaacatacgtggcatgagtctcaagtcctcgctatctcaagttatattgccgtgcaccatcgtactcaacgggttcaccattcaacaaaatagtcaacagcatgttgcgatacctgcatactgcagtatgcgatgtcaggcaaaccgcagtatgcaacgtcgtgagatttccgcaatctcaagtttcttgcgatctcacttccatcctccgattccgaccggctgggtcattatgggtccgaaagacccattgtccataaccgttatgggactttgtttgggatggcttgtctggaagcaaacaagcccgtactggcagcgggataagtcacgccgtcagtccgggcttatgatgcaatatcacaagtgatatcagaagtagctgccaaaaacagctactgtagtggtgccaggaacggcatcagagggacgcgttgaaatcacgcaccttgagcgtgcgatgcgacgattcaacattgccacgcacaatgcgctgcaacgcgttgtcggcgtcggcatgcgaagccagccaagcatcaccgagatccaccagtgtggccggatcggcatagctcgggtacaggccttccagcagagcctcagccatgtggaaggtcttgttcttccaaatccagtcggcaacctcgaaatacttggccgcgtacggttcagccaagtcggcacgtggagttgatgcgaaaccacgggccacggattccaactgcatgttggtcagctcgtcgttgtgcaaagcctcgttccaagcccattccttggcttccgcaatgcctgcgaccgcacgcgcacccaatgcgaactcacggttctcagtggtttcacgcttggcgagttccgcgtcgatgtcactctggccgatggcgttgattgcgctcagcgcgttgatgatggtccaacggaaattattgtcgatctccaagccatcaagcttcacggaaccatcgagcagacccttcgcattcgcttcgaacgcagcatcgcccggctcgccataacccaagtaggcggtgatcagctggaactgctcgtcggaaccggcttcggcagcctgagccagcttgaacagttcggcagccacatgctccaccacttcggcacggtcggccggagcggtgtaatgccatgcggtggtgctgacctgcgccaaagcgtaacggaacgtggtggactcatgttccgtggcaagcgcagccaaagaggtttcgatgaactgctttgccggcaattcgccgtcacgggtcatatcccagaatgcaagccaaatcacggaacgagccaacgcatcgtcgaaacgatacaggttctccgcagcgaacttgaggctcttctcgtcgaagcgcagcttcgtgtatgtcaaatcgtcgtcattcaccaaaatcagcgccggacgtgccttgccggcagccgcttcgacaatcgtcagttcgccgtcaacatcaagttcgaactggtcggtacgcacgatcttgccggtttccggatcctcattgtagaagccgacagccagacgatgcgcgcgcagcaccggatgctcagccgaagcggactggcgcaacgcaagctggcgaatcgtgccatcctcgttttcctcaacttcggtggcgatggtgttgatgccggactgttcaagccactgggcgctccacgccttgagatcgcggccggacgtcaactcgagttcagccagcagatcggcgagcgtagcgttggagtacgcatgcttgttcagataattgttgatgcccttgaagaacttctcacgacccacatagaacacgagctgcttcaacacggaagcgcccttggcataggtgatgccgtcgaagttgacgtacgtgtcgttcagatcgttgatcggcgcgacgatcgggtgggtggtgctcagctggtcctggcgcagtgcccagctcttctcgccggagctgaatgtggcccaagcgtccttccattccgtggcttcggcagtggcgagagtggacgtgaactcggcgaaggattcgttgagccacaggtcgttccaccacttcatggtcacgtagtcgccgaaccacatgtgtgcaagctcgtgcagcacggtgaccacgcggcgctcggcatacgcgtcggtgaccttcgattcgaacacgtactggtcgcggatggtgaccatgccgatgttctccatagcgccggcgttgtattccggcacgtaaatctggtcgtacttggcgtacggatacggcacgccccaagtcttcgcatagaaggcgaaacccttcttggtgatgtcgaacaggtagtcgacatccttggcgaacgcttcggcgagcgcctgacggcagtacatggccatcggcacggtgcgaccgtcttcgttggcgtattcggtgtgccattcggcgtacggtcctgcgcagatggcggtgaggtaggagctcatggtcggcgtggattcgaacacccacagcttggtggtttcggcttcgtgcgtgccgagcgtgccttcttcggtaacggtttcgctgtcggtcacggatgcggcaggcatgttggaggtgacgatccaagacttggcggcgagcacggagaagtcgaacacggccttgatgtcaggctggtcgaacacggcgtacacgcggcgggcatccggcacttcgaactgggagtacaggtagatgttgccgtcggacgggtcgacgctgcggtgcaggccttcaccggtgttggaatactggcacagcgccttgacggtcacttcgttgtgcgcttcgaggttcttcagttcgatacggctgtcggcgaacgcttcggccggatcgagagttgcgccgttgagtacgatttcgctcacttcagtggcgatcaggtcaaggaagctggtagctcccggctcagcatcgaacgtgatggtggtttcggaaccgaaattcttggctccacgggtcagatcaagtttgaccgtgtaatgaaccggtgctgcgataacgcttttgcgttcttccgcttcgattcgggtgagatttgctcctggcatgtcactccttatttgtgttgagattcctatttattgaataggagacggcgcaaccggttgtgccggttacgccgtcttacttttgattatgtaatcaacaattattgacgatctgtcgatagtccaatattatttcgatattaattccgctgagatcggcgatattgcgaaaaatattgactatctgtcgattcatcattgcgctgcgttcaatcccatcgcttcgtcaacatcctgtgcgatatcggcaacgaccggaacgatcatcggcttgcgatgcagctgacgtgcgacccagctacccaacgtacgacgcatgatctgctgcaacttgtacgtatcgtgcgtgccagccatcatcgcatcctgcaattgctcgatgatctgatgacgaaccttgtcgaattcgctttcgtcttcggccaccgcgttgagatagatcttcggacctgcgacaacgtcagccgtttccgtatcgacgacgacgaagctcgacacgaaaccttccgtgccaagaatacgacgcttctcaagctcgtcctcggtaagttcgccaacggaatcgccgtcaacgtacacgtagccgcatggcacggaaccgacaacagcagcttggccgtggtacaaatcgaccacatcgccgtcttcggcaagcaccacattctgcggatcgacgcccgtcttgaccgcgatcatgccgttggccaccaagtgacggttctcgccgtggatcggcatggcgcacttcggcttgacgatgttgtacatgtacagcagttcgccctcattgcagtggccggacacatgcacggcggcattgtctcgattgaccacacgagcgccaagctgcaccagcttgttgatgatcttgtacacgccatgctcgttgcccggaatcagggagctcgcaagaatgacagtgtcgaattcgttgatggtgatgtcgcgatgattgccgtcggcgatacggccaagcgcggccatcggctcgccttgggaaccggtgcacatgtagacaagcttgtcgtcctgcacatcatgggccttcttcaggtcgataaccgtgtcttccggaagtctcaagtagcccaaatccgcagcgatggacatgttgcgaaccatggaacggcccacgaacaccaccttgcgaccgtacttgtgggcggcgtcgacaacctgctgcacacggtgcacatggctggagaagctggccacgatgatcttgcgcgtggcctgggcgaacgcctgatccagcgccgggccaatggtggtttccggcttgacgaagcctggaacctcagcgttggtggaatccatcatcagcagatccacgcccttttcgccgagcttgccgaactccaccaaatcagtgatgcgatggtcaagcggcagctggtcaagcttgatatcgccggtatcgatgaggcttccggccggagtctgcacgaacacagccagagcgtccggaatggaatgcgtgacgttcacgaactcaagattgaacggaccgaccttcagcttgtcacgacccttgacctcaaccagtcgcggattgatgcgatgctccttgcacttggcttcaacgaaagccaacgtgagcttggaaccaatcagcggaatgtcgggacggagcttcagcagatacggcacgccgccgatatgatcctcgtggccgtgggtaagcaccagagcctcgaccttgtcgagacgatccttgatgtagtggaagtcaggcagaatcagatcaacacccggctgctcctcttcggggaaaagcacgccgcagtcgatgagcagcaggtgaccgttatattcgatcacgttcatgttacggccgatttcgcccaggccaccaagcggcacgatgcgcatggagcccttacggtacttcggcggagcgatcaacacgtcatcctgctggggcgcggtggtctgcggagcaagacgggaattgcgacggcttccagcagaagagcttgccgcgctggagttcttggaacctctggagttcttcgtgttctttgcggccttcacgtttttcgtgctcttcgagcccttggaggagccgctgccgttgccgcgagaaccgccacgaacggaaccggacgcatcgcccgcacgattgccacggccaccgccacggctagaagacttcgccttcttggaagtcgtttcagccttgctgaccttctcagagctcacagacttcacagatttcacatccgcggtctgcgtgttttcagtgcgcttggcagctttactgccgcgcttgtgcgtagttactgttttggtttcttctatagccatttcctagttggatttctattactaattgtctccgcctgtgcggaaacgaggaattcagttagtttgccgtattacggcaaacccagcaaacttgtgatcgcaacaatgcccggaatcagcgcaatcgccgacaatcaagcgcttcgcaatcacaagttcttcaattacagcaagccggaagcgcgcatgccatcttccgcgcgcttgatctcagcctcgcccggaccgacgttcggcagacgcatcgtcgtggagtcgagaatgccacgcaccttcagcgaagccttggccataacagcctggaaaccgttgccgttcattgcttcgaccagtggagcaagctgcacggcaatgcgctgagccccatgaatgtcaccgcggtcgaatgcggcagccaaatcgcgcatcggaccggaagcagcatgtgcgatcacggaaataatgccgactgcaccaaccgaaaggaacggcaggaacagaccgtcatcgcccgaataccaagtcaaaccggtttccatacgcttacgcacggcacccgcgatatctccggtggcgtccttgactgccttgacgtgaccgagctcagccaaacgacggtaggtttccaactgaatgtgcagaccggtgcggccaggcacatcgtaaacgataatcggcttgtccgcggaatcattgaccgccttgtagtgacggaacacgccttcctgcgacgggcgcgaatagtacggagcgaccacgagcaccgcatcggcgcctgcttcctgggtctgctccaccatgcgcacggtgtgggcggtatcgttggaacctgcaccggagataacgggcacgctcaccacatccttgacggcttgaaccagctcgaccttctcctccatgtgggtggtgggagactcgcccgtggtgccattgaccacaaggccatcggcgccatcggcgacaagctgcttcgcaagcttctgcgcggcctcgaaatcaacggaaccgtcggccttcatgggggtgaccatagccggaagaatacgtccgaaaggagcaggatcaagaagatgcatagtaccgtcagtcatagtgccaacggtacttcccgccacggacgccgaagcgcccgagttcgcgaccatatcgcaatatgaactgccttccagagaccaaaatcccccacccgctggaacaatcctcccgttgccgagcctcccagagtcccgaaacctccagtcactggaacaatcggtacgctaaacaacccctcacattcccaaaacctccacccgctggaacaatcctcccgtcaaccagcctcccagagacccaaaacctccaggtaatggaacaatcctcccgctgccaagcctcccacagtccaaaatcccccagcaagtggaagaatcggtacgcttagccgcatactcagggggattcaagccaaatgacttcacgattttgatctggtgaccgcacgatttcggaatatcgcacgattttgctttcctgaccgcacaacactccaaaacagtgcgatcaccaagaaggaaaagtgcgcccaccaaaacaaactcaggcaaggtattgggtggggttctgctcgaacttggcggcgcagcccgggttgcagaagtagtaggtggtgccattgtattctcgggtggctgcagcggtggccggatccacgctcatgccgcagaccggatctttggcgggcgcgctctgattgccgttggcagtgtggccgccacagcaggagtgcgcgccgcccatgccttccataccctcgtgcataccttccttcttggccttgtgatcactgaacagtcccatgatgaatcctttctgactatggttgttgtgattattatcgttcgggttcggctggcgaacctgatacgtcttatttgcggcacgcaccgccttgtctggatcgaacaggcgcagtcggctcgcgttcgtcaccacgcatagcgacgagaatgccatggccgcgcccgcgatcatcggattgagcatcatgccggtgaacgggtacagtacgcccgccgcaatggaaatgccgacgctgttatagccgagcgcgaatccaagattctgcgcgatattgcgcatggtggcatgggtcaaatcaagcgcatgcaccaaacccatcagcgagccattcatcaatgtcacgtctgcggattgaatcgccacatccgtaccggtaccgatggcgaatcccacattcgcgcgggcaagcgccggagcatcgttgataccatcgccgaccattgccaccgtatagccttgcgcctgcagtttcgcgatttcatccgccttgttttccgggcgcactcccgcgatcacattgccaacgccaacttgatcggccacggcatgcgccgtcgtttcattatctccagtgagcatcaccacgttgacgccacgcgatttgagggacgcgatagcctgctgcgaatcggctttcaccgtatccgcaacgacaacgattcccgcaagctcaccgtcgattgctgcgagcatcggcgttttcccttccgccgacagccgttccatggttgcgataatgtcgtcaagatcctcatcgccgacgctcggcatgcccacgtcaagatcgtcgatcagatcggtattgccgaccgcaacgttgtacattgcggtttcgggagaagatatggatgattcgaaggtcacggaagatgcagaggattcgtcagctgcaacagtcggattatttgcagatattaacggcaacgcgacgtgcgcagtgactccccgaccggaaatcgcacggaattgcgtggtctcgcctaacgtaagatgcttttcttgcgcgcccgcaacaatcgcggcggcaagaggatgttcggaatcccgttcggcactggcggtaatcgccagcagatcatccggcattttgcgccattttccaagcggaaacacgtcggtcaacgatggcgttccagcggtgatcgtgcctgttttgtcaagcacgacggcattgattttgccgcaggtttccaatgcttcggcggaacggatcagcacgcccatctgcgcggcacgaccagtcgaaaccgttacggaaagcggcgtggcaagacccaacgcgcacgggcatgcgatcagcagcaccgaaaccgcagccaccaacgcatgcaccacgcgtggttccggcccaaacgcaaaccacaacgcgcacgaccacacggcaatcagcaccacaatcggcacgaaaatgcctgaaatcttatccgccatgcgctgcaccggcgcttttgaactttgcgcggattgcaccaatccgataatctgcgcgagcaccgtatctttgccgactttcgtggcacgataccgcagcgatccagtgccattgatggtggcgccggtcacggaactgccggtctgcttcaccacaggcatggattcgccggtaatcatggattcgtcaacagccgacgaaccagcaataaccacaccgtcaacaggaagttgttcgccggggcgaatcgcaataatatctccgaccgccacctgttcgaccggaatttcctcttcaatttcacctcgtaccacgcgagcgtttttcggctgcaatcccgccaacgcgcgcatggcctctccagtgccgacgcgagcgcgcgcttcaagcaattggccgaccagcatcagcgtaataaccacaccaaccgcttcaaaatacggttcgcgagcattctcaggcagaatctgcggaataaacgtgaccacgcacgagtaggcaaacgcacatacggtacccagactgaccagcgcattcatttccggcgaacggtgaataatcgccgcgaaaccactgcggaaaatcggtaatgcggcatagcacatcaccggcagcatcagcacaaattgcacccaattcggcatcggatacagcatcaacatcgtcgaaccgaatactggaatcgtaacgatggctgacacaataagacgcgcaatcagcgttcgcatctcacgagattcggaagaatcgtttgacgaatcagaagaaatattggaagattcagcagattcatacgatttttcagcaacaacgcttggctgcgattgtatatgaacgtgagattcagcaatattcggattttcttccgattccgaatgttctttcgccattgcggcatgatgttttcccggcaccacccgtaatgtgccatgcagcatgttcatgccgcatgcgaaaccgtactcccccggttcgttaggatgaagcgtcaatgtcgtcgtacgaaaagcaggcaatgccaggtcgatgccaaaatcggagaacaccacatgcgacgagcattcaccgttttctttgcgatcgaatatcaatcgcaatggcaaaccggcctcagcttcgatgattgccggactatacccacctttgacttcgacaaccgcctcttgcacaccgttatcgacacgagcgcgaaatgctttgcgcggcgcgaagaaaaaccataacacggctgccgccacaatgaacgcgacaatgacggcaatcaaagcctgcatattctcaccaacctcaacaccaatagggtttattcacgttcacgtctcaatgactatcatcacaatatacccctatagggtatatttgcaagagaaaagcggtatcttcagcggtaagatcaagatttcagcgttacgaggaggagcatcatgaacgcaacccatcacggatacgcggacgaccagaagaaaatcatcgcacgcctcaaccgcattgaagggcaagtgcgaggcatttgccaaatgacggaaaacggcgaatactgcatcgatatcctgacgcagatatcagccgtgaacagtgcgttgaaatcggtagcgctgctgctcgtcgacgatcatctcaaccactgtgtcaaagaagccatcgaagagggcggggaagtttccgaagcgaaaatcgccgaggcaagcgcggccatagcacgcctcgtaaaatcgtagaccgcaaaacatgtcaatccccgatccagcaagcgaaaactcaccatcgccgccaaatcggggatcgtatgatcagaccggaaaagttccagaccccatagatttacgaggtagatttacgaggtagatttacaggtcgaggaagttgtcgaggccgacggtcacgcctgggtatgcgccggtggaaaccttgcgcacggccagcagcacgcccggcatgaaggagatgcggtcgaagctgtcggcacgaatggtcagctgctcgccgtcattaccgaacagggcctcctcatgggcgttaagaccgcgcagacgtacggcgtgcacgtgaatgccgtcaaccacctggccacgggagccgccatcggtttcggtggcatccggcacagggccaagacctgcggccttgcgggctgcggcgatgccctgcgcggtgtggaatgcggtgccggacggagcatccaccttgttcgggtgatgcagctcgatcacttcagcggattcgaagtacggagccgcaaccttggcgaaatagtcggcgagcacggcggaaatggcgaaattcggcgcaatgaacacactctggccctcgcgaggcgcggcagcgagcgcggcacgcacctgatcgagcttctcgtcggtccagccggtggtacccaccaccacgtcaacaccttgcgccacgagtgcgagcacattgtcaagagacacgctcggcacggtgaactccaccaccacgtcagtgttgccgggggtgatttgggtgaggtcgtcgccggcgtcaagcgcgagcgccaattcggtgtcggccgcgttgttcacggcatcgaccacatgggaacccatacgtcctttggcgccaactacagaaaccttgatcattgcagctccttcaagcatgtcgcacgtacgagcgtacgaacagcatttcaaatcagtctcactcattctactgaggaatgttccatttacgaatgtaaagagacgcttcgacgcgtcaccgcccagccgatcaaggcgaacggaatcgaagcgagcacgaaaatccatggcagcatcaggcttatgtcggggctgaaatggtcgagcatgattcccgtggtcatcgaaccgaatgacgcgccgatggttcccgcggtgctcacccacgcgaggccttcggtcagcgattcctccggcacggtctccttcataacgagattgcccgaagcgaacaccgacgaaacggtaagacccgtaaggatttcaaacactcccatcataatcagattgccttggcacatgtgaatgatgaagaagcctaccgttatgaccgcgaggaacgtgatcatatggcgccagcgggagcccttcagctcgcgcgtgccgaaaaacagcgcgcctatgcacgagccgaccgccaacatcgcaagctgcacacctagcagggaatcaagatccaacgctttcataacggccgtcatcgacgtatcgaatgcggtgaaactcatgttgaacacgatgaataccatcaaaagcggaatcacgcccgcataggtgagcacattgcgtttcttgcgattgtcattcgacttcaactgcgcgacggtcagtttgtcttgttgtttgtcttgttgcacggaatttgcgccgccattatttccagtattgccgtcaaccgccaatcgcacgtccgcatcgtcggaagatgccgaaacaacagtgatttcacgtactaccggcggttgcgtgtcacgcaatgcgaagaacaccgtgccgccgatcgcgcacgcaatcgtcggcacaaacaactgcgaaacgggatgcacggaagccgccaggaacgcggccagaatcggtccgaaaatgaatacgatctcatcgatggcggattccaatgcatacgcagtgttcagcaatgagccgttgccggtacggtcaagcacatacgtccaacgggtacgcacaagcgcgccgaacgagaattgcgtgagccccatcaccacagccaaggcgaacagcagtggaatcggcacgcgcaccaatgccgcgaacgcaaagccaagcatggcgatgatttgcacgacaagcactaccgatccgaccttgcgctggccgaatcggtcgaacagtcgtgcgtacagtggcgtgaccgccgccgtggaaagcacatatgccgcgctcatcacgcctgcgatcgtccaattgtcatacaaatggttgagtgcgaggataatgccaaggctcatcatcgacatcggcagtcgcgccaaggctccggaagcacagaacgctttggttcccggaatggagaacagtacggaatatggcgacttcgggatttcggttgcgctggtggcagccatgattatcgctccttaactttcgttgcgtccggcacgtgtgcccgcccacacatgctgcacgagggtagcggcgctcctccacaacgctgcccatagtgcgttatcctacgggcaggctggaaagcgccgcacgttcggcgcaccagcactagtcgttgtcggattgttccggaattccgtagctcaactcggcaaggatctcttcttctgttttgtcggcggcattgagctgtcgatcgccctcaatgggttcactcagatagtagaggcaggcgtcgatagcggtgagcggtacgccctccattgccgacagcaagatacgatacatatccaactgtgctaattttttctgaattaccccttttttgcgaggtttttttccagttttccaatcgacaatagtatattgtttcgaccgatccgccccatcgagacccccgaagaacaccgcgtcgagcttgccgttgacgatggtgcccaattgcggcacgttgacgacgatttgccgttccgcccacgcgggcttgcgccgtgcccatgtcgacgttgcgagacgctgttgccaatcgaatatcccgttattgtctgccccattatcgtcttgattgtcttgcgattgcgccgcattgttgcgtcgcagctcggcaagcatcgccaatcgcgattcagctacgcgagtaccgtcattgccgctcgcgccaacgccaatgccggcatcattcgcatcggccatgatgaaccgttccgcccaagcatggaactgcgtgcccagttgcgcggccggagacgctacgttcggtatcggacgcaccagcccacgccagtaagtgcgggcgccacgctcgtccatcatgcctgcgcgcgcctgcagcgaggtgacgttctgacgaccggacgcaagaatcctctcgcccttcgcacgcaccgcgctgtcgaacgcatcctgcgacgcctctccaagcatgtcaggcatgagattgctgtcggccaccagcaattgcgcgcatcgcagcagcgaagcacccgtattttcgcaacgcccagcacctttgccaccgacaggctcgccaacttgcccgccggcccgttcgccagcccgcccatcagtctgcccgccagcattgttcatcgccgaatccacctgcaacgcagacaaacgcaacgtctgcagggtctcatcgctcaactcgcacggccatggcaggaactggttgccttcagacggctcgagcggcgcattccaagcgtcgccgaccaccgcatcttcaaaatcgcgggcatgctcgcccacaaaaaatccatccggcaacggcgcatcgatcgaatgcagactggtcatgccgttttcggaggaatcgacatcctcaacttccgcaatatcggccaggttgctcggctcagccgctctggaaacgatattgagcatggaatcgcgcacctccactaggaaattcgacggtttggacacacgtttgcgatcgcccacggcacgcggatcacggctttccgcattcgttgcgctgcaggtgagcagcgcctcatgacgggcgcgagtcaacgccacatacgcgaggcgacgctcgtcggcatgcaaccgacggccatactcctcgatttgcgtcaaatacagtccgtccggatcaataccttccatgtcatcgacgctcatattccgcaaggtgccgaacacttcgtcgtcaatgatttccgcatcctccagcatttccaacgcttccaacggatttccacccacaagcgcgtcatgggggaatcgcggcagaatatcggcgtccacacgcaccggaaccggcaccgcagcaggatcggtcagccacgttttggcggtctcatgatattcgggcggcgtccacacgccatcctggaaaccgttgagatgctcttcatcaacgaccacacgcagatcgctgcccttgttggtggggaatccgccatcggtcatgccgaccacggccacggcatcccattcaaggcccttcgactggtgtacggtcatcagcaccacgtcgacaggcacatcgggagccaccgcgtgctcctcgcgtgcgtcgcgcagcgaatccgcccatgagatgaacgcgcgcaggctcggcgttccctgcgacgcgatctcctgcatatacgtgtcgacgagcttcagcaacgcatcgatcggcgatttggcgagcgccacccgggatgcggcgagcgtggcatcggcctgaccgccgcgcatatgctcggccagctgcatgtcgatatcgagattcaatgcgacgatggcctcacgaaccacttccggcaacgggtggccaagcatgcgctgcacctgacggatcgcatccgcggcgcgaagcacttccttcgtcccctcacgactcaccctgccgtcaatgagttccgcgagatcgtcacgcaacatgaggtccacaaggaaaaccgcattcggcacttgatctcgatattcacgtacgatggcacggatttcagcatcggaaggacccgacttgggagttactccataaattcccagattttccggtttttcttccttgttggattgctcctgcacgattccagctgaaacaagcgcacgataccggcacatcgtgttcacctgttccgcggtatcggcgagcgcctgcagatcgttggcgctgatggagaatcgcggcgtggccagcaatcgcataagcgccgcactgtcggtatgatcgctgacgacgcgtagcaaagcgaacacgtcctgcaccgccgggcgttccagcaacgccgaccgccccactaccagcgtggtcaggcctgcgcgttcgagcgcttccgcgaattgcggcatgactcctttggaacggaacagcaccgccacgtgcggacgattgtctttcatgccattgtcgaggtcgcgcgaggaaggcgtgtgcagggcgatcgcatgtttggcgaagcgcacgaccgcgtcgacctcctgcccgaacgtgtcgaacgcaagcacgcccaccgttccttcgggggcttcgtcggtattgacgagcgccggaacgtcgacttcgcgcatcattgagctgctgaggcgtctggcaggcaagcggagcggtttggtgagattgttcgccgcttcgagcaccatgcgtgagttgcgccgtgtcacggtcaatgcgaatggcctgctggtggcgtccatgccgaaatcgtgttgcagcatgcggaatgcgccagggctcgcccctcgccatgcgtagatcgattggaaggggtcgccgaccgcgttgaccgcgctgcgatgcgtgtcgtccacgtggaacagcgcgctcagcagtgccgcctgcgtggtggacgtgtcttggtattcgtcgaggagcacatgcgaatagcgtttgcggtaggccgctccgatggacgggaatcgggagacaagctggaatgccgcgatggtgaaatcgctgaattccgccatattgcaggcgcgtttttcggcatgatagtcaagcacaagatcgagcagcaggtcgcgttgcttggcgacgaatgcgagttgcgcgctgttgaacacgcacatgtcgtgcccgagttcgcggtatttctccagtttcttttcgtagtccgcgtcggaatcctttttcagtcgtttcggcagctttggcgatttcggctcttccgttggcacggtttcgccgtcaagcgccttggcgatctgttcgacgaacgcctcatcccagtcgcgcacgcgttgcacggcttcgtcgaagctggtgcagtcgccgccgatcatggcgccggaaatggcgttggacagggagaacacgttgcccgctatggtgttgaacgatttcagatcgccgtcgaacgccataagatcatccatatgcctgtcaagcacagtgtggatgagctgcatggcacctgcttcgctcaatggctgcgtgttctggtcaaagccgacaagcagtccatattggcgcacgatggattggaagaaagcgtcgtacgtggagacttccggtttgaggaacgtcatgttcgctgatttcaggccgcgttcgcgctggtcgcgagtcacggccgcagacactcgagacaatagttccgaggccgctttgcgcgtgaaggtcagtccgaggatcttttcggggctcaccccctgttcgatcagcgtgatgatgcgtctggtcatcgtgtaggttttgccggagccagcgccggccaccaccaccacatccgcatacgagggcgcttggacgacggcagcctgctcaggactgtcggtgaacttcatggttccgctcatgccgttctcctttcgaatacggtgttctgttcgcccgcacaggccgggcagatcgtagtgtttctgcagtatttcacatgttccgtcgtcggtcttgcggtgatttcgttcgccctgctggccgcggccgcatagaagaccctcgcgatcatggtgagggaccataccgccatcgtgccgcgtaagccaaggaactcattccaatgctcgtcgctcacttccaacggaggaagcatgtcatcgagtccgtcgtggaaatccttgtcgagttttttgacgtaatagcgcggtatgaattcgccggtattgagacttccattggcgaacagcgcctgctgcatatgcgattcggcggcggtgtcgccatacggcgcagggtatgcgtgcttggctacatggaatagcgcgctttgcgtgatgttcggcgcgttcgccaccgcctgcgccccgcgcatgccgctttcctcggggaatacgagtcccagctgatagcagacgagctgcagatcgttgaacaggccttcgccggtcggactgacaccggttttgtagtcgatcagacgcacctgctgcgtgccatccgccatttcacgccgttccaaacggtcgatcctgccggtcaaacgcacggtgagatactcgctcatgccggtttccggccatcctccgaccaacgctcccataatggcgatcaattcgttccgtgaaatcgcgtgaacgccgtccatcgcattgtaggcgtcgagaatatcgtcgaaatcgaattttgcggtaaatttcagctcaggttcggctttcgtaagttttccaacgctgaatgcatcattatttttaatcggataatcaccatgattcgattgcacgaaatacgtggcgatgttacgcaacgcctcctgcgcctgctcatctttcttcaacgcctgataccgttgcgcgggatcggcaatggcgttgaaatcgccgcatagacgcttgtattcggcatacatccattcggtgatcgcattgatattgtccacgtcgctgatggcggtatggtgttccggcatatcaagtccggcttcggtggcctgttgcgccaccttgtggatcagcgagccgaaactcgtggcgacgctgcccatgcgcgggccggagaagcggttttccaacatccaacacaccgggcacgcccacagattgtctaccgcagaaggagacaaagtcaccacgtcggatcgccgcgatttgccgttccggcccgacgtcgagctttccgacgtgtcgctcatgcccgtccgcatgacggccgcgatcttccgcatggtggcctcgaccgtctcccccataaacggccaacggtcagggtcggccgccgtaacaccatgcgaagccagcaatgccaacgcttccgcggcatcacgcgccttcgggctgtcctcaggttccgacgcaagcacgcttcgggcggccgcgaccagaccacggggatcggtttccagccccgcgtaatcgccttggccgccgaccgacgcatattctcgccgttccatatcggcgtcgcgatcgcggtcgaagcattccggcatatatccgtatagaaaatccgaaggcacattgtcgtcattcagcacggcgctcaccaccacacgctcgctggcacgggtcaacgccaccaacaggctcttctgctcggaggcgagcaccgacgccagttgcgcgtcctgcctgcccgccggagtgacgatcgtgtcggacaatacgccgtgcagcatcacatcggccagttcctcaccgccgaacaacgtgttgcgtggtgtgagattcggccactgcccctgctgcaaagccggcagaaaaaccagattccagcgctttcccgccgctcctgcgggagtcgtcagggtcaccgcctgatcaatgggcgcggtatgcgccagcgaatccgcctcaatggtcagcaaacgcacctgttcgatgaacgcctcgatggtgtgtaccgcgaattccccgcttgactcgccgcctgaagcatagttgaacaaacgcatcgccgcgtcaagccgatcattcgcggcacggccggcagccgaatgctccagcgccacacgctgccagacttccgccttgccgcaggccctccatgcgcaatccaacacatattgcggttcacgcgaaaccagtttggcttccgactcgcatgttttgtcaagaaccttccacaatgatgcgaacgccttgatctgcggatccgcgcccagcacggaggcgatcgcatcgaccacgcgatcggtattgccctccataagaagcacgtacagcgcttccatactcagcacgaaatcgccttcatgctcgtcttcatgctcactatcatgctcgccatcggcgcgaatcgcatgatagtccgtcatataatcgcgccaatcttccatcaaacgagggagcaacgcctgttgttcgacggcagcgtccgccgcatcctcatcatcttcgaaatcatcttcgtcgtattcttcggcagcatcctcatcatggttcgcagccttgctttccacaatcgaagcgagcgaaaccaacgcgttcatcgcggattcgatggatgcgagacgggccggacgcccctcatgccgttgatcaccaccgaccgtaatcagcggagatcccataatcagcgccacgcgcgaacgaatataggatccggcggtctgcaggtccatggtcgaagccgcgatcgtctggtttttcaattcggccaactcgatcaacgcgaacagaccctgcacgaacggctcatccttcaacggccgggtcacgctggaatagcgcacgggaacgccgtcagcgcgcaaccgctcgccgaatgcgcgcacggtggcattgtcgtgcgcgatcacggccatgtcgttccatacacgggaacgttgcaaatgctcagttttgatcttccacaccacgtcgtcgagctcttcggaagaggaacggtacaaggccgtttccacactgccgtcggccggcgtgacacgagcgcccgtatcgtcggccggcaacgtttcgatgggcatcgcgcctggcatatcgctcattttgccgggacgatcgggcagaggcacgtccgtcgactccgtgcttgcgatcgacaggctcactcgcgtcgcgacaagcgtgcgatagtcgccatgcacgccttgctggttcgacacggtttgcgcggtatcgccttcgtgcgccgtttgcagaccttcgatgcgttcaagcctcgctcccatgcgcgtctgcgcctggttgaacagatattccggatatgatcctcggaacgtctgcacggcttcgtcgggattgccaaccaacagcaggcgcaccccgcgttcatgcagggcttcaagcagtgcgaaaccagccaacgtcgtatcttgaaaatcgtcgacgatcagcatgttcgcaatatcggcttcctgtatgccagacacggcttcggtggcgtcgatcatcagctgcgacgcgtcgagacgatattcgccaggataagacgaacggatcgcctcattgtattcctcacgcaaggcgaaggcgagacgccattgagtgcgcaggcgttcgcgacgttcgtcaagcatgccgtccctgctggccgcacgggcgatcagcatgtcttcgaactgcggtttcgcgccaatctcgttcatgcgtgcgagcatgtcgcgcaattggttggcgaatgcgtcggtggaatcgtcggccaccagtcctgaccattcggaaaccgcgaaataggtgcgcagcagatcgcaggtggcgcaatcgtcgccatgttgcctatgctccacatgcgaagccagtaccttgcggatgatcacatcctgttccgcaccgttcaacagtttcggcaacggttcgccttgacttgatctcacggccgtcagcagacggaatgcgacggcaggcaacgtagtgaccggtcgcgcctgcgacacggccgacaattcgcggatcgcccgatcgcccaacgcatcggcgatctgcctgccagacaccgtcatcacggcattcccgtcaccataccgcctcattgcggcaaccagcatgcccagcgcaaactcggtttttccactgctcggcgcgcccgcaaccaacgtgacgcggtcaaggtcttccaaattcatcatgcctcccaacactactagtctcgccctcctttacctgacaaatccggagcctacaaagttgtctcgaagccaacctttatccaacacaatctgcggtgcaaccactccttcgtggcatctgcagcaacgccgacaacacatcaatggtcatttccatttgagccagatgcccgtcatccagcaactgaatgtatgtaccctcatcgtcgccacgaaggccgtctcttaaggttcgcacgttctttctatcactacgacttctattattcagccacaacatgtctcagatgcccgtctttgtatatggacattttgaccccttgctgataggtttctgggttggtcttcagttaggatgggatccagagagagcggccgaaaagcatacgcaccacgaggaaagagagcatatggaagccatgaacggcatcccccctcaaatccctgggtatacattcgcccaaaagttgggttcaggttccgaagcgaacgtgtatttgtaccagcagctttcccccagccgacaagtagccatcaaggtcagcaagggaacactcgatccgcgcgcggcggcgcggttccgttccgaagcgaacttcatgggcaggatctcctcgcatccctacgttctttcggtgtatggaagcggcgtcaccaccacgggcaacggctacaccgtgttcgaatacgctccgggaggcaattacaagaccttcctggaatccaacaggctcaacgcagaccagatgctcaccgtcggcatcaatctggcgagcgccctttccacagcgcaccgcgaaggcatcatccaccgcgacatcaagcccagcaatattctcatcaacacgcatggcatgcccatgctttccgatttcggcatcgcgggaacgatctacgggcgtcccggcatcggctacaccatcgcgtgggctccgccggaagtgctcgcaaagaacggcggaggcaacgaatcctccgatatttattcgctgggagcaacgctgttcgccatgctgacgggccagtcgccatatgaatacggctattccgcggccctcggctcgaccaggggcaaagaacgcggcgctctgctgagaaacatcattctcaccgatccgctccctaagctcaataggccggatattcccccgcaagtggagcggattttatgcaaggcgttgaataaaacgccggaagacagatattattcctcatacgatttcgcgcgtgacatgcagcgtgcgcagcaggaattgtatggccatgccacgccgaccacggtcgaaggcgaaccgccgttcccgcaaaatctgtacgcacagtcccaggcaagcagccaggcaaccgcggttattccgaaacagcgcaacacttgggccaagcctcttgcgattgtcgtttcggcggttgccgcgatcacggccgtcgcgttggtgttcgcgtatgtgatcttgccgaatatggattcggcttccgacaatagcagcgtgcagatcaagactccgggaacgcacgatcaggacaacgattcgcctgattcggccatcaccacaagtagcgtgcccagtgtcgagaatctggccggctcatattccgccgatggcagcagcgtgcagttcacatgggtgaaccccgaccctcaggacggcgattcatacgtatggtcgatggtcggcgatgcaggagtagacccgaacgcccaaggaaccaccaccaccgacacgcgcatcagtatcgaacctgccgacggctcgcagacctgcattcaggtgagtctcatccgagcggaccggcagatgtcgcagaatcctgcgatcgcgtgcgcagccaaaccataagcatcacagcacttcccaacagggtcggccgacggcattattccatcgcaggcgatgtccggaacgaacacaacgaccatcggaacactcaaggaagaaccgaaaatggacaaacgcaagaacgcagccgatcagccggcacaatcgcacgaacgtcaattgcgcttcggatcgatgatgcgcaaactgctgttgccgtcgggaagcaggcggtggatcacgccgatcgtcatgctgcttctgctgctgggcatcatcgcgggcgcgttcatcgtcagttcggtgacgcaacggcatgtgcaacttgacgacggcaccgtgtggatcacttcgctgaaggaccgcaaggcagcacgattcaatgtgaaaaacaaggatgtggacgctggagtctcgtccgcagcctcccgtttcgacgtggcacagcatgatggtgacacggtgatctccgaaggcaccaaagccagcaatatcgcggcttccacaatcagcgaaaccggcaacaccgccatcaaaacggatatcgaaaccattatcggaggcaataccgcggctttcatcaacaccaaaaccggcaatgtgtgggtgggatccgctgccgatgtgaaatccgtcaaccccaccaccgacaagccgaacatgaaactgggatccggtggaaagatcgcggtgacgcatgacggaaccgtatacggataccgaacttccgatggcgcggtgctgagcatcaaagggccgcagggcacgcgtgagcaagtcggcacgatcgaaggcgccccgcacgccgaatcgttcaccatcatcggcaaaaccccggtggtggcggcgaaaagcaccgtgtactggccgcagggaagcgcgaccatcaacctgcagggcgatatgacgctgcaggccccctccacggacggcaagcaaaacggatgggtggccgtggcgacgccgcgcggactcgcaacggtggatctcagcaccaagaaaacctctgaaacaacgaattccggcaagggcgaggccgcccaaccggtgtccacaggcggatgcgtgttcgccgcatgggcgcagaaagccaacaattacgccaaagtatgctccgtcgacagttcggatacggcattcgacaccctgaccaacatcaacgccacttcggaactgatattccgcaccaaccatcgcctagtcatactcaacgacgtggtcaacggcaacgtctggaatccacaggaatccaccaaagtcatcaaaatccaatggaacaaggtggaaaccaaacagtcgaagcaacaggaacagaacaacgacagcgccaacaaccagcataatttcagcaagacctgctcgtcgcaatccggccagatcaaagccgaagatgattcgttcggcgcgagaacaggatcgcagcagatcctcgacgtgctccgcaacgacgaacagaccgactgctccgtactgcgcatcacctcggtaagcgcccccgacggcgccaacatcagcgtttcccccgtatacgacggacgatatctgcagctcgacgcttccgcggcatccgaaggatccgtatcgttcagctatgaaatctccgacggacgcgggcaaacctccaacgccaacgtaagcctcacactggtaggcggggacgacaacgcgccccagcaaaccgatacgccaccggaaatcgacgtggaacaaggagcgacctacaccaccaacgcgctgggcagcttctccgatcccgacggcgacccgctcaccctcgtatccgcaaccccgcagaacaccgaccaggtgaccgtttccacacgcgccgacgggcagctcgtattcaacgcgggatccatgtcttccggacgcgccggcatcgaagtgaccgtttccgacggccagcagaccggcaccggcatggtgtatttctcagtgaaaccggccaacacgctggccgcggtgatcgatccggccgtcaagcagaccacgccagacacccgcaccaccatcgcgctcaaacaatacgtgcatggcacctcggccgaacccgcgcagctgaccgccgtggaaaccccatccggcgcatccaccaccatgaacgccaccgatatgtcgttcaccttcagcgcatccaaccccggcacctactacgtgccctacaccatcacacaaggatccatcccctcgaccggcctggcccgcatcgaagtgcaggcggtgaccggagactccgccaagcccatcgcagccaacgacgtggcactgctcggcgccgacaacaccgcaatcgtggaaccactgtctaacgacgtcgacccgatgggtggtgtgctatccgtgaccagcgtgaccgccgatgcggcgagcggcatcaaaaccggcgtcgtaagcaacaagcgcgtctacatcaccgcacggcaggtaccgaccgagcccgtgcagatcaaatacagcgtcgccaacgcggcaggcacgtcaaccggcgtgatcgtactgcagccaccggcactgaccacctccaactccgtgccgaaagccgacaacatcaccacgcaggtacgcaccgacggcatcgtctccatcgacgtgctcgaccacgtgacctactccgacggcaccacggtaagcctgcaaaacgacctgcaatacgacaaaaacacgttcaaaggactcgtattcgtatcaggcaacaccgtacgataccaagcatccgaccaaaccggatccttccccgtaacgtacaccgtcaaagacaatctcggcaacgcggcatccgccacaatcaccatcaacgtgcatcaaaaagacgcttccaacaaggctgcgccaacaccatccgacgtcgaggcgcaagtcgcggccggccaaaaagtccaaatcccgatcaccttgaccggcatcgacgccgacggcgacgacgtacagctgctcggtctcggcaacaaggcgccgacactcggacgcatcagcgaagtcggcgccacctacctggtatacgaagcctatgccgactccacaggaacggacaccttctcatacgccgtcgaagactggaccggccaacgatcccaagcgcaaatccgcgtaggcgtattcacatccggcaccgactcgggcgtatacgcgcgcgacgacgaaatcacattgcgccccaacaccgcagcaaccgtgcccgtggcgcaaaacgacatctccggagacaacaccgacctggccgtcagcgaaaacgtcgaatcgcaagacatcagcaatgtgaccgtggcggacaatacgctcgccttcaccactcctcagcaggcgggcacctattacgtggtgtatacggtcaaagacaaggcaggattgtccgacaccgcgacattgacggtgaacgtggacgacaacgccaccatcgaaccgccgacagcatacgactaccgtgtgccatcttccgcgacgatcgataagaaatccatcgacgtggacgtttcgcaatggatcgcgaacccttccggcagcgccgacgaactgcaggtggccgttgatgattccgccaccggccatgcgcatatcaaaggcggtgacaagtccacgaccattagcgtggaattgacggatgaggcacgagccgtgccgtacaccgtgaccaacacgacatacaacatcacgtccacggcgttcatccaagtgcccgcgtacggcgtgttcccgccgacccttcgaccgaaggcgccggcattgaaggtgaacgcacgcgagacgatcaccatcaatatcgccgattatgtgcgcgtgggcgcaggcaagaccgcgtatgtggacggcgccgattcggtgagcgccacgaaggccgcggacggcgacctgtatgtgaacgaccagacgttgaagttcaccgcgccgaaggattactccggtcccgcgtccatcaccttcaccgcggtggatggcaaacgcgacaagaacgacaaggtgaaaatcatcaattcggcggtattgacgttgccgatcaccgtgatcggacgtgacatgcccgcgccgacgttctcctcgtccaccattgacgtggtcgccggcgaaagcgccaccaccatcgatctgaccgcgttgacccattcggcgtccgacctgtatgacgatgagaagcagtacacgtattcgggtggcaccgattccgaccaggtgagcgccaaagtgagttcgaacggcaagctgaccgtgtccgccgacaagaccgcttcgccgggaacaacggtgagcgtgccgatttcgattcaatattcgaagggcacggtgagtgcgggcgtcacggttcgtgtgacggcctccaacaggcctttggcgcgcatcaacgcgaaaaccgtgaaggtcaaggcaggatccagtgaggaagtgaacctgctgtccgatgcgtataatccgttccccgattccgcattgaccgtgaccggatgcacgtccgatgacgcgtcgaagctgaccgtggactgcccgtccaacggtgtggtgtcgatcagcgcctcgtccgatatcggcgcgagcaccaacaaggtgatcgtcaacgtgcgcgatgccaccaatacgaaggaacgtgaggtgacgggcaccatcaacgtttcggtgatggacaagccggatgcgccgctgctctcccccatcgccggagacccgcaggatggcgcggtgaatctgagttggacggccggctcttcgaacggcagtccgatcagcgaatacaaggtgtcgtggggcggcgacggttccggcgagaaatcgtgcggatccgtgacctcctgccaaatcaccggcttgaagaacggcaagacgtactcgttcaaggtgcaggccaagaatgaggtcggctggtcgaaggagtcgaatggcgtggaaggcacgcctgacaagcttccggacgcgccgaccgatgtgaaggccgaagctagcaagaacaccatcactgtcacatggaaggctttggagggtaatttctccgccgtcgacaagtatcaggcgacgttgagcggtccgaatgtggcgaatccggtccaggaagtcactggcaccagcatcacgttcaaattcgacgacaatgcgatcaccgacggcgcatcctataccgccacggtcaaggcgcataacaaagtgaactggagccagccctccacggcatccaatgccgtttcgccttggggtacgcctgacaatccgactatttccgccgatcaatcaggcgacaagatcgtggtgagaggacggatcaatgacgcacgtaactcgaaataccagtcgattacggtaagcatcgagggcgaagacaaatccgtggagacaagcgccaaggattattccgtcgaattcgacattaagaacgagtggtactacagaaaacttaagccgacgattaccgtggttacggaacgcagtggctcattgcgcaacgaagcgtccgtttcgactttcacagcagtcgatcctccaaccaatgtgaagctggaactcaacaacaacacatgtgtggcgacctggtccagaaaaggtggacgcgtcacaggtttcgttgtaaaggccaagggttattacgatgatgatgttcatgagagcagagccgaatggccgctttccggtgattggagcacctgcgatacggtaagcgtgcaacagtacttcatcgacacctcacatctcagcgacccagcaatcgctaccgataataccgtcggcaacaaaaagccagcggaaatcacactgccatcctcattgacgtgggatacacagaacgccaacatcattcatgtcaatggcggtagttgggaggcccacgggcgaagtgtcaaaggccagatcgttatcactccggcaggggaaagctcgcatacctacgattggccagctaacggcacactggatgtttccgacatcaccagtccttccggtaccagatgcgattgggaggttcgcgtgatcaccactgccggggaaccagaaatcaatgcgaccaagaaaagctctgatcccgtgaccggagtccgatacgaggagaaaacccccgatccggaaccgggaccaacccctgataatggagagacgcaatcctcgatagacaccaatgcttcagccatctcattacgaacagggttggcaggaaaacaggcgcgaggcatctcattcaccgtcaaataagcaaattcaacatcacaaccaatcatcaatacgatcaatagaagcaaccaaggagtacctatgagcaacgaaaacgacgacgccacccagctgggttccattgggcgccatatgagcaagccgcaacagcccggcaatccgcaggcacgccccgcattccaagctccaagcctgccgacgcatccgcaggaacaggacggagacgaagagggcacggtactcagcacgcataacgctacccactacgccgccaacacgttcgacgccgacgaggagggcacggtactcagcacgcataacgcaactccttccaggccgacgaggcctacggttccaatggcgcagcccatgcaggcgcaaccgacgcaatccgctccaacacaacagccgctaccacaatcgcaatcggctcccgtaatggcaacgcgccaattcccgcagactacggcaccaagcgtcaagcccgcgcagccggccatggcttcttccatgatgtccgcgccgcaggccgacatcaccgaattccatgaactgttcgcccaactggtcggtaacgtctcccaagtcgtggtcggcaaggaacagccgatccgccaatgcgccaccgccatgatcgtcggtggccacattctgctcgaagacaatccggggaccggcaaaacgcagctggcccgcggcctcgccaactccatcgacatgtcgttcaaacgtatccagttcactccggatctgctgccgtccgacgtggtcggcgtaacctactacgaccagaagaacggcgaattcgaataccgcgaaggtccgattttcgcatccatcgtgctcgccgacgaaatcaaccgagcctcgccaaaaacgcagtccgcactgctcgaggtcatggaagagcagaaagtcaccgtcgacggcgaaacccatgcggtaccgcagccgttcatggtcatcgccactcagaaccccatcgagcaactcggcacctacaaactgcctgaggcgcagatggaccgtttcctcatcaaaacaaccatcggctatccgagccatgacgtaagcgtgaacatcctcaagcaggtcaacgtcaccgaccgtgcttccaccgtacatgcggtgctcaccggcaacgacgtgctgcgcatgcgcgccatcagcgaaaccgtgcgtctcgacgacgcgatcatcgaatacatcgtgcgcttggtggaagcgacgcgccacaacgaacgcatccaagtcggatcgtccatgcgaggcgcgctcgcactgacccgatgtgcccgcgtgtgggccgcgtccagcaatcgcggatacgtggtgcccgacgatgtgaagcaactggccgtcgccgtgctcgcacaccgcatcacgctcaccgcggaggccacattcgcgggatccacccccgaacagatgatcgaacagatcctcaatgaagtaccttcaccgaccgtgggcgccgccgcctgaaacgcacggcgcagccagccgcgtacggcacggcacacgcgaagcgcacaccccacacgaaacgttcgtaaacccccgaaaggtcaagcatgcgacaatccaaaaccatgcagcgcaggagaaccatgcaacgatccctgcgacgcatcaagcatcgcatcaaacgactggtcacctcatacgtgtcgccgctcggatgggccgtgaccggactcgccatcgcctcactcatagcgttcacaatcctcagctggcatgaactgctgaccatggcgatcgtgttcgcatgcatgatggtcgccgccatcatgctgtcgctcggcaacacgtcgttcaccgccaccatagacgtgtccagcaggcgcgtcaccgtgtcagatacggtgaaagtcgatgtgtgcgtcgacaatccagggcgcacgccaaccacatcagcacgcggcgacctgcccatcggagacagccacgaacgattctccatccccatgctcgccgccggccaatcacgccaaaccaccgtggaattcaccgccgtctcccgcgcggtactgccggtcggccccctgtccatacgcaaaggcgacccattcggactcgtacgacacgaaaagaaacttgtcgaccaaatcaacgtgttcatccacccgaaaaccgttatgctgaacacactcaacgccggaattccgcgagatctcgaaggccagccaagcggcgaaatcgtcgacgacgacctcgatttctacggactgcgtgaatacgagccaggcgacgacgtacgcaacgtgcactggctcagctccgcaaaaacaggcgcactgatgatccgtcaatacgaggcgacccgacgcaccgacaccgcattgaccatcagcgtgaaccccgacgactatgtgagctccgacgaattcgaactggcggtatccgtccatgcctccatcggcgtgcaatgcctgctccaaaaccgaccggtgacctcacacgcgggaaccgaacgcatcatgccacgcaactccacggaattccttgacggctgcagcgccatctcccccgatatcagcgacaatccgaatctggcgcaaaccaccctcgcccacgcccccgactcatcgttctactacatcaccgtcggcaggctcaaaaacatcgacgaaatcaaacacatggcgctcgcactcccccgatccgcaacctgcgtggtactgcaaaccgccatcggacagccacgcgccatcaaacgatacgccgatttcaccctggcgaccgtaggaaacctagacgatctcccaatgatcatgggggtactggaatgagcaccacaggactttccacccacaacaccaacaccggcgacaccggccgcaccaccggattcggcaacaccttcaccggaaccggcaccggctcatgggccgactccacacactccgtcatctggatgtcacgagacggcaaatcacaggcactcccctacctacgccggacacgcgcctcgcaatacgcaagcctgctcgtcgcagccctactcaccctcgccgccgccagcaacctcatcgacgtctacggatcggccacatcctgggcgctcgccgccattccggccaccatcatcggatctctcgtggcgctcgcaggcacggttccggcacttcgtctctggtggcagatgctgttcatggccgtcgcccagctggttgtcggccctgtactgttcctcaacgacaccaccatcgcccatattgttccgaccttgcgcacgcttacacaaggctggatgaacatgctcggatcgttcaaattcattctgtcggtcgaacctcctaccggtaccgccgatggctgtttgctggccgtatggaccatctgcctgtggttcgcgctactgaccggcattttcgcagtgactgaagatgggcgattcaccatgatcgccattattcccgttaccgccaatcttgcgatttgcgcgctgctcggctcatcttccggctattaccgcatgttcgtaggcaccataatggcgctcatattggtgatttggatcagcgcacgttggaaattactggaattgggacgttggctcagttccgtcgtgatcgtggtgctttccgtcgcattggcgattggaggatgcctcgtcgtcgatcaggaccgcaccattctgcgcgaccattatgatccgccgcttagcccgtacaattacaccagtccgttaagcggcatgcgctcgtacattacaaacagtaaggacgatgtgctcctcaccgtcgaaaacctgcccgctggatcaagcgtgcgactagcggtcatggaccgtttcgacggcaacgtatggaatctgtccgactccaccatgtcgtcggactcctccaattaccgacgtgtcggcacctccatcaccaacaatgccgaaggcaagaaattcaccgccacattcaccgtggacaaaggactcagcgactactggctgcccatggccggagccgcatccagcgtgacattcgacaacagcgaaaactccgactcgttctactacaacagcgacaccatgtcggccatctacccctcacgcacctccgaaggtctcacctacacggaaaccggcatcatgccaacggttcccaccgacaaacagatcgccaaaacagacgcggccgccatcagccagccaaaagccgaagatgtgcccgactgcgtagacaaactcgccacagccatcgccggaggccaatccaaaggcggcgaagcggcccaggccttagccgaaaagctcaaagaatccggttggttctcacacggattaagcggcgactacccgtcaaccgcaggccacggcaactaccgcatcgaccaactgctcgccggaacggccatggtcggagacagtgaacaatacgcctccgccatggcattgatggcacgcagcctaggtcttcccagccgtgtggtactcggattcctgccaaaagacgacgaaggtgaaatcagcgaaagccgcaccgaagaacaaggaacaaccaccatcacgaaattcaccggcaacgacgtgaccgcatgggtggaaatcaaactggacggctacggttgggtggcattctatccaacgccaaaggaaaccaaagtccccgacgaaaaccagaacctcaccccaccgaatccacaaaccctggtacgccagcccccggtaccactcaccgacccgctacgcgacgacacccaggccaaaggcaagtcctcaatcggcggaagcatggccgacgaaacctcagccaacctgttctggcagcatttcggcagaatcgcaagaaaagtagccatctacggaagccctctatggacgctgctcatcatatgcggtctcctgctcgccatcaaagcgatcgcactggcacgatcaagaaaacacggcagcacgcagcagcgtgtggcagccggctggcaatcggtcgccgcgctcgcacggcaaagcggactcgacattcgaggcacacgcagcgaacaggcggtttcgatcgcgaatcagatggatatttcccgcgagaccttgctcgctttgggcgcgcaagccgattacgcggccttctccggtaatttcgtcaacgaagagcatgtgcagcagtattggcgcgatattgcgcaggaacgcaagtacatgctcaagtcattgccgacgttacgccgatggcgtgccaaactttcgcttgccgacgttttccacttccgcagcaaccgcagcgggcggaacaacggcagcgatcggaagcacaatcgtaagaaaggacgggactcatgatcttccgtagcatcgaggccggcctgaatagcaatgtcgggtgcaaaagaaaaaacaaccaagacaacgctctcgccagccgtggcgtatatgtcgtatgcgatggcatgggcggcggcaaaggcggcgagcgggccagcgcacaggtggcggcatgtttctcgcagcttgccgaacagccgtcgcgcaaccgtacgtccatcgaacatgcgttgagccaatcgcagcaacaggtgctcgaacttggccaggagcttggcggcatcgccggaaccaccatcaccggcgtggtgctgccgactcgcgttgaagatagcgtgcatgaacaagccatcgatgagtactgctacgtcatcaatgtcggagattcacgcacctaccatatgcgcgccgatgcggaaggccattggatggcggagtcgctgacccggatcacacgtgaccattccgaacggcagaacgccatcgacaccggcgaaatgctaccggacgaggcgaaccgatgcataccgcgcaatatcatcacccaatgcgtcggcgctcctgacggcattcagccggactggtatgcggcgcgctccacgggacgtttcatcatctgctcggatggcctgcacgcgcagatcgatcgggaactgctcgccgatgtggcggccgcatatggcgatccgcaagtcgccgcggatatgctggtgcagtccgcgctcgacgcgggcggcaacgacaacgtcaccgtgattgtgcttgatatatgcggcaaatcatcggattattcggcaaatgacgattggaacgtcagcaaaatcgacgatcacgaggatatcggcgatttacaggaaagcacattgcaaacgttacgtgccgtccaataatgcgcatgttctcgcaatgacaatcgtcaataatcggatttgtcacgttatatcagcgtattcaatacaatatttacagaacacgagataaggagatcatgatggtcgatttcgatgccgcggtggcggccgtgcaggatccgaacgcagatcccgtgtttctggcgaaaatcgcttacgaaaatccggaattcggcgcgaatgtggttgccaatccgcgtgcgtacccgggtctgaaacgttgggtcgcccaattcggcgacgaacgcgcacgtcagcagctggtcgcgatggggtggccggttccacaggacggaatcatgcagcaggaggccgagacggcttctgaacaggcgcaataccagatgccaagcgaacaggcgcaataccagatgccgcagcaatcatcggaagtgcaatatcaggcgcagtaccagccgccggcaacccagcaatgccagcctgagccgtttgcggcaacacctgcatcaaatatggcgaacgatgcttcgacggaatacgtcgacccatataccaaccccgcagacctgtctgaagtggctgatttttcgccgattcagccgcaagagccagtcgcgtcgaatgctggtttcaccgcggaattggccatgaccacggaagatcagatgctgatggctgaaatcgcaagcaaagctccggagctgcaccccttccttgcgcgcaatccgcatatctacccggatctgctcaactggcttgccagtctcaatgattccgccatcaacgcagccatccgtctgcgacggtaaccccttggtagaacttggcaaaagcccgacgaaagccgccaaacaaggcctaataaaagccgcttgcattggtaagctttcgtaccataatatgttcgttgcgccgtcatcctcatttatggattgacggcgcaacatgtatcgcggcgcgaaggaaatcagcgctgttcgaaagtgaagaactggtctccgatacgcaccgtgcaaggcgcgtcaagcttcatcggcttgcgttcgaccttgatctcctcattgccttgaatgatgtacgtgccgttgagcgaaccgtaatcctcgatccacaatacgccatcctgatcgaagctgatcgccgcatgattgcgtgagatggtgcgcgtcggatcctccaacttcacgaatttcgcaccttccggcacttcagcggaaggcttgcgtcccagcagcacacccatatcgacgatcacttcctggccggtctgctcgttgtaaagcacatactccagcttcggctgcttcatggtgaacgccgaagagagcaccgtgccatcccagtcgatgtcatcatcgtcattgaccggttcgacgtcggacggttccagcgctgcggcagcctgttccaccggctgtatgttcgccgcatacgattccgcggattcctgcacattttccaatgcttggaatgcttgggattccggtgattcgtatgttggctgcgatgttggctgcgactgcgcagcctccgccatggcgggctcaacgagagaagacattactgtggcatcatcgtcataccaacctggttcaggtggaggcggatatggaagaaagctcataccttcattgtaatttgccatgcgattttgcgatgaagatatccgctctgcaatacgtacggttccgcaataggctgactgttgtcgtagggatcgcagcaactgcagttccgcattaaaaatagttccgcattaaaaaaaaaatggggatcagctgtttccagccaatccccattcatgtattgagatgatttcagacgttatgccattccatcatcgcttttcggatcacagggtgtcgcccaaatccatctgaccgccattgtcgtccaggaagtcatccggattgaagtcgtcgccgagcttcagatctccgaagtcgatgttcgagaagtcgacttcggacagatcggcgtcgccgaaggcggcatcggactcgtcgccacccaaaccgaagttcgggtagatggtgtcgcgaatggccttgtcaggctcgaccacggcgttacggtaacgggcaaggccggtacctgccgggatgagcttaccgatgatgacgttctccttgaggcccttgaggtcatcgaccttctggctcagagcggcttcggtaagcacgcgggtggtctcctggaaggaagccgcggacagccaggaatcggttgccagcgaggccttggtgatgcccatcagctccggacgaccggcagcaggcttgccaccttccttcacggccttcatattggcggccttgaagcgggcctgatccaccagttcacccggaagaaggtcggtatcgccggaatcgatcaccgtgatacgacgcagcatctggtgcacgatgacctcgatgtgcttatcgtggatatccacgccctgggagcggtacacggtgtgcacttcctccacaatgttcacctgggcagcacgcgggccgaggatgcgcaggatcttcttaggatcgacggagccttcgatcagctgggtgccggcttcgacatgatcgccgtccttgaccatcatcggggcgcgacgggtcaccgggtaggcgatcggctcgacggaatcgtcgtccggcttcaggatgacctgacggccgcgctcggtgtcttccaccttgaccacgccagcgaactctgcgatcggggcctcacccttcggagtacgggcttcgaaaagctcggtaacacgagggagaccctgggtgatatcggatgcggaagcaacgccaccggagtggaaggaacgcagcgtcagctgggtaccaggctcgccgatggactgtgcggccacgatgccaacggcctcgccgacatccaccagcttgttggtggccagcgaccagccatagcacttggcgcacacgccgcgcttggattcgcaggtaagcacggaacgggccttgacctcttccacgtcgtgggcaacaagatcgttgagcacgtccatggacagcgcgtcaccggccttgtacagcacggtctcgccgtcggcgggatcgatcacgtcggttgcgagcagacgggagtacggaccgccatcggcggccttgaccagatgcaggttgccttcagcatcacgctcgccgaccttcatcgtcaggccacgcttggtgccgcaatcctcttcgcgcacgattacgtcctgggaaacgtccaccagacgacgggtcaggtagccagactctgcggtacgcagtgcggtatcggccagacccttacgtgcaccgtgctgggagatgaagtattccagcacggacaggccgtcacggtagttggacttcaccggtcgaggaatgatctcgcccttcgggttagccacgaggcctcgcatgcctgcgatctggttgatctgcatcatgtttcctcgtgcaccggactgcacgatgatagccaggttgttcttggagtcgaagtgttcctcgaccgcctcagaaacctcgctggtgcacttggtccacaggtcgatgagttcctgacggcgctcctcttcggtgagcataccgatttcgtagttctcgttgaccttgtcggcttcggcttcgtacttctcgatgtactcgtcgcgctcggacggctggataacgtcggagaacgcgaaggacacaccggaccacggtgcgcgggtgaagcccatatccttcagcgcgtccagcgttgccgccacctgtgcggtggagtaacgggttgcgatgtcgtcgacgatcttgctcagacgcttcttcggagcctgatcgttcacgaacgggtaatccaccggcagcgtgctgttgaacagaatacggccataggaggttgcgaaaagcacggaaccatcatggaagcgctcttccttcaccacggccgggctgcccggttccggatcgacgacttcgatttcgctcggctcccagcccttcggcagcacaaagtcttccggaaggcggataagcaccttggcctgcatgtcgatctcatgcttgtcgagggccatttcggcctcttccagcgaggagaacacgcggccctggcccttggcaccgtcgatgacggtggtcaggtagtacagaccgaggatcatatcctggctcggcatggtcacggtgtggccgtcagccggcttcagaatattgtcggaagccatcatcagggagcgtgcttcagcctgggcttcagcggacagcggcaggtggactgccatctgatcgccatcgaagtcggcgttgaatgcggcgcaggcaagcggcggcaggtggatggccttgccttccaccagaatcggctcgaatgcctgaatacccagacggtgcaacgtaggtgcacggttcaggagcaccggatgctcggcgatgacctcttcgagcacgccccacacttcggagtcgccgcggtccacgagacgcttggcgctcttcatgttctgggcatagttgaggtcgacaaggcgcttgatgacgaacggcttgaacagctcgagggccatcggcttcggcagaccgcactggtgcatgcgcagggacggaccgaccacgatcacggaacggccggaataatccacacgcttaccgagcaggttctgacggaaacgaccctgcttacccttgagcatgtcgctcagggacttcagcggacggttggaggcgccggtgaccgggcggccacgacgaccgttgtcgaacagggaatcgacggcttcctgcagcatgcgcttctcgttgttgagcatgatttcaggagcgccgagctcgatcagtcgcttcagacggttgttacggttgatcacacgacggtagaggtcgttgagatcggaagtggcgaaacggccaccgtcgagctgcaccatcgggcgcagatccggcggaatgaccggaatcacgtcgagcaccatggcctccggcttgttgccggtggtcaggaaggcgttgacgaccttcagtcgcttcagggcgcgggccttgcgttggccggtaccggtgtcgatctcttcgcgcagctgcttggaagcggcttcaagatcgaagtcctgcaggcgcttcttaatggcttcggcgcccatgcagccttcgaagtaatcgccgtagcggtcttccatctcacgccacaggtcgacgtcgccttccatgtcgcccggcttcaggttcttgaagcggtcgaacacggcgctcagacgctggatctgctcgtcgaaacgaacgcggatggcggccatttcacgctcggcgctgttgcgcagcttggcgcgtgcggagcccttggcttcgccttcggcctcaagttcagccagatcggcttcgaccttcttggcacgctcttcgatttccgcgttgcggcgcttctccaggttggcgatatcgttgtcgaactcgtcctgcagacccggaagatcctcatgacgctgttcctcatcgacgctggtgaccatgtaggcggcgaagtagatgaccttttccagatccttcggagcgatgtccagcaggtagcccaaacgggacggaacacccttgaagaaccagatgtgggtcaccggagcggcaagctcgatatggcccatgcgctcacgacgaacacggctcttggtgacttccacaccgcagcgttcgcagacgatgcccttgaagcgcacgcgcttgtacttgccgcaggcgcattcccagtcgcgggtaggtccgaagatctgctcgccgaacaggccgtctttctccggtttcagggtacggtagttgatggtttcaggcttcttgacctcgccgtggctccagttacggatgtcgtcggcggtggccaggccaatcctcagtttgtcaaatgcgttgacgtccagcactctattgtcctgtctatcgattcttaatgcttaatcacgtttcatcaggctggtcgcgccgcgctgtcaggcaacgcgaccagccttgggatcactggaattcaggttcttccacaacctggtcttccttggcggccgcgtcaggacgtgcgccaatgttgaagcccaaatcgtcggaggaagtagacggatcgtcgtcctcgtccttcatgtcgatggccacgccttcggcgttgagcacttcgacgttcagcgacagggactgcatttccttaagcagcaccttgaaggattccggaatgcctgccggcggcaggttgtcgcccttcacgatggcgccgtagacacgcacgcggccgtcgacgtcatcggacttggtggtcatcatttcatgcagcgtgtaggcggcgccataggcctcgagggcccacacttccatctcgccgaaacgctggccaccgaactgagccttaccgcccaacggctgctgggtgatcatggagtacgggccagtggaacgcgcgtggatcttgtcgtcgaccaggtggtgcagcttcagcatgtacatgtagccaacggagatcggcttcggatacggttcgccggtacggccgtcgaacagcacagccttgccgtcgtcgccgaccagcttgttgccgtcgcgatccggaagggtgcaggacagcaggcccttgatggtttccggacgaacgccgtcgaacaccggagttgccaccggagtgcccggctcgcccttttcggcgccctgcggaatgtacttcttccaagcggcttcggcatccggatcaagggagatgtcccagccggcgtgcgcgatccagcccaagtgcagttccagcacctggccaaggttcattcgagaaggcacgcccagcgggttcagcatgatgtcgaccggagtaccgtcggcaaggaacggcatatcctcttccggcagaatgcgggagataacacccttgttgccgtggcggccagacagcttgtcgccctgggtgatcttacgatgctgcgcgatgtagacgcggatcatctggttcacgccgttcggcagctcgtcgccgtcttcctcggcatcctcgcgagtgatctccttgacggcgatcacagtaccggtttcgccgtgaggcacgcgcagcgaggtgtcacgcacctcgcggctcttctcgccgaagatggcgcggagcagacgctcttccggagtcagctcggtctcgcccttcggggtgaccttgcccaccagaatgtcgccggcttcgacctcggcaccgatgcgaatgatgccacgctcgtcgaggttggccaccgcgtcctcgccgacgttcggcagatcgcgggtgatctcttcggcacccagcttggtttcgcgggcgtcgatctcatattcctcgatgtggatggagctcagggtgtcgtcctgcacgagacgctgggagatgatcacagcatcctcgtagttgtagccgttccacggcatgaaggcgatgagcaggttcttgcccagtgccatttcgcccttctgggtggccggaccatcggcaagcacggtaccggcttccacacgttcgccgtcgtggatcagcggaacctggttgtagcaggtggtctggttggaacgcaggaacttggccagcttgtaggagctggtggtgccgtcgtcgttcatcacacggatgatgtcggcggaaacatacgtcaccacacccggcttctcagccagaatgacatcgccggaatcgacggccgcacgccattcggcaccggtgcccaccagcgggcgctcggattcgatcagcggcactgcctgacgctgcatgttggtacccatcagcgctcggtggccctcatcgtgctccaggaacggaatcagggaggcgccgacggaaaccatctgacgcggggaaacgtccatgtagtcaacggagctgacgggcacatcgactgcttcttcttcgccgactcgggcaagagcctgcttcttgacgaagttgccgttctcgtcgagttcctggttggcctgtgcgatcacgtgctcggcatcgcggtctgcggtcatgtattcgacctcgtcggtcacatggccgttgatgaccttacggtacggggtctcgatgaagccgaacggattgatgcggccgaaggttgccagagaaccgataagaccgatgttcggaccttcaggagattcgatcgggcacatacggccgaagtgggacgggtgcacgtctcgcacttccatggatgcgcggtcgcgagacagaccgccagggcccagagcggacagacgacgcttgttggtgacgcctgccaacgggttgttctgatccatgaactgcgacagctgggaagttccgaagaactccttgatggtggcgttcaccggacgaatgttgatcagggactgcggggtgatggcctccggatcctgggtggtcatacgttcgcggaccacacgctccatacggctcagaccggtacgcagctggttctggatcagttcgccgacctggcggatacgacggttgccgaaatgatcgatatcgtcgacgtccacgcgcagatccacatcctggccgtcacgcttgcccgggaacttggtgtcgccggcatgcagggtgaccaggtacttgatggtggagatgatgtcttcgcgagacaggctgcgatcgttgacatccttttccagaccaagcttgcggttgatcttgtaacggccaacgcgggccagatcgtaacgcttggtgttgaagtagaaggaatccagcaggttgcggccagcttccggcgtcggggtgtcggccgggcggatcttgcggtacagatcggtcagagcctcgtcctgggtctgcacggtctccttggcaagcgcgtccataaccagcgggtaatccctgaacgcatcggcgatctcatccttggtcatgccgatggccatgaggaacacgatggcggactgcttgcgcttgcggtccacgcgcacgccaagcacgtcacgcttgtcgatctcgaactcaagccatgcgccacggctcgggatgatcttcgcgccgaagacttccttgtcggaagtgcgatcctggctgcggtcgaagtacacgcccggagaacgcaccagctgagacacgatcactcgctcggtaccaccgatgatgaaggtgccgtgcggggtctgcagcgggaaatcgcccatgaacacggtctgggacttgatttcgccggtgtcgccgttttcgaattcagcgttcacatacagcggcgcggagtaggtgtaatccttctccttgcactcctgcacggtgtggcgcggttcttcgaaatacggatcggagaaggtcaggctcatggtctgagcgaagttctcgatcggggagatctcctggaagacctcatcaagaccggaggtgtggggcacggtgttggtgccgttcgccagatcctcctcgacacgcttctgccagcgctcgttgccgatgagccagtcgaagctgtcagtctgtacacccaacaggtagggtacatcaatgggctcgcggatggagccgaagttcacacggtccgacgccttgtgcagatcaatatcgtgctggtcggcgcgtgcgatgatggtggtggtgttcgtcgtagcctcagccaatggacgttccttatcgctcgctaaatcgtttcgatatgtttccccggaagcgctcccattggccaccatatgcctagtacgcgggcgcttcttccttgtcagcgtgcccgctatatgacacgcatgtacgcaaagtcatgagaataacatatcctatagatttttattcaatagtgacgccgaccggatcggacttcgctttgggatgcccttcaatcgaaagctgcgccgaatacacgccacgatccaccttcggcagggtggattgatcctccacgcattcgctgccagtacgcgttcccggccaggtgatcgtctgtctgacctcgtcgcccttcgccaacagacgatagtcggtgtcaacggggcacacattcgacttccaaaccacatcatcgcccgatttgatcgtcaacaccacgctggaagccgacacatcaaccaagcaaccaaccttgctggaaccgtcatatttgacgtccgtagtgaaatccatcgaatcgcccacaccgaaacttgacgccgcaggagtcaacgaaagcgcgacattggacgcatcgcaatccggcaccccgcttttcttctccttggtcggggacggcacttccttacgggaaatcgcatacacgtccgcatgatgaatctcacgattcaccgcgacaatccccctcgacagggagtacaggcaaaacaccagaaaagaaatcagcactatcgcagcgatgccgacgacgatgcgacggcgacgaaatatcgcctgctgttttttcgaacgtttcttgccggatttcgaggacgtcttctgtgccatgatctcacagtctagcgtgcgcacatccaaagaacgtcggcattcttcctttcataccggaagacgcacatccgcattcggcaggatttcgataagaccatcctcatccaacgatgcgatgcaccgatcaagctggatatggtcgtcccacagtcgttcaagcgacttgcgattaagggcgatcgcaccttccggcagattgcgcagcgcattcagcaccagcccacgcacctgacgatccgtaccttggaaacgttgacgcggccgcgtgcgacgttcccccaatcccggacgaccattatgcaaaaacacgcaatgtcccgaaacagggcacgcctcgcacaacggagcctttgccgtgcagacggtcgcgcccaattccataacggactgattccacaccactgaaggacggtcgaaccgtctgcattttgaggcatcatcctgcggcaacatctgcttcgccaacgcacgttccgcaggtcttgcggcgccgccaagcgactcctcgccaagaaaaaccctcgaaagcaccctgcgaatattcgtatccaccaccgcgatgcgctcaccaaacgcgaaactcatcaccgcgctggccgtataatcgccgatacccggcaatgccagcaactcatcgtacgtacgcggcagcttgttatcgtaatcggaagcgaccacgcgggcgcattcctgcaatcgcaaggcgcgtctcggatagccgagcctgccccaagccgtgatcacatccgctttcgcggcatcggcaagcgcgaccgcatcaggccagcgttccatccaatcgttccaatacggtaccacacggctcatctgcgtctgctggctcatcacttcggagacaagcacgccccacgcagtagtgcggccgaaacgccatggcaggtcacgcgccgaagcatgccaccattcggcaagcgcgtccgccacagcttcggcgttttcaatttcggtattaggctcgttcgtgtcgttcatcgtacctattcttgcattcatgacgaacgaagagcataccaatgacgcgcaaggcgcaaccgcagcggaagccaaagtcgagaaaatgttcgaatacggctaccgcaagtcgaattatgggccggacgaactcgtgaccgacgcgcacggcaatccgatttccgtggtcgacgcgatgctgtcagccgaagacgcggccaaagccgaaacctccacgccccacttgtgctactactccccccgcattccgggcaacaccggttcggcaatccgcctatgcgcggtgaccggcacgattctgcatttggtggagccgctcggattcaatctgcgcgatacgaaactgcgccgtgccggactggactaccacgacatggcccacgtggtattgcacccgaattttgagaatctggtggaatccatgccgaattcgcgcatcatcgcgttcaccgcgcacgccaccaaactgtataccgacatcgaatacaagccgactgacattctgctgttcggcccggagccgggcaatattcccgatccgatggatattatggccggtccgcacgtggccgaacaggtgcgattgccaatgcgcccgagcctgcgttccctgaacctcaccaattgcgcatccatcgccatctacgaagcctggcgccaactaggcttcgccggcggccagtaatccctcccctgcctgcaacttctaggtttttcaataatttacttgcttttgtatagtaagttccgctggagaggcggcggggtctattcccgacacgctccaggccgctcaggccaagtctttacggtctgaaacagaccccgccgcctctccagctacgctgagttcaacttaagtaagttttcttttcttttatgcaagacacaacgaaatgtacggtctcgagcagaagagcgggatattctgttcgagaccgtaagcttggccgaacggccttgagtgtgtcgcgaatagaatatcccgctcttctgtgacctccccattacagcaacttatgcacccaacgcaagcacaaatcgcaagaatgaatcgcacgcgacaagcatgcatcgggaagagaggggctagtttttgaagctgtggattggggcggggatgcggccacctcgggtcacgaaagcttcgcagctggtctggttgactggaatgatcggcgcatagcccatcaggccgccgaagttggccatctcccctacgcctttgccttcaaccggaatcacgcgcacagccgtggtcttctggttgaccataccgatggcggcttcatcggcgatgatgccggaaatggtggaggcggtggtgtctcccggaatggcgatcatgtcaaggccgacggagcatacgcaggtcatggcttcaagcttttcgatcttcaggcagccgttggtcgccgcgtcgatcatgttcttgtcctcggagacggggatgaatgcgccggaaagtccgccgacgtaggaggacgccatgatgccgcccttcttcacctgatcgttgagcatggcgagcgccgcggtggtgcccggtgcgccaacctgttcgaggccgatcttttcgagcacttcgccgacggagtcgcctacggccggggttggcgcgagggaaaggtcgatgatgccgaatggaatgccgaggcgacgggatgcctcctgtgccaccagctggccgacgcgcgtgatcttgaacgcggtgcgcttgatggtttcacataggaattcgaagtttttgcccttggcttcgtcgagcgcgcgggaaaccacgccggggccggagacgccgacattgatgaccgcgtcgccttcggttacgccatggaagccgcctgccatgaacgggttgtcgtcgggggcattgcagaatgccacgaatttcacgcatccgtaggagtcgttgtctgcggtggcgtgtgcgatgtctttgatgatgtggccgagcagttcgacggagttcatgtcgatgccggttttggtggatcccacgttgacggacgagcagacgatgtcggtttcgctcagcgccttcggcagggaacggatgagcagctcttcggcgggggtcatggatttggacacgagtgcggagtagccgccgatcagatcaacgccgacttgctttgccgcacggtcaagcgcatgcgcgattttcacgaaatcgtccgacgtcttgcaggagcttgcgccgaccaacgagatcggggtgacggtgatgcgcttgttgacgatcggaatgccgtagtcgcgttcgatggctttgccggtggatacgagatccttggcgtacgtggtgattttgttgtagatgttgtcgcagacttcgtcgacgctgtcggccgcgcagtccagcaggctgatgcccatggtgatggtgcgtacgtcgagcttctcctgctcgatcatctggttggtctcgtggacctccatgatattcagcatgatgtgttccttcgctccttaccgatgaaccctgatggatcagacgcggtgcatcttggtgaagatttcctcgcgctggcagcggatgcgcacgccgatctcttcgccaagcttgtcgagatcgtccacgacctcgccgaattccttgtcggtgttggaataatccacaatcatcatcatgttgaagaaaccgtcgatgatggtctgagaaatgtcaagcacgttgacctgatgctcggaaaggtaggtgcagacgcgtgcgatgatgccgacagtatcctggccgacgacggtgatgattgccttgttcatggaactccctaaacgttaggtgcgaatatccagttaccgtctcggcaaaatgccggacgtgccttaagtatagaaaaggcagatgtcaaaaaagtcgttttttcggcaatcgcattacattgtgagacgatttcttccgtcaaaccggtttcaaaagttgcggaaagtcgttttttggaatatctgttttcgacgtgaaatcggatttcataaaagaaaagcgcctgccgatcgtttggaaatacgatttcggcaagcgctttttacaatatgtcatgcgattcacttttcgctgatcttgtcttctttcaggaagaaggagaagaccagcacgatgacgatcagcaccaagccgaacacatagccgtagcgggatcccgcaacgaagccttccgcatcggtggcgccggagcccatcgacagcaggcaggtggcgatggacgtgccaatcgcgccgaacacctgctgcatggtgttaagaatggtggagccgcagcttcggtatctcatcaagctagccgtatctggtctacggcatcgtgcctgctggccatcgtcgtgagatagctgtgcacccatctggcccacaagtgaatcatgcagaaacgcgcgttggcgcacgtccttttcatggacgtgcgccaacgcgcgtttctgcatcagcttctgcgatcaggcctcacggctcgcggaagccgcagcgaacgccggcaaggcgcgaggtgcgttgaaaccttccttttcgaagcggtcagcaatcttctgtgcgatctcgtgcccctggcccttatccaccagggcgatgatggagccaccaaagccgccgccggtcatacgcgcaccatacgcaccgttggcacgggccacgtccacggcaatatccaactcgggcacagtcacttcataatccgcagcgagcgaatcatgagacgcgttgaacagtcggccggcctcgtcgatcttgccgttggcgaaggcacgcacgaaggagttgacacgggcgatttcggtgatgacgtggcgcacgcgcttcttcatcgtgtcgtcttccagcttgtcgagcgtttccttgagcgcctggaacggatcgtcggacttggcgatgctgtcggcgaccacacgcaggttggccacgccgaggatttcggcggccttctcgcaagtggcgcgacgctgggcatactgtccgtcgttgagctggtgcggagcctgagtgtcaagcaccagcagttccagaccgtacttgtcgagatcgaattcctgctgggagacgttctccagcgggctcagctctggacggcaatcaagacgcaacgcatggccgaaagtgcagcgcatggatgcgttctgatcgagcccaccggtggacgcgcccgccatgtcgttttccgacttgatggcggcgttgatcagcgtcacacgaccggcatcggatgcgccataacccaaaccgtacacgtcatccaacgccaaggcggtggagcaggtcatggctgcggaggagctcagaccggatccgagcggcacgcaggaggagaatgccgcatcgaagccctgcaccgcatcgaagccggcttcgcgcaatgcccaggcaacgcctaccgggtaggcggcccagccttccacgccaccggcctgcaggccgtcgaggtcggcttcggtaacgttttcggagtcaacgtcggaaaccacgcgcaccttggtgtcttcacgcggcttgagcgcgatgaacgtgcggtgcggcagtgcgatcggcaggcacaggcccgcgttgtagtcggtgtgttcgccgatcaagttcacacggcccggtgcggcccatacgccagccggctcctcaccgtaggtggcacggaacagatcggtcgcgttcttcacaccctcgtcgtgcgagagcggctcaatgaattcaacagcagtcattggtgttttgtcctttgggttttattggctttcagccttcgatatcgactggtccgagctcgtggaagcgcttggcgatgagttccggcgtggtgtcggaaacccatgcggccatgccggattcggatccggccagatacttgatcttgttggctgcgcggcggaacgagaagaactgcaggttcaggcggtagttttcacggcgtacgtcgtggatcggagcctgatgccatgctgcgatgtacggcaggtccatacccttgccgtcacccttgtcgaagaacgcgttgccgcgcttgagcagggtggagtacatgacggccagatcccaacgttcctggtcgttgagctcgtcgagggtgagcacgtcgcgcaccggggccacatgcacctcgaggggccagcgggctgctgctggcacgtaggccacccagctgtggttgcgcatgacgatgcgctccccggcctcgatttcggagttcatgagatccttgagcaggttgccgccggtcttctcatggtaggcttcggtctgcttgagttcggcttccatcttcggcgcgatgaacgggtagcagtagacctgtccgtgagggtgtgccagggagacgccgatttcctgtccgtggttttcgaacgggaagatctgttcgatgccttccatcttggagatttcggcggtacggaacgcccatgcttccacgacggtgcgcagacgggagaccggcaggtctgccggcagaccgtcttcgtccgggtcgaagcagatcacttcacagcggcctgcggcgagcttcttctcccacagcgggttgccgttgacgtattccacggcttcggaacggcccggcacgcgaaccatcgacgggaagcggttttcgaacacgaccacgttgtagtcggtgtccggcacttcgccgtcctggtacgggtcgcccggcttgcgtgcggccagcgggttgcctttggcggtggcgccagggcccgcggtgatcggacggttcatgcgtgcggtcgccataggaatccagtcgccggtcagtggatcgcgacgcatttccggagcagcgtacggcacttcctcaccggccgcgttgagctggttggagaaacgatatgccagctgacgaggatcgttcagttcgcgcgtcttcgcgccggaaacgtattccggatcatcgtcgaggtagaagaaagcgcggccatcggcgagcgtggtcggcgtgatgcgaatgtgctccttcgcgtactctccgggagtgtagtttgcgaattcactcattatggttattcaccttcctgaataggctcgctctggtgtgccagcacgagctctttaaccaaatcccttgttttcccaaccgaatcggggtctagtccatcatcggtaatgaccgtgtccacctggtcgaagcgtgcgaaaagcgacaatgatgtgcagctccacttggtgtgatcggtcaaaattatggtgcgatcggcaatgtccatcattgccatatcggttgcggcctcaagcgagttcggcatgaggaagccgcgcggaatggacacggaatgcgtgcccaggaagactgtgttgacgcgcagggaggccaccactttgtctgcgatcgggcctacgagcgagttggatcgggtggtcacgccgccggtcacgatgacttccacgtctttcgattccagcgcctgcaccagttccgccaccggaatggagttggtgaggatggtgatccccgacgactgctgtgattccagcagatgttgcgcgaatacgtatgcggtggtgccgccgccgatggcgatcacgtcgccgggtgccacatatttgatggcttcctgtgcgatggcgtccttcaatccgatgtccatctgcgactttacggagaacagcggctcactcagcagcgtgctggtggtgacggcgccgccgtgcacacgcttcagcagacccttgtcggccagatcggcgatatcgcgtcggatggtcatggcggaaacgcccaattccttggacaatgcggtgatacgcaccgcaccgcgggtacgcaacctgctcaaaatcaaatgctgacgttgtgacgatatcattcgaacattatcgcacatgttcactcaaaataaaaactgagatgagcgtttcgcgcgttttcctcacgaaaaaatatacttggcactcctgtaatcgttcaaatcgaacaaaaacgaacgtcgacatcccgtcagcgaaatcaatcgacgtgttgctttcctgcgacaaacggtgcgagaataatgaaccatgacgtatgtttctgagaatttctggcacgatgcggtgaacaaagccaccacagatctcttcaccttcggctacaagcacatcatcaagccgcatttcgtgttcaatcagacgcccgatgtggcgcacgaccagatgattcagttctgcaagatcaccaagaacattccgccgctgatgtgggcgtgccgtgaaatgctcaactattccgaccccgtgctggaaaccagcgtgatgggcgtcgacttcgtcaatccgttcggcctttccgccggcctcgacaagaactgcgagatgccggtgctgctcgacaacgccggcttcggcttcgaaacggtcggatccaccacgtctcgtccgtgccccggcaatccgaagccgtggttccaccgtctgcccgaatatgattcgatgatggtgcatgtcggtcttgccaatgagggttcggaaatcgttgttccgcgcgcggaacaggcttggacgaaggcgcgcgacatgcagatttccgtgtcgatcgcgcgtacgaatgacgataagaccggcgatttggacgaaggcatcgaggattactgcatttcgatgcgccgcacggccggtcgcaccgccatgatcgaagtgaacatctcctgcccgaacacgatggccggcgaaccgttcaatcagagccctgaagcgctcgacaagctgttcaccgaactcgacaagatcgaacgtccacagcccacgctggtgaagatgccgttgaataagtcctgggaagagttcaaggatctgcttgacgtgcttgccgaacacaatgtgcagggcttgtcgattgcgaatctgcagaaggaccgcgccggcatggagattcctcgcgattgggagggcggactgtcaggttcgccatgctatgaggccagcaacgaacgcatcaagcaggtgtaccgcgagtatggcgaccgttttgcgattgccggcatcggcggcgtgttcactccgcagcaggcgtatgcgaagattcgttccggctcgtcgttggtcatgttcatcagctcgctgatgtatcgcggaccgcagcagatcaccgtgttgaagcgcggccttgccgaactgctcaagcgcgacggattcgaccatgtgagccaggctgtcggcatcgacgcctgataccgattatttcaatcggcagcgagcaccaaataataatgcgtcctgcgaccgccaacgcggtgcagggcgcattattgttgttcgattgttgttcgatattaccttggttattggttgcgtttagtatgcgccacgcacatactgcggctggtagggcgcatcttcggtcggaataccgagcttgtgggcggcgcgaagaggccaattcggatcacgaagcgccgcacgtccgatttcgatggcgtcggcggcaccggatttcaaaatcttcttggcctgcttcggcttggtgatcaatccgacggccgtggttggaatttcggcacgcgagcgcacctgttcggcgaatggaacctgataatcgggtttgacgggaatggtcacgcccggaatcatgcctccggtggagacgtccatcagatcgacaccgtgcttcttcaggactttggcaaggtcgacggtctgatcgagatcccagcctccggcggcccaatcggtcgcggaaacgcgcaccagcaccggcatggtgtcggggatgacggaacgcacggcgtccacgacttcgaccagtatgcggatacggttgtcgaacgatccgccgtattcatcctcgcgcttgttgatcagcggatcgaggaattgcgacagcagatagccgtgggccgcatgaatttccaccgcgtcaaagccgatatcataagcacgccaagcggcgtcgcggaactggtcgacgatggcatggatttcgtcaacggtgagttcgcgaggcttgtccaacggcccgaacgcgttggcacttggccccacggtctgccatccgccctgctcttccggcacgctctcatgctcgtatccgatggagaagcagccggtggaagccttgcgtccggcatggttgagctgcaccgccatcgtcgcgccggcggccttcgcatcggcaacgatccaacgccatgcgtccatctgctcgtcggcccacaatcccaagtcgcacggcgaaatacgaccctccggcgtcactgcggtggcttccacgataaccatgccgaaaccgcccatggcacgtgacacataatgctggtagtggaatggcgtgggcaggccatcctgggccaacgcggaatacgtgtccattggcggcagccagatgcggttgcgcacggtcatgccacgcaaagtcataggatcgaacaggccaaccgtgccattggttttggccttcttcgaccgcttcgccttcttttcgtcttcgctcatcgtagtagctccccctccggtcgcacctactggctccatgccgatcggctgaaccttcttcttgtattccccttgagcttctctggagatttcgtgccataaaaccggcactatctgcattctacgcagaacgcccgccgagcgtggcgggcgttcattgattgttcacttccattcgctgaattacggaagcgtcactcatcttcggtctgctgctgatcctgatcatcctgctggtcgttctgctggctttgctgctgaagcgactggttctgctgctgaatgattgtgctttgctgctgggtggcattctgctttccaccgccgatcttggtgaccgtgccggatgttgcggaatacttggccgcaggctgcccataatcgttgtcaatcggcagctgtttgcgttccgcataagcattcataaagtcacgccatgccggggccgcgatggtggaaccatcccagtagctgtggtactggccgttgatagcgatattcgcaatcgggtgtccaaccgggttctgcacgtcaccgacaagcacgaatgtggcgatctggttcggaatgaaaccacccgtcgtaactagctgatcctcgtgggtaccggtcttggcgaaggtcttacgtccattggctagctgtgccacaccgcctgcgccgtcaggacggacaacgccttgattcatggcccaagcaagcgtttggatgatttccggatcgaccgcctgatggcagttcgcggaaggcaccttaatatcattgccgtccacatcagtcacctgcttcagcgcgatcggatcgcactgcacgccattggacgcatatacagcgaagatgcttgccatcgtcagcggggacacgttgacgttgccgaccatcatggcaggcacgaatgatgaggtcttgtcgagcgtctcaccggtattcgcatcatgatagccaagttcagttgcggtatcggcaatcttgcacaagccgatgatggatcccatggaagcctgcgtggtgttatgagaccttgccaaagccaatgccggcgtttccgggttcaccgttccattggttattgcgttggtgacgttccacgtatcagtgccgccggtataacgatcgcatgcgaacaacgaggtcgaatacctcgtggacgtctgcaggttctcgttgacggaatgtcccgcttccatccatgccaccagattgacaggcttccacgacgagccgatggagaagcccatgccgccgccgtcttctcgatccacggcatagttcatggaatccctggtctggtcgttctgcgccgcttcggtggcatcatacgttcgattcagaccgaagcccaacacttctccggtacccggtttgacggacgccatcacgatttccatgccggaggaatcttccggtgggatggtgttgcgcgcggtttcgttcaacaaggtgttggcatcgatatccaacgtggtgacgatcttcagaccgccttctttcagcagcttttctcgatcctcactggtcttgccgaattccttggaattcaagatcttgtgcaccacgtaatcgcagaaatagcccgcatcatagtccgcggccatgcaaccggtggaaataggctggacatcaagcgtatctgcgagcggagtattgaccgcctcctgatattccgcatccgaaatatagccctgctcgttcatcagctgcagcacgatattgcgttgcttctcggattccggctggttcgattcgacggaaggatcgtaagcgttcggattcttggtgattgccgcgatggtggcggactgcacgatgttcagctgatctgcggtggtgttgaaataccgcttcgcagccgcctgcacgccatagaggctattgccgccaaactgtgcgatattgagatatccctgcaaaatttcaggcttggaatactgcttttccatttgcacggaaatcagcatttccctcatttttcgtgcgatggtatcttccgacgcatggtattgtgcaatcggatcgtcatcctgctgcgcctgcaggatcagcacgtttttgacatactgctgggtaagggaggaaccgccctgatggtcgcccttcatatacgtttggacgaacgcgcggaacacaccctgcacatcaacgccgccgtgagtgaagaatcgtctgtcttcacgcgctaccacggcctgctgcatgtatttggaaatcttcttcaacggcacgacttcacgattctgatcccagaattcggtgattttcgtggtgccatcggaagcgtacatggtcgacttctgcggcaggctggtcacatcaaaatcaataccttcgaccgacagcgacggaataaccgccttggcgacgctgttcgcgccgaaaaccgccggtaggaggaacaaactggcggccacgccgccacccacactcagcgtgatgtaggcaatcacgagtgcgagcacacgttgaacggtcaaagtcttcttttcgggcatggtgcccattctaaagtggtgggtctactaatcaaccggccgatcgcagccatcacgggtttctcacaaacaaccgtaaaacttgaaaaacactggaaaacagtcgaaaattatcgtctcgatcgtcgaataagcatgccaggctggtagatgatgatggaacggccctcacgcgcgatccatccacggttggcgaaatccatcagcgccttgttcaccgtctcgcgcgacgaaccgaccagctgcgccatttcctcctgcgtcagatcgtgcggcaccttcaaccccgcctcgaccggctcgccgaagcgtgacgccagattcagcagcgttttcgccaaacgtcccggcacgtccatgaacacaagctccgaaatgcgctcgttgttgtcacgcatgcgatgcgcgagcacctgaagcatgtcgacggccacgcgcggatgctcgtcaagccatgcgaacagggcgtcatgctcaagccatacgactttcgtgtcactggtcatggccacggcggacgcggtgcgcggcccaccatgcggatcgaacaccggaatctcacccagcacttcgccgtacgcatgaatgctcaacaactgcacacgtctgtcggacgattgccggatcagtttgacgcgcccgcgttccagcagatacatgcggtgatcggtgtcgccttcgcggaaaatatagtcgcccttgctatattcggcatgctgcagatgcggcagcagttcctccgcctcttcggaagaaacctgcttgaacaacgcggtgtgcagcaacgtcgcgctttcgccactgggtccactattggtctcgtttggcgtagccatttgtcacacctccgttcataggcacatcctctgggcacgccgccaggcgcgctgccgggcgcgctgccgcggcctcgaaagcttggcgcgattccacatgccctcacggaacacaagctttcgtaacgttctcattgcccttgatatcagggcggcttcgaccatcgggctacattgtaactcgcctggcggcgtcgagcagccgttcaaccacgtcttcacgactcatgcccgtctgcgagcgcattggatcgactcgttttaccgctgatttcaccgctttgtccgacattttctcacgtgaggtgttcaatacccgccccattttttccgcgtcgatatcgtaggcgagggtcacgtggtgcagtatggcgccaggccctccctctactggtgtgaagcggcgttgcgcggctccgccgagtttgccgtattgcgtggcgatgtcgttgagaccggcgaatcgtacgtcgagcccgagttccttaagcgcgcgcaccagccagaaatcgcagagccggtatgattcctcgatgcttatgccttgggtgaaatcgaacggcgcgtacaacgagtaagtgatggtattgcccggttcgatgaacatcgccccgccgccggtgcaacgtcggaccacggtgaatccttccttctgcgcgaccgccgtattgacttcgtcttcgagcgactggaatttgccgatgaccacggccggagcggcccattcccagatacgcagcgtgggttcgcgtttgcctgccgccacttcgcgcgcccatgcgatgtcggtttccatttgttcgttcgggtcgcgcggcttgtcgtggatgacggtcggtttcagggcccgccagcgttccagatattcctcttgtgtcagcgcattatgcattcccggttgttccccggaatattgtttcgtggaccgcgcgatatttccgttgcccgttgcatcttccgcattgcgcgattcactgcttgtgattgcgcggagaaaagcgatggcaatgccctctgccgtcatacccaccaatcgcacgttcggatagttcgcggtaatcgcttgcaatcgtcgcgtaatgtcgcgtgtgggcgcgcctcgctggctttgcagcaagttttcccaatcctgcaatagtcggcgggaatccttgtcatcgccgtcaagaaagaaatcaccgtcgatccgacattgttccacggattggatggaacttgcgcattcgcggaaatatgctggaatgtcatcagaaagccggacggaaacccctacgagtttgccacccggctgcttgtacaggcctctgcccatcaatcttggagttcttggccgtgcccatcgcggtgccagttggacccgtagctggagcacaggatgaggacggcttcgatcagagcccagattccggaaatgatcggtccgatgaggatgatccatccgatcagggtcagcaacagctgagccacggccttgccggtatatcccagatagaagttgtgcacgccgagggtgccgaggaacaggccgagcaggccggcgacgatcttcgacttctgcgcgtagccatagccgggctgctgttgggtcgcctgatagtaggtctgctgcgcgtaggttggtggctgattgtatgcggactgcgtgtattggggctgagtcggctcctgataatagggggtctgcgccgattgtgcgtaatccgtaggtccgtacgtcggctggccgtagatgggctgtgcaggttgcgcaggctgagtcggctgcccgtaagcgggagcggccgagccatatgcggggacggacgaaccgtaggcagccgactgaccatatggctgaccattgccatacgtaccgccggggatgttgttgccctgcgtacccagggcatatccctgcacgggctgctgcgatgcgtacaggttgggattgtgcggctgtgatgcaggctgattgtagccatcctgcgactgcctgtaatcggcttgagttgaatcgttcgtcgcgaaatactcgtcttggccggaaccgttgtaatcggcattgttgtcactcatggtttcaacaatatcccataatttgccttgttgctttcatccaccctgaaagcaatccctgaaatccccctgaatatgcgagacgcctgtcgaattcaagcatgaactcgatttcgacaggcgtctcaacaggcgaacatatccggcgcaatcatgcgttccggatcatatgtcacatgcgtgccagaatgtcgcgtccgacctcgtcggtggagcgtgtagcggatcccagctcttcgatgtccgcttcgacggccgcatcgatctcggccgcggcgtcgtcgaaaccgaggtggcgcagcagcatggccgcagaaaggatcgcggcggtcggattggccttgttctggcctgcgatatccggtgcggaaccgtgaatcggctcgaacatggacgggtattcgttggaagcgttgatgcatccggaagcggagtatccgacaccgccgaccacggcacctgcctcgtcggtgatgatgtcgccgaacaggttgtcagtgaggatcacgtcgaagcgggacggattcgacaccatgaaaatggtggtcgcgtcgatatgcagatagtcgtgggaaacttccggatattcctcggcgaccttatcgacgatgcgctgccacatgtctccggcgttgacgagcacgttcttcttgtgcacgagggtcacatgcttcctgcgcttcatggccagctggaaggcgtaacgcaccacacgttccacgccgtaggcggtgttgatggaaacttcggtggccacctcgttcggggtgccgcggcgaaccgctccgccggcgccgcagtacaggccttcggtgccttcacgcaccacgacgaagtcgatatcacccgggttggcgagcggggaggtcacgcccttgtacagcttggacggacgcaggttgacgtactggtcgagatcgaaacggagcttgagcagcaggccacgttcgagaatgccggccttgatacgcggatcgccgactgcgcccaacaggatcgcgtcggtcttcttgatgcgttcctcttcctcttccggaagaatcgcaccgtcacgcaggtaacgttcggcgccaagatcgaaattctcgtaatcgaattcggcaacgccctcggccgccttctccagagccttctgagcccacggagtcacttccttgccaatgccatcgcccggaatgacggcgatggtgtacttctttgcagaatcactcatagcacgcgactctagtcaacgaatcagcacgtggacgcgtaacgctcaactaatggacactccatgccgctttcctgtacgaaacacacgaaaagcatgaatcatacgaatctcacaaatcgcacagcctaatcagctggtaatacccatcacgccaaggcaccaagcattctcataggagatctcctcccactgcttgtaccttccagacgtacccccatgaccagcctcaacctcaatcttcgccacggcatccacgcccgcacgctgcagtcgggccaaccatttcatcggctccacatacagcacacgagtgtcattcatcgacgtggtaatgaaaatcttgggaaaaaccgcaacccgcgcatcatttgcatcagacggcgcattctcatacggcgtatattccttcatataccgatacacgtccgcattatgcagcggatcgccccactcatcccactccgtaaccgtcaacggcaacgacggatcaagaatcgatgtcaacgcatccacaaaaggcacatccgcctcaacgcccgcgaaacattcgggagccatattcgccacggcacccatcaacaggccaccggcggaaccgccatcggccaccgtgcgagcaggcgatgccaaaccggcacgctgcaacgcacgcacggcatcaacgaaatcctcaaacgaatgcttcttattgagcaaatgcccctgctcataccaagcacgacccatctcaccgccgccgcgaatgtgcggcaccgcataaagcacaccacgatcaagcatgctgatgcgagacaccgagaatcccggatccgaactgatctcatacgcgccatacccggtaacgaacatcgccgaatcacacgcgggcacatccctgcgccacaccaaggaaacaggaatgcgctcgccatcgcgggcggtaacccacaccctgcgctccatgtattcgcgcggttcaaatccaccaagcaccgtggcacgcctcaacaggcgatcctcgccggtcgccggatcgatatcatgcagttcgccgggacgtgtgtaactggagaacgagtagcgcatgcggggcgcatcatacgaaggattgcctcccacaccaatcgaatacaagcgccgggtctcccccggcatcgcatcggcggtcgcaccatccgatgaggtcatcgccttgcgggagatcccatgcacggccgacccctcgccttgcgcggcggccaattggtcgagcgcgccccacacttcggcacgttcctcgttgatctcgtccaccgactcgtcgacatcccaatcgtcttccaacgcgtggggaaccagctcggtgaacttccatggacgccccgcaagaaaatcctccgcagcggcatccttcgtcatcaccgcaatatgcgtcaggctttccgcccggtactgcagcgccacataatgccggtgaatcgagatcccctcaatgccaagaccatgcgcgccctgcaaaatggctggattgcagggattggaatacggtgtgccgatcggcatctcagaagctcccggttcgacctcgtcgccatgctcgcatccgtacggcgaaccgacggccacacgcacgccctcacccaaacggtacgggggctcatgggagcgcatgtcaatcacatcgatttcgaaattcgggttcaacgcattgtggtagaccacggcgagcggaatatcctcaccgcactcgccggcaccttcgaaacggctgaaactcacgtcgtattccacgtcctgctcgcgcggaatgaacgcgcggaattcgccttccggatcgtcggtggaaagcagcagcacttcggtggtagtcttcgacccggtgccgatcaccagattgcgttcgtcgaacgacaggccgatgccaacccagaatcgttcgtctcgttcgcggtacacctccacatcgtcgacgatgggagtgccgacgcggtgcctcatcaccgcgtatggacgccacgcgtcgtcgagcttcacatagaacacccattgcgcgtccggtgtgaagcaggcgccaccgatgcccttgaacacttccggcagttccttgccggtttccaagctgcggatgcggaaatcgtaacgttcgtcgccgctggtgtcggtgccgtacagcatccaacgtccgtctttggaaatatccatgccgccgatacggaagaaatcatggccttgcgcttcggcattggtgtcgaacaccacttgttcgccgtcgatgggcacgccgatttcaatggttggcggatcccaatcgtctgcgcctcgaataggcacacggcattgcaccgcatactgctggccctcctgggtgcgtacgaaataccagtagccatccatgcgtgtcggcacggacatgtcgttttcctgaacgtgcgacttgagctcgtcgaacagtgtggagcgtagggttttcaacggttccatacgctgctcgcaataccggttctgcgcggcgacgtaatcctgcacgtcatgcgattccttgtcgcgcagccattcgtactcgtcgatgaaggtgtcgccgtggaatacgcgctccttcggcacacgcttcgcgatcggcatcccgcatttgtcttgcacgctttcgtcgctttctcgcgcgcccgttgcgccctgttcaccccgaaaatcagtcatgcacgcgattataccggcattgcattcccaatcccacgcggcacgtaccccctgctccgggcgtacgaaaaagtcagacgcccatctgttgtttcaggaacggcagcatggttttcatcagattcgagccggtcgttcccgtgaataccgggacatcggtgaccgggatcggctgcgtgaccgcacgccccgcaacggtgccgagattgccggcgacttcgcgtggagacaactgccggatgccgatcgccagcacacgccctgggtatcggcgtgcgatcgtggcgtacgtggtcggatccttctgcccgtcatcgccgatcagaatgaacttcatatcaggaaaatcagccatcaattgttcggcatattcgagtttgtgctgcactccggaaggaatgaacgttttcgggcgaggatcgaggtcgcgcaatagcagcggaccttccggaaaaccatggttggcgatgaaatgccggatcgagctttccacattccatggcgatgtcgacaggtagaagaacggcgcgtccgggaacatgtccgcaatgcggttgaacagcaggttcatgcccgcaaccggcattttcttctttggatcgagcagcagcagattgtaggcggctttcatcaggcttggcgcctgcgtgaccatgatggtgtcgtccacgtcggagatcacgccgactttcgtaccgctgggaatggtgaacaggttggctgtgaccggtttgcggctgcgtaccttgtatgacacgtcgtgcacgcccggttcgagcgaatgttcggccacgagatcgagatatcctgcggaatcggaggctgcgaattcactggagacattgcgctgcgcgtccacttcgtcgtgcacttcggacgcgcccacctgcacggtttcgaggggcacgccgtcgatggcgatgcgcaccttcgtatgcggcgaggggacggtgagcatggcacggatgccacgggtcagacgacccgcctgacgtttgaagggcccgtacacggttcggcagatcagtcgagagtaatgttcggtgccgtagccgacatatggttccacgcgcggataccagttgagattgagcaccatgcttgttgagaacgtcacccacttgttgaacgctctggtaatggtgcggcggaacagtcgtgtcagcggaggcttgacttcgatgcgttcgtgtttcgaagccgcgtcgaaggtggtgaccaccttgcgtgcgggaatgggcacggtcggcatgtcatcttcggatatggaatccggttcacgctggggcaacggctgcggttcggtcataaccccactataaaggcgattattgaattacctggtaccccagcgtgaaaatcagggatttttcagggaataccgatgattccccatccaatttcccgaatcgtgccgttcactgagccacgatgttggcgtattcctcggaggaaagcagtcccggctcgtcatcctcaagttcgattttgaaaatccagccttcgccatacgggtcacccgttacgatgcttggatcgtcggcggcctcgttgttcacatagcgaatcacgccggccaccggagtgaccagcggcgtgaccgccttggaggattccagttccgccacctcgtcgcccgcctgcacttcggtgccgacttccggcagatcgatatacacgagttcgccaagctggtcggccgcatattcggtgatacccaccatggccggctcggtggaagcatccacccacacatgctcgtcggaatattcaagatgctcaggcacatccagattcggcttgttatcgttttcttcgctcatgaaagctcattctacgtcaatcgtatgtatttccctagagcagtgccgaaacttgttacgggaggtcgtggccgagccattcttcgatcatgtagcgggcgatggtggcctttccgggagcttccatacgccctgccaccaactcgttcatgtattcgtcgcgggtcacccaacgcgcctgcagggtctcgtcgccgtccacgcgcacgtcggtggtgttggccacgcctttgaacgccatcatgagcgatgcggggaacggccatggctgcgatcccaagtatttgagttcgccgatatctatgccgacttcctctttggcttcgcgccggcaggcatgctccaggttttctccggcttccacgaagccggccgatacggagtacagtccggtgttgcgccatgcgctgttgtgttgcaacagcagacggtcctcatggtccacgatcgccgtgatgacggccggttccactctggggaacagcagtcgcttgccgtccgcttcgctggtgcagcgttgcgcccatcctcccaacgccggttcggtcggagcgccgcatgtggggcaatgacgttggcgcgcatgccatacgcccagcgagatcgccgtcgtggcctggcctgcttcgcgcgcgctggcatgcggtgcgaatccgcgcagatcgacccagtcgaatcgttccgcagcgctttccagcaacgatttcgacgttttcgcttccggttcgtgctgttcgccaaacgcatcgtccgcgcccatatgctcgctgcttgcggccaccgtctccgcggctttcacgcgagacacgtcaacggcgaccacgtgttcgtcgcgtttgccgccatacgatccaaggaatatggcgagcgccgtcggatgcgtgtgcagttccgccgccacgtaggcgccgggcaattgcgcgagacgcatatgcacgttggcgtagtccgcgatggctccctgtccgcgcggcaccgccaccatgccgtctttgacgagaatgaccttcgtggccggctccagcagcgccgtgtcgaacaggtcgggttcgccgcgtctcgaaacctcatagtcgatgtcaccttgcgcaagtggcaggaacggcagtgcctgagtcagcgccaatggtgagaacacgctcatcgcttgcttctttccttgaatacgattgatagagcggatattttttctctattccgtattttcttttctatttttttatatcttttttgtatttctgattgcgatattgacggcagcggcggaaaataccggctactgcaccctgcgcaccagcgcgagcagcgcgtcggcaaccgcctgcggatgctcgtatgcgctgaaatgcccgcaatcgaataccaccgtcatatccgtgctcgtagccgtcatcgcatcggcgatcggcgccatcacgctcggcggactcgacggatccttgtcgccgcagatcaccgcgaccggcgctgtaatcgacgacagcacatcgttcaggtccggacggccagcagccatgcgttcacgccaggcgatgccttcggccggctgctcgttgatccatgcagtgaactgttcacggtaagcgtccgactgtttgatggttgaatcctcaggcgtggcggcggcgaatcccataaccggctcatgcgtgcccgtcgattcgcattcctcggcgatcgcgatgcgtttcgcacgcatctgatcggaatcagcggcggccttcgtgtcgcataaggccagtgcggcgacggcttcggggtgcagacgctgaatgtcgagaatcaggtagccgcccatcgaaagacccacccaaatcgcctcgtcgtatccggcagcgtgcaacaggtcgacgtaagcgtcggccatatggtccaaaccgttcgggaaagcgccgtccgcatctttgccgccactggtctcatcggaaggaatcggcccttctcccgcaccgggcatgtcgggaccccagatcgggaaccgtttcataccatgttccacagcggccgcctccaacgcctccgcacattcgtcccacatgcggtggtccacggggaacccgtgcaccagcaccacgggaagtccctcgccctcgcaatacacgttattatgtaattcgatcgtcatcgtctcactccgttcctctcccctatattgcctatatatctatcgcttacgctgcctgcattcgcaagctgccacgcgctttcctggcgcccacggccgaccgttttcgacgtcaaccataagcctgtcggctacctgccggcccaagcgatcgcctgacgcacaatcgtgccgtatccgttgctcatctggtttatgaaagtgtcgaggatctcgctgttcgtgttgacccattccacgtcgagcgtctcgtcctgcggcttgcaatcgcccgcgatcggcactacatagcacaatgcgatcgcatgctggcgggaatcgaaataatcggacagtcctggcgtcgggaaaaactcggccacggtgaatggctgcaggctcactggcaactgcggcaacgcgatatctcccaaatccttggcgatattgcgcgccacggcctcacgcaacgattcgtggtagagcacgcggccggcgatcagcgttcgttcgatgctgccgtcgtcagacacacgaagcagtgatccgacctgtgagacacgtcccagatcatcggtgcgcaccggcaccacaagcacgtacggaatcggcatttcacctcgcatacggttgatttcgccggaagcaagccatcctggagggtttcctattccgcggatgaaatcctccggcgtgatgtcgtcgaattctccgcgacggcggcctgcatcgaaatcgccctcgtcgggcacttcatcattcatcactggcatagtcccattatcacgcatcttgtgtgaattggctggaaaagcgtgcgatggaagacgattcctctgatagcggatcttgcgcatgccgggaatgcgtcgggttggggcacggttatatactccaaagcaatcgcatacgaggggtgcagcccgtcacgcgcgtcgatggaacgaacagcaaggagcaatcatggcaacgcatgcagtcacttccgaggatttcaatcagattgtggaatccaacgatctggtattcgtggatttttgggcgacctggtgcggtccgtgccgcgcattcggtccgacgttcgaaaaggcgagcgaagcgaatcccgacgtttatttcgccaaggtcgatatcgaccagaatccggatctcgcttccgcggccaaggtgcaggccgtgccgacgttgatggtggtcaagaaccagcagatcgtgttccagcaggccggtgcgttacgtgcgtcggatctggacgatctgatcgcgcaggccaaggcgttggatgtcaacgcggccgctgccgaagaggctgaggcgcaggcggagtaggctgaaaattacaacgatttcaaaggtgtcgttcgatggtaaacatcaacggcactttttgttttgcccgcctattgcgtacgcttgcttcgcccacctgttacatatgcgcccgctcggtttccatggcgtgaggtaaactggcctgttagatgtgcgctttccggcgaagcctcgtgtggcagcgcaccgcatgccgagcatgcgtgaattcgccgaggatctgaacgcgcgtttaggagcagaatggctaaccacagcaagcacgcccaatcgtctaccttcaccatgccgagcaagtcctcgctggtgaagatcgccgcaacggttgcggcggtgggcctgttggctaccggcggcattgtgtcgcgcaatctttacacatccgcggagcggaatacggccaatcaggtcacggctttctccgtcaccgattccgcggaggcgtcccgtggcaatgcccgcgagctgcttaatggagacacctcgtacgtcaccgtgaaaatcaacggcaagtcacgcgtggtgcccggcaccaatttcaccgacgtgaagtccgtgctcgacgcgggagacatcacgctcgaaccggaagacacggtctccccttcgctcaccaccaaggtggatgagaagaccgtgatcaccattcagcgtgccggcgcgagcgttgaggtttccgacaccgccatcggtttcaatgtcgtcaagaaggaaacctcaagcctgccggagggccaggagaaggttgagacggagggcgaagagggcgtgatggaaaccacgaacctcgtgaccaagtccggcgacaccgtggtctcctccaatatgatcagctcgtatgtgaagaaggctccggtcgacaaggtcgttctcgtcggcaccggctccacttcgtcgtcgtcctccagcgcttccgcgtcgatcggcaccactgtgccggcgggcgaaatgcagcagtgggctcacgattatctgctgtcgaacggctacaccgaagccgatttcaccgccaccgtatacatcatcacccacgagtccggctggagcgtcaccgcaacgaatccgagttcgggcgcctatggtctgccccaggcgttgcctggcagcaagatggtgagcgagggcgccgattgggctaccaattaccagacccagctcaagtggttctggggctattgcgcacagcgttacggttccattcagggagcctattcgtactggcttgccaaccactgctactgatatgcgtcgccatctgatctcaagcaagctcgtattgaaagtttatgctgactggtgattgatatttaattttcgtaattcaacgcatatagtttgagccttgtaatatttgaagatattacgaggctcaaactatattgcgattcgatatatcactaagatactatcggtttcacagggcgttgttggcgccgatcaccgtagcttccttgacgtcgtcgatcttcctgcgcttgcggccgccgtgaccggccttcggaccgcgcttgccgacggtgccgctacgaaccccgttcttggcgtcgaagaggatcacgcgctcatcgctgtgatattcaccttccaaagcaaagtaggcgatcttgtctgcaggcacttccgggaaagtgaagaacttctgcgttgcaacaagcaggtcaagattgcgagtggtcacggaagccggacgatcagcgttcggattgttgaactgaaccgcgaaatcgtcgttctcgtcgcacacctggattgcgaacttgccacgctcgtaattcaccagcagcttgacgaattccggacgaccgagcacttcggaaacacccttggaaaaacgaacggattcaagcatgaccgtcatggtcaacttgccaccagttctttcgccaacttctttgaaaccatcaagaacggacatgtaaatccttcctttactgtaaataactacgtgaaatactgtacctcattgtcagtaataaaacgaatcgaatcttagggaatatatccatattttcaagaaaaaatgattgctttttccgcaaacgctttcagcaaggctgccccatccctcagcccaccgatatgcggcacgccccgaaacagccgcatgcgaacgtttctgaaaatcgtttcaccgcatgcacccgtcaacagcctctcccccgcttcttcacccctcttcagggcaacgggtacaatacgaaatcgtcggaaaacacgaagaaacacggtaggaaaggacagacccgtgaccttcaaccgctacatcctcttccgcatggtcgttgaatttgtgggagccatcgcctgcgccatccaaatgttccagcatcacacgtggccgggcatcatcaccatgggcgtgttcgcgctggtgtgggccataggcgagatctggctgagcacggtgtacaaccgcgcgcacccccgccgcgacgagctgtccgacgagcatcaggcgacggccatccgtttcacgttcttcgtgcttgtggtggcgctggtggtgttgggcttcgcgggcatgatcgtcacactgttcaggcatgcgccgttcaccgttcccgccatggcgttgccgacgttgggcatgctggcgctggccatcgccgacgcccgctacctgtggcttgagcatgagggcggggacaccgatgaagactagtttgaagttcaaacgtatggaacgcggcttgaaacaggccgatcttgccgacttggtgaacgtgcgccgcgagacgataggacgcctcgaacaggggcagtattgcccgtcgctacgccttgccatggatcttgcaaaagcgcttgataccacggttgaagacctgttcagttttgacgacgaagagtgacgcttcggcgtgttgcgtttgtaaattcttatcaaaatggcgattttccaacgaaaaatcgccatttttcatattcgggggcatgtgcgaacgtcgtcacatggtgtgacaacgccgtcacatatgtgcgattcacctcacatccccgagagcgcggttctcaacgggggcgtatagtcaaggtcgtagcgggaaaccactacggcaaaccgctgaaatgtacgttttatttagagaggaatcacgattatgaagaagaagatcgtcgcaattctcgccaccatcgccgccgtgttcggctttggctttgccgctaacaccgctatggcttatggcgcgaccggcaccgtttccggcaacgtcgccaccttcacgtttacgggactgactccgggccagcgctacgtggtgtcctacgatgacaccaccgtcgagaacgtcaccctggctgccaccaagtactccaacgctgccccggcccatgaggatggcaccctgaccgccacctacaccttcaagtctggctttgctggcaccatcgcatcttccatctatgcagtcgatggggcagacaagccgaccggcgccgctctcgcttccgcctccgtgaccgtcgccgctaccggcgaaggcaccgccaagaagaacgagaccgcttccaccggtgctgctatcgctccgtacgttgtggccgtcgtgctgctggctgccgctggcatctccctggttgccgttcgcaagagctctgctcgctgaacaataaccaagtagatacacaccatatctatgtttcatgaaggggcttgggttttcccaagtcccttcatttattcgaaaacaagcatcgtaaaaccgattgttttcttttttcaggaagagatcatgaaagtcctgtttatctgcaccggtaatatctgccgctctcctatgggagaactgctcctcccccaattcatgcccgatcttgaatccgacagtgcgggcacacgcgggctcgtttcgcacgaaatcgcaccgaacagcaaaaggctgctcgaccagcatggcatcgattccagcagcttccgcgcgaaacgagtcaccccgcaaatcgcgcagggcagcaatctcatcctctgcttcgaacacgagcagcgcaaggaaatcgcggtgattgcaccaaccgcggcccgcaaaaccttcctcatcgacgatttcgccaacatgtgcgtctactgcaaggaacaggggtacatggggggtaatacccggcaggaaaaactcgaatcggtaatcgacaacgcaagcatgatccgaccgatgatccccgataccaacaatgtggaggatccgatcggcaaggacttcgccgtatatcaggcagcgtacaacgaaatctgcaaggctttgcagaccatagcaagcgccactgcctgaaaacgttgaaatatcaacgaaccaagctagaaagggtgcccacctccctccatgggggtgctctttgctagtatggaacctgatcaatatgatgtgacaaatgtcgaggggaaacatggctgcagcagaaagcaacgtgccagcaaccaatcaggtggtcgtcgaatccaatgatacggaagacgacggcatcaccttgatggatttgttccgtatagtccataagcatcttctggtgggcatcatcacgttcgtggtggttttcgcagcggtgtgcgcatacacattcctggcacccccgaagtattccgcgaccgcgcaggtgttcgccacctacagtgattcgtcggtgcaagacaacaatatttccaacatcaacagcgccagcacgtatatcaccaaccagattcagtcgtatccgacgttggccaccacggaatccgtgctgaagccggttatcgacgaccttggcctcgacaccaccgttgcgaacctagccggtcagctgaccgtcacgaacccgacgaacaccgcgttcgtgaacatcaccgccgaaacgggagacgcgaagcaggcttccgacattgccaacagcgtggcggaatccctgagcaatgtggtggagaagtcgctgtatgcctccggcaaggagtcgccggtgaagctttccgtggtgcagcgcgctgcggagccgatctcccccagctccccgaaggtggcattgtacttggccgtcggcttggtggcaggcctgattctcggcgtgttcgctaccctgatccgcgatcttatggcaacccgcgtggaggaagccagcgatctgcaagacattatcaacgcgccgatcatgggccgcatccccaccgacgaaagcctgcagagcaacaagccgatcatcgtgtcgaacccggccggccgtatcgctgaggaattccgccgtattcgcaccaacctttccttcacatcgaaggttgaaggcagcgatgcgcgcatgatcgtcatctcctccgtcggaccttccgaaggtaagaccactgtttccgtgaacgtggcggccgcccttgccgaaaacggcgccaaagtgctgctgatcgacgccgatttgcgtcacccgtccgtagccgaacgacttagcctggaaggcggcgccggcctaacgcacgtgctttccggccaggccaccgtgaaggatgtggtgcagcgctattggaagccgaacctgcatattctgccggctggtccgaagccgccgaatgcttccatgctgctgaactcgaagaccatgaccgaattgctcgacgcggctttgcagacttacgattacgtgatcatcgacacttccccgatggtggtggccaatgatgccactgtcttcggctcgaagagcgacggtatcgtgctcgtttccggtcgcgacgtgaccatgaagcgcgatctgaaagacatcgccgtgcagcttgacaacctcaatgtgccggtggtgggcttcgtattcaacctcgaaaaggaacgcaagtcttccacgaacggcaattactactattactactattacgacgaggatggcaagaagagcaagcacgctcataagaacagccgcaagaagtccaagcacaactaggctgctgggcttcagggtttccgccctctatcgcgagtcggaaaccagtctaagtaaccgaaaaggggttgcagcaaatcgtcaagattcgctgcaaccccttttccatgcccaaattttttgccttcagccggctggcccgcaacttcgcatcagctgcggaggaggatttcctccagggcgccgatcaccgcatcgggcatgccggaggtgacaaacagctcgttgctgaaacggggcgcggtatcgaaggtgcgcagagccccgagcgcacgcactccttgctcacgaatcgcctgcatcgcatgctctttggaaatgtacggcatttgcgcatgcaagagcacgtcaagcacgtcctgttcgactgaattctcagcaatctgcagtccgtctgcaatcgtaacgttcaagcatgcagtagacggcacgtcgcgcacaacgaccgacagactcaacgtctgctgatcgtatgtaatttctgcagtattgcaagctttaccgccaatttcgatacgaacgttctgcgtgtctggctgtgcaactccacggaacacaatctcccagttacgctgtgccggaatggcttcagcacagccttccaccggactgatggtgaactgcgtggcattgtccgtattcttccagtcaaggctcatgcgcgtatcggcaacatgagtttggccatcgcaagactcggcagatgcagaaccggaagcagcagaggccacagaaccatcgtcttccttgagtgtgaacgaaccgttcgcaccggggaacaccagcacctgcagggactccggattgcccagatcattcaccttattgccctcgccaagctgctgcaacggcacgataccgccagccttggcaaacaccggcatacggtcgatcgcacgccacacttccaaacgacgcccggactctcctgccgaaacgtaacggcgaccatcgaagaagtcataccattcaccttgcggcagccatgcttccgtgctacccagctgcgcggaatcgtcattgtcagaaacaattggtgcaaccagcagctcagtgccgaaacggaattcatccggcacctcgtacgcctgcggattgttcggatccgcccaatacatcggctccaccaatggcatgccctcgaacgcggcgcgatagttcatggtgtacaggtacggcagcatcatatggcgcagtcgcagcgaacccaccatggaatcgcgcacttccgcggagaagttccacggctccttgcccatgaactgcgaattgctggaatgcaggcgattgatcgggctgaacgtgccaagctggtaccaacgggcttccaaatgctcgttacgatagccacacatatgaccgccaatatcgtgactccaccatccgtagccgatattcgacgcggtagcagtgaaatacggctggaactgcaaggattcccacgtaacaatggtgtctcccgagaagccgaccggatagcggtgcgaacccgggccagcataccgcgagaaggtgagcggccaacggttgttgcgttccgtgcaactcacgttgcgttcggattgctcgacatgcatttcatgctcatcgcgagcgcccggctcggcgcacttttcgcattcgcagttctcatttacattgcgttcggaagaagtctcgtagcgcccggaatccaggtagtgcaagtggttgagcacccacagcgggtcaagtccgggctggcgggtcacgccgccttgctgccagtcgagccaccagaagtcaacgccttcagcttccatacgatgatgcatgtcgaagtaggcgcttacgaaatccggattcgtgaggtcgaattccactgcctcttcggttgcgggatcaatgccgacgcgcttggccaccgcctcatagtcgtcttcgaacgcgcgcacgccgtctcgcggatgcacgttcaacgtggctttcaggccgcgctcgtgcaagtcgcgcaagaacgcctcatgatcgggaaacagctgcttatcccacgaatagccggtccaaccggaaccgtatttcggatcgacatcgtccacgcggtgccagtccatgtcgatcacggatgtggtgaatggaatgccttcgcgcttgaaccggtccatgagctgcaggtattcgtcttgcgtgtagcggtagtagcggctccaccagttgccgagtgcgaagcgcggcagcagaggcgttggtccggccagcttgtagaagtcttgcaccgcttcggtgtagcggcggccatagccgaagaagtagaagtcggtttccgcgtgatcgcgtggcataacccaagcccccagcggattcggtttgccgttcacttcgtatgcttccacgatcacgttcgcggcggaatcgtcgagcaccgcccatccgtctcgcgaaatcacaccatcgtccagaggaatttcgccgttcgcctcgtcgagcgtgcgcgcggtgcctttaagattatgcttcggttcgtcgccgtaatgccacgtattgaactgggtgtcggccacgcccttgacgactacgctcaagccttctttgctgaatggcttgccatcgtacgtcacatacagcgcgggggtgtcaacaatgagcagtccgtcgcgatgcgtcaccgtgaattgcgggtcggcgccaaaatcgcggttgaccaccatttgcgtgagattgtcctcaaattcgccggaatcagaccattcgaaacggatcagcgattccgttagaatgccaatcctccaatgatccccttgtaaaaccgacgattctcgcattttcggacgtgccttgcgcacatagtcgacgaataccgtgccggttgcgttatctaatgcgttgtttgccatgctactcctgccttacttgccactgcccgtcgcaatacctgcgatgaactgcttctggaaaatcatatacacaatgatcactggaacaattgccaacgaagtcgctgcgaacaatccgccgtaatcggtgccgtattgtccgttgaaggccttcagaccgacagcgagcagctgcttgttttcgtcagtgatcatcaagaatggccacaggtagtcttcccaattccacaggaaggtgaagatggcgagcgccgcgatggtgttatggctcattggcagaatgatgctatggaagattctggtttcggatgcgccatcgagtttcgccgcttcaatgagttcgtcagaaattcccgagatggattggcggaacaggaagataccgaatgcgctgatcatgccaggaagcacgagcgacgtgtaggtgtcttgcagaccccagttggtgaacatttcgtattgcggaatgatggtcactgcccaaggaatcatcatggtgctcataacgatgccgaaaagcaggttgcgaccacggaatcgcattttagagaacacgtaaccaagcactgcacttgtgtagattgcaataccggttttcagtactgctacgatcagcgagtttgcgaacaatcgcaagaaattgaacttttcttggatgctcacataattgtcaatcgtggatggcttagggaataatcctccggtcactttgacgatttcgctatttggcgcgaatgatgaaatgaacatccaaacaaatggaacaatggtgatgatggcggcgatgaagagcagaatcgtaagaatgatgccgccaattttacgtgatttcatgccagttcctccgaatctccagaaaccttgaacatgatgagggtgagcacaccagtgaacaggaagagcacaactgcctgagctgacgcgacgccgaagttgtatttctggaatgcctgatcaaagatgagatagctgatggtgtaggttgacgtgcccggaccgccttcggtcatgacgagaatctgcacgtatgcctgcaggtagctgatcagtgacgtgatgacaatgaacaaggtggttgatttaagcaacggcagggtgattttgaagaaaatctgcactgagttggcaccgtcgatggcggccgcctcgtacacgtctcgaggaagattcatgagaccggccaaatatagaacggtcgcgtagccgaaatccttccaaatggtcatgatgatgactgccggcatggcccatttggtgtcgtgcagccagttgatgtcgagtcctgtgattttgtttaccatgccgaactgcgggtcgaacatccacatccacacgaaagaaactgccacgagcggagtgatagtcggcatgtagaacagacctcggagggtgtctttgcatttgacgagtttggcgctgagcagcagggccaagccgagaccaagcacaatgcggaagagtgtggaaacacctgcgaataccgccgtgttccccatggaagtccagaaaagtttgtctgtgaggatctgtttgaagttgtcgagtccgacccaatcataagtgccaatcagaggattccagttatgcaaactgcccgcgaaggctttaaaaattgggtaggccaggaaaatggcgaaatagaccaccaagaagacaacagccatgttgcgtagggtgaaaattctcgataccagagattcaccatttttgtttttcattgaatctcgcctctctgtgagccgattcgaccgttttgttacgcaatacagagtgtcagatcgaatcgaataagaagattgaacgtatctcgtagataaaaggcagccgcggcgcggaagaagaatcgtaccgcgactgcccggattggaaaagggattggaaaggatatatcggtattacttatgttcgtcgaagtaagcgtacttgctttccattgacgtgaagtcagagctcttcatgtcggtatccatctgaccctgggcctccttgagagccttatcgatggacatgccgttctggaagacgttctggaaagcagtggtgccgctggattcaacagtggatggtgccggtcccggccagatcagtcggtctacgcgtggctggatggcggccatgaccggcttggagagaatgtccttgtcgttctgcagcgaggtcttggctgggaaggagttcagttcggataccgcttcacgaatgtaatcatcgttggcgagcaggtacttgatgaagtcctgggcaacggcctgctgttctttgctctggttcttgttgacgcccggagtggattcgccgttgtaacggtcgtatgcaaacggagtgtcttcggagaaggttggggtggcgaacacgccgtagtcaatatctggatacttttctttcagcgtgccttccatgtggccccaagcgtagatcatcgcagactggccgttaccgaagctttgggtgtaatcgttgccgaagtcaacggatccgaccttgtacttgtcatacaaatccttgaggaactgcatgttttctttggtcacatcgttgttgtagttggctttcttgccatcttcgctgaagagcagttcacccttctgataattcagaccttgatagatggcgctgtaggcgtcgccgttgaagttgaagccggcctgcgtcatcttgctgccgtcggttttggtgagcttttgggcgacctggatgaattcgtcccatgtggtcggaatgtcggcgtcggtgaggcccgcttcgctccacaatgtcttgttgtagtagatgttgccggtgttgatcacggagtcgatgtacttgactttgccgttctcatcttcatgtacggatgcggtggagtagtcggattccaaagacttggtgtcgatatcgtaatccgctgcgtatggacgaatcaacgcatcgtaagagttgtggatgttgaaaacggccggaccgtttttgcctttcagagccaacggcagcttggtccaataatcatcccatgaaacattcaccgttttgatggtgacgttcggatacgtcttcgtgtaggactcaatcatcttgtagacaggatccgtgcccttgctgccccagctccagtactcgagctggattggcttgccgtcgttcacgagatgattggggtcgtaggtgatggtgttgccgataacgtcaagccctttgtcggctttcgtatcggttgtgccggacgcggcattgctgttcccgcacgcagccaagccgacgatgctcaaggccgccactgccactgcgatacctttgttgattttcatatctctccttacgtcctcgtaagccttcatccgccccttgcggacaagcaatagcatacgacaagggtttcatattggcaattcaaggttttttgaaatgtaaacggtttcatttgaaacccgtttcatctcaccgctgtgagcgtgcacatattgtttttcatacggcgtgtcatatcgcaacccttttcattcatctttcaactttgcagccatgcggacggtaatgatggtaggctgaaacaaacagtggaaaactttcggaggcaccatgaaagcgagcatcggcgatgtggcactgaaggcaggcgtatcgaacgctacagtctcacgcactttcgcacaccctgaacaggtgtcagaggcaacacggttgaaagtgcaggccgcagccgatgcgttgaatttcagcgtttccagatcggcaggaattcttaaatccggtagaacctatcgcatagcattattggtcggcagcggcgtcatcgaatggttcaccgccgaaatcattgccggacttaacgatgttttgcgtgacgccgggtacgatctggtcatctaccccatcgaggggtcggaagcgcgtgacgcattcttcgaggaacttcccgtacgcagcaacgccgatgccgtattcgtttcctcatttggcatcagccccgacgaggtcaaacgtctcggaaccgcaaaaattccgattatcggcatcaataccaccagcgaaggattcgatgcaactgtcggtatcaacgacaaagaaggcatcaaactcatcgttcgacatctcgccaagctgggacatcgtaacctgctgtatttatatgaaagcttttcctccacattgggattcagctcatttaaccgtatttccggattccaggaagcctgcgatgcaattgacggactgaccgcccgcacactggcagtgcaaaaaggcgacagcattctagatgcggcaatttccgagatcatggcgcaagacaacccacccaccgcattgtgtttccatcaggactcacaggcaattccattgttcttccgccttcaacgcagcggcctttccgtgcctggagatatttccgtaaccggatttgacgacagcaccttcgccaaagaagctgagctaaccaccgttcgacagcgcccatacgacatggccgtcgatgcggcacaaaaggctctggcgctcatcgaaggacaacccatcgaggaaccattcgagacattccccgtgcagttgcaagtacgaaactcaaccgcaaaaccacgcaccgctcccctgctgtaggccgcagcgtgtactcgcgtgaaatcacttcgcgtaataccccacaccaaccggtctatctgcgttatgtatggcagattttgcttttcgtacggaaacatctcgcttatatatggcacgccgcctgcgaaaacagccacttcgggggtacgtttttgaggttttcgccgcatgtgtctgccatatgtaagtgagatgtctccggtcaggcctccgaatctgccatacatagacgagatgcgagccgcagacaagcctcttcgtcttaccccggcgttcaatgtgcttttcttacggcgttcaatgtacttttcttcacacgcatgtacgtttaatcgcctcaagcaccgatgcgaatcaaactcaccaatgttcgcaccgtcaacggcatacgccaagacagcaacgcgacttaacccaaaccgccaacatcagtagtttggtagatactcgcgcgcatagccgtccacacctccattggacgagaggaaacgtggaatagagtcattgccttttgtcgaccatcatgacgacgcgcgcaaacagataacgctaaacttgtctcatgttgattatttgcttaacctagcgaagcgacgaagcaagagcaggtgatatatggtaacaatttctgacgtggcgcacgcagccggtgtttccaaggcaacagtctcgtatgtactatcgggagatcctcgaatcacccaagctacaacacttaaggtgcaacatgcgattgacgaattaggctatacggtgaaccatgcagcccgcgcactatccgtaagaaaaaccaaaacaataggtgtggtctcccccgcctttcacggcaactatctgtcagccctctttgggctgtacgtgtacctgctatccgaagaagcgacaaagagaggatacgacaccctactcattggcgagaacgacggcttcgaggcaatgcatgaagcatggtcgtcaaagaaagtggatgggttcatcctgatggacgtcaaagatgaggatccacgagtcagctatgccgcaaaagagcacattccgaccgttgcattcggctcgccaaagaactcacacggtttggatacagtggattccgatttcgccaaggctgcatcatcaatcttgaatttcttagcctctgaagggcataaagaggtgattcttattccatggtcacacacaatatttgatcagggtcttggctacgcttggcgctttctggattcagcgatagagaccgccaaacgtcttgacctgaaaatgcatgtcgaatatccgaaagacgacgattcggatccttcgcccctcattgagcatgcactagatacacacgccaaagcgaccgctctgatacttcacaacgagccagcaacaatcgttgcccctcaggtcttggcacgcaggaacctccgaacaccggataacttgcaggtcgtaaccgtcttcccgaaacagctagcaacatcaatgaagatatcgttccctgcagtgcgtccggacattacgcaactatcagaagccgccgtgggaacccttttgcgtcgaataaacaatccgaaagccccgacggtcacccgctatcttgattatccactaacccaagagcccgagtaacatcgcagctacgtagattacgcgcagaaaacaaccacgagattctacattggttaagttcgtcgatttgacttttcaaagatcagggtttattatttaacttgtttaaccggttcaacagtttgggattaaaacttcccaaacgcaataaattaatcattcagcgcataggtgcgctgttaatgaaaggaaataccaaatgatcggttcaaatatgaagcgcgtgatagctttaatcgccgcaagtgccgcggcagtcagtctcgccgcttgcggtagcaactcgagtcaagattccaaaacaatcgaattctgggacccataccctcagaagaacgatagcagcacatgggcgaaatacgttaccaattgtgctcctgagggatataacgtaaaacgcatcggctatgcgcagtcagacctattaaacaatctcacaacagctgtcaaggccggcaacgcaccccagatcgccctgatcgataacccaaagatgcctaccgctgtcgacgcaggacttgttacggatatcgaggcagcgggagtcgacgtttcaggattcgacaagaatatcgaaggccctggcatcatcgacggcgtacaatatggggtttcttacggcactaacgcattgggcttgtattacaaccccgatgtcctcaataaggccggcgtcgacccggaatcgattaccgattgggattcactcaacagtgccatcgaaaaagtagtaaacgcaggatataagggcatcacgttctccggcatttccggcgaagaaggaacattccagttccttccctggttctggggagccggcggtcaattgaaggacgcttcaggttccagtgccgagcaggatgcgcttgatctggtatccggctgggtccaaaaaggttgggctccgaaatcggtcgcaacggacaaccaatctgctgcatgggatctgttccttggcggcgattacggcttctccgaaaatggttcatggcagatggagtcggccgtcgaaaaaggctacaagatgatttccatcccagccaaagatggcggagtagccccagttccaagcggtggcgagttcattaccattccagcccagaaaaccaaagacggtgacaagatgaaagcaaccgcggaggtcattcagtgcctcattgacggagataatctcaagaagaccaatgatgagatggtttatcttgccgccaaaagtgacgtccgcaagcagcaggtggaagagaacagtgcctgggcaccttgggttgacgccgtagaaaatgctgaaggccgtaccactgacgttggtctggaatacgaagacatttctgcacagctttctgaagatctacaggctgccttgaataagggctgattcgcggtctcatatttttctggggcatctgcccgccattcattgcgatattcagacgccccattccatcttttccatcaacaggcaggtgaactatgtctcaaacaatcaccgcagataaaccaaggcgaatcaagccaaccacattggccgccattggtttcgcggccccgctgattatttacatgcttatcttctacgtttggcctctgattcagaatatttccatgagtatgcaccgctacacacgtcgcacttttgtgaccggcgatgccccttggtctggattcgatatctataaggaaatattaagcaatcaacagttctggactattctcggacagactttgattttcgtcttcgcttctatcgttttccaatactctatcggcttggcattggcggttttcttcaatcagaatttcaaactttccgcggctttgcgcggcgcattccttgtaccatggctacttccgccaatgatttccggtacgatctggcaatggatgatggacgccgacagcggtgttattaataatttcctcaaactatttggtttggacccggtttggtggctgcaagccgatcattccttgtgggcggttatcattgccaatatttggcttggtattcctttcaacctcgtaattctgtattcgggcttgcaaaacatcaatggcgacttgtatgaagccgccgcgttggatggttgcaatgcttggcagcgcttctggaagattactttcccgttgctcaagccggtatcgatgatcacgctcctgctaggtttcgtctacacgttacgaacagtagacatcatctggattatgaccaagggcactggatcttcgagaaccttggcaacttgggcttatgagatggctttcggaaagggcacatcagcaaccatccggtattcggaagcatccgttgtgggcacgattctcattgttgtagcactgattttcgctctgatttacctgtgggcccagcggaatgaagagaagaggtaactaaaatgaaacatcgttcatcatggtggaaaacacttataggcatcattttgacgctgattatgctcttccccgtatactggatgatcaacatatcattcacgcaacgtcgctccatccgttcaggtgatctgttcccgaaagatttcacgctcgacaattatgcctctgcgttaagttcacagctcccctacctaggaacgtcattgctggttgccataggatgcgtgattctgactctagcaattgcattaccttcgtcatacgccattgttttcttggagttcaaaggctcaaagtccatgaacttcctgttgattgttgctcagatgattcccgcggtcgttatgtctctaggcttttaccagatctacgatgacatcggccttctcgacagtattccgggacttatcgttgccgactccactttgtcggtaccgttcgcggtgattctgatgacgggatttatgtccggtatgccacgctcgttggtggaggcagcgcaaatcgacggagcatcgcagtggggtgtttttgccaaaatcgtgattccactctcccgtaataccattgtcacgacttcgctgttcgctttcctctgggcatggtcagatttcatgtttgcttcgaccctcgattccggtggcggcaagatgaggccaatcaccatgggtctatatgactttatcggttcacagaaccaagaatgggggccaatgatggccaccgcagtattggcctcagtaccaacagcgctattactaattttcgcacagaaatacgttgccgccggcgtaacagccggagcggtgaaagactgatccaacccttaagtacataattacaaggaccaactatgagtgaactaacttttgctatcgatggagatgcactgttgtggactggtgacggcgaatatcttcgcatcgaaccatggggaaagaattcagtccgcgtccgcgcctcgaaaatgcatgagatacaggaacaagaaggagctttgctgccacaaaacaatcaggcctcagacagtcacgactatggtatcaccattgacaagcccaatagaaccgccgaattacgcaatggcgatattgtagttcaagcgaaagcatcctgcggcctgtactccggatcaggatatgaagagccacgctgtttactgagcttctataaggcagacggcacaccgctcattcaggaaataccatctggcggatcactaaatcttcgagcgcgatggttcaaaccgatcaccggaggcgactattccatcgttgcttcctttaccacaccggaaaatgagaaactatatggtatgggcgagtaccaacagaacatcctcaatctgaaaggttgtaccctcgaactcgcgcatcgcaattcacaggcatctattcctttcgtggtttccagtgccggatatggcttcctgtggaataatccggcacttggaaacgttacgttcggcaagaaccgtacggaatggcgagctgaatcagccaagcagattgactactggattaccacaggcgatacaccttcttcgataatgaagcattacgccgacgccacagggcacgctcctcatatgcctgaatggggactgggattctggcagtgcaagcttagatattggaatcaacgtcagctcctagacgtcgctcatgggtttaaacagcgtaatattccattggatctcatcgttgtagatttcttccactggccgcatatgggtgacttccgttttgagaatgaattctggcccgatcccaaagctatggcggacgagctgcacagcatgggagtgaaactcatggtatctgtgtggccccaggtcgcgctcgcctcagagaattatgttgagatgaagtcaaagaaccttctcgtgcgcgcagataagggtgaagacgtcggcatgatgttcgaaggtcccagccagttctatgacgccaccaatccaaaagctcgcgaatatgtttgggagaagtgccgaacaaattatgccgagcttggggttgatgcattctggctcgatgaagcggaacctgaatacggcacgtacgatttcgacaactatcgatattacgccggcccaaaccagcaggtggcaaacatctacccaagagactataacaaaggcttctacgaggggcaacaaaccataggaagggatggtgacatcgtcaacctcacccgttgcgcttgggctggttcgcaacgctatggttctcttgtttggtctggagacgttggttcgaccttcgccgacctccgtgcccagattacctgcgccattcacatgggcatggccggtatcccttggttcaccaccgatatgggcggtttccatgatgggataattgattcggacgatttcaaggagttgttggcccgctggtgtgcattctcatgcttcctaccggtcatgcgcaaccatggcgatcgtagtctgcatacggcaaccggcaaggagaccatcactaattcggccggagaccaccgttcgccaagtggtgccgacaatgagccttggagctatggccccgagatggagcaaatcttccgaaagttcattgccattcgcgagaaaatgcgcccttacactcgagaactgttcgaatcagcacatatcgatggccagcctttggtccgcggactcttctacgagttccctcaagacaagtcggtgtctgatatcgccgatgaatacatgttcggccctgatatcctagtggcccccgtagttgaggccggagctaggtcgcgtgaggtgacgcttcccggaaacgctagcatcacatggacggatctacgcaccggcaaagtgtatgaaggtgggcagaaaatcactgtcgacgccggaatagacacgatcccagccttcgcgcgcgacggacacgaccatgggctgatcggaatgctataaattcccacacaggaagtgtggggcgtccgtttccaaggcgaacgccccacactctgcgctttttcccatttcaaccggtctatctgcgttattatggcagatttgtagcgggctttcgatcaaacagatgttgagcagttttacatggcatttatcaaagtttttgctttctgccgctccgcactcaaagaattcagccagaaaataccgaccgctttttgcagccgcatcaattaagtgcctgcaaaaagccattcaatacgttgctgtcagcaacacctcggaaagcaaagtaaaagttgtggccaatatattcggaggcatcgccaagcaatgcaaccgtattaaaattcggttcgattaaggttcgataaatctacctcaccatttttgcttatggcgagtcaaaatgcatccttcccacatggctttgctgctttttgtatcttttgttgttatccgttgccacttgtcagcatcggcacggcatgtcagtatcatgtgcgtatgcgacttattggtaatattctgtggctgattctgggcgggttgttgctcgccgccagctgggccattatcggtttggtgttgtgcatcaccattgtgggcattccactgggtattcaggcgttcaagatggcggggctcacgttgaccccgttcggtaagaccgtggagtatggcggcggcgtgggatccgtgctgatcaacatcatctggttcgtactggccggtttgtggatggcaataggctatgtgttcgccgggctactcaactgcattaccattattggtattccgttcggcattcaatcattcaagatggccaagctggccttgtggccgttcggctcgcagattcgcgggtaatggttggcgtttttgaatgctggcacccacatacgttccccgcttgcctacggtgacatgcggtgcgtcacgtctgccgaacgatacgctgctgatgccgtctttaccgagattgatacgcacgcccttgcccaagccgacgccctttacgaactcggaaccctgtggaactctcctttgactaccatttctccctgtcgattatatggaggaggcgagaaacaaaccgagagtagaaaaacaagtcaatcatctgccgattcgacccaatcgaatcgcaatcatgaccacacttcgacagagtgaaatgagatgaatcctgtatgcactcaccatatttagcgttttcgccttaggttaaccactagcagtatgaagtgtcttttattggacaaaaagttctacctttggtagaatacttgtttgttaaaagccaccaatgcctctcactgaagcacactagggtggcatttttcttgctcgaggggactccatggcaaattcgcatgacggcaatgctcaagttctttcctacccgcagcacccaccaaaagatttttcagatctggcagccactctaattaagaacggcctgggcggagtagatgccgagacccttgaacgccacctcgaacagattggctattttcgtctaaaaggatactggtatccgttccttagcccatcttcctcatgcgaccacaagcatgtcctcccattcagagaggggacacagttccagcaaatctggtgcagatatatattcgatcaggaactgagaactctcgtgttcgacggcataatcacctttgaaatatatctcaaaagctttctcgcacacgagctttccttgtttggcggcgaatttggatataccacacctgaaggattgcctgagcttagctttgatgattatttggcatgcattaactcgttaagagcatcgttcacgaaatccaatctgccataccttaaacatttcaaaagaacatataaagacccattgccaccgtattggatgatagtaggatgcctaagctacggaactctgaaaggttatttctatcagggatcccccgattctgttaaaagaaagctagcagcgaagcttcatatttttaacccaaatcctaatcccgcagtacatggagacatcaagattctctcaaattggctggaaacgattaggcaagtccgcaacatggttgcacatcatgatcgtttctggaacgagaccagtacccgtatcgttccgaagctgcctaagcatcggagcggttcacacgccaatgaatggtggggcaacgattgggacgccttcagaacagactctaccggccccgccgctttcctcaccatggaaaactacctgctgcaacaaatcgatggctccgcatggaagaacaaattcatcagcctcatggaccgctatccggaaattcctgcaacggaaatgggattccccgaggattggcgatcactcgcattgtggtcatgacgacagacgcgcaccatgataacgtccgattgcttgcgcactttgggttttcaggcttgacgtgaaaggcatggccccgcgtcctgcgtacggtttcttcattcgccaaaacgaaagaaccgcgattggaaaccaggagacggaaccatgcccgagaacaccatgcggatcgaccggcacatgcccgggaccaggcttaatcggctcgtcacgcaggaggatccgcacgaacaacatgatcgaacggctgaacagggagatccgccgccgcacgcgcgtcgtcggcagcttcccggacggtaacagcgctggtgctcgtgcgtgcgcatacggtacgtgaccgcgaacgagtggagctcgcgccgctacctcgacatgtcccggcttggcggcacgctggaggaagcgaactgatcatcgtgccatggacggccatgatccaaagtgcgcaatctttcgagcactaccgttctccggatgcgactgccatacataagcgagataacttctggtcagacctccaaatctgccacatataagcgagatacacacgaatccgagttctttcagcctgattatcaagccggaggcaatctactccaccataccgttcacccagaatccgtttgtgatcttcacgaagtttccgcacgactttcccgtccatgcatctctcgtctcatgtctgcacacaacccgcgttccgtagtcatcttgagagatgtgcagacataagcccgcccttccattcgcagaacctgagtttcagcccaacaattagggtgcagttcaaaccgagagctgtcggagcctaatcattcctgacgcatgggatccttaaaagtgcgtgcctatctttccacatagccaaggcttttggccttggccgttatttcggagatattttcttctgacatatatttttttaagtgccacagtagatacgacaacctgacacgcttgatgtcaaccgttttaggcagatgttcgattcgccaaatgtagtatgcagacaaagcattgggattggtcacgcattcctcatcgacagcgatgaaatagtcctcagagctcatgcttgtcaacatttcttccggcacgagcttcattgcatcttcaattgcttcacctagaaaagcaatagcatcaataagtcttttcctctcgtacgaagaagcgatacaaggccatccactcatccttttcgcatagtatttcgatatccatttatcccagatatttcgagatgaacgaccattaaaccctttgctgtaaaatttatagaaaacatcagaaaagagattcaaatcgttttctctattatctttactgatgattttcataaataaattatcaaaagaagcacatttaaggcttgcatcagacatcaccataacagcgaattcatacagcttctttttaaacttctcttccgctgatgggatttctttggtcaaagaaacaataaccgaatacttcataacaaatctacgtaaattggcgttgggattacccaacataattcgccatgaaagatcgcgcgtttcgtcgtcgttcagaagaccaagaagattgttattcgcgtattttttatcaattccataaaaatatcccgcataatacagcagtcccattttggcgcatagtcttgcatcagcgcttccagaaagaagaatattcaatgcgctatccatctcctcaggaagcccttttcctataacgctctttccatatacgcatttgcatcgtttaacccaataatcgaccattttatacggccaagcacgcttaaccgattccagggatttatcagcacattcaaaatccggcgaatactttttcataatgtttagcgcgaaaacattagaaattcgaaattcatcctcgctatatttgtaaccaaatgaacttatctgttgacacaggagctgagagagaacaccaacacccaacatctcccatttttcatcttgaatcgcctcgaagatattagccctgcattcctccaaatccaaggaatcaatcgacataaccaaggtttccatcaatatggaaacctttttattatcttggtcaatcttagatgagagagcctgacaaactgagcgtattctacttatgttattcatgcagaagggaggaataacacgttcaataacagtttcaaaattgagagattcaaaatcgtcatatcgtctaggaagacgaagaatagcatcaatcgcagcgtcgggatccgaagccaacaataacgccaattctttctcgcctatttcagaagcgccagattccacactgacaagcttgtttttgttcgccaaagatccggtgccatgaatcgattcatacaatgagcgaccttccagccaatcaatttttcccaacaaataataaaggaatctctggcacccatcaatgccgaccttccctccactctctttaaaatatttcaggagttcgtcatgtatttcaggtgaaaaatcatcaaagatacttgcaacataatcaatcgtatcatctccatacaaatagtagtttaaacaatcattttgaagcatccatcgaatcttcctatctggaatccagtcggattgcaccacgacataaagggcaagcctcgtaaaaatgacgtgcccatatccttgccatcgttcaataagcacatctttcgcattatatgaacgtgcaacctcctttaaaactttgattacaaattgaattccagaatccatatgaaatgaaaaatcatccttttccaaatcacgtatatccgaagacaaataaccttccacaagatcagagccataataatcgttcaataaatcacttgcttcgcacatcgaattttcgaattgcaacaatgtgtcatttgaagcgatgcatagtccgcagatttcttcgagatcgccttcatatccacgcaatccagcgtcacatttcacttttgcgcacggttttttcagagatttttcgttcttgatggaactcaaatccttgtaatccaatacaaggtatggctgcaagagcaatcgccatccaagtgcagtttttggcatccccatttccctatatgccttggaatgatcagcgaaaccgcacgtaatacccggtatagacgttcgcagaaccgtttccaatgccctacacttttcctcaccgacatggctaaccattgaggctagctcttcaaatatcgctttggaaatacgctgttcgcagtaagcgagataattgaggattatcttatccccaccatccttgacgcaaagcagagcaacccattcacatattctccgttctgttttatttttgggttcttcatcactgaaaatccaaggaaacagattttgctctctagcccaaaccaaccagttcgcatctcgtgccaaacttgcgaaatcatcgacaaaagcctcttctaggagcgattctttgacatagtcaatatctgtttttctgatagggatccctttttccagaattgaacggaatcgcgttcttctctcaaaaacagaagaacgcgcattttcatcccattgttttagcgccttcgctagagacgaatgctcgcctccgactaccggatatgtgatggtttcgatgtggagtctttcgtatttttctttaacgtcttcattcaattcactatcgccaacaaaggcgtatctctttttgtctcgttcaggcattcccaatgccagatatcgcatgattggatcattaacgctatatccaataaataaaacagtgtaattctggaataattccacgagaaaatgggcggcccaaccttccgtcagatatgctcgaccgaaatctctatcatccagaactaaatatttggcgtcacctttgacggatccatgcaaatgtagtagaccttgaaaatcatgcccaggtgggaaagccggcgcatagtactgacgctcgatttcaatcccttctgtcttcgcagcacaggcgagaaagtcgtcataattcgttgtcacaacacgagccggcggccgtgatccagccagggacataatggcagcatgttcatcattgaactcaaccccttctcccctaaaacgctgtttcacatattcgtgcgccgttatgccgtcgtcactcagcgaacctatgaagccgtcaagatgttcgagatcgctctttttaggtttttcatagcctgcctccttagccaattcttcggcaagctgcctgtatgacggaaaattggttggcggcgccatggaggctccagccccgacgaagaagaccagttctcccctgttatgagcttccatcaactcatcaggaatattaaccccatctatgatttccatagacacccctcaaatagcatccgcgcgaatcgttttccgttccacccctgcaacagaaaacgtgttgttaaagccagtatattatcatccatcctcagaaacagcggcaccatgtcaaccgccagtgccactagctaaggatcccgtttacatcaataacggattattcaatctttaattcgggcttataggaacttttgtggtgcttatgatcgaggtctggccttgtacgagtacgcgtgtcggcatgtctttttccccgcgtggaaaatgatgcgctcccggtggtgggctggatggtgtgagaaagccatccaacaaagcgaaaaaatgcccggtatgcgggcatgcgatgaagaagaacggacggaccggcaagggcacgcaacggtggagatgccggacctgccggctgagctcgacgatgccgcagcgcggccgcagacgggcgcggacgctggaggagttcttctcatggattccggggccgtcgtcccggacggccccggaatccacgggcgacgcgcgcgccctgcgcaagcggatcgcatggtgctggtcaatccggccacgcatcgccccgccggacgcgaagcgccacacggtcatggccgacggcacgtacatgggccacggctggtgcctgattatcgccatcgacggcgagagcggagaagtcctcgccttccagtggtgcgcgcacgagtccaaggccgcctacctggccctgttctccgggatccccacgcccgacgtgctgatcaccgacgggctgcgcggcgcggaggcggcgtgcctggagacgtggcccggcacccggatccatcgccatctggtgcatgtgcaacgcaacacccgcaccgacctgacctccagaccccgactccaggccggcagggaattgaaaaactgtccggcctgctgaccggcgtggaaaccgccgaggaggccgtcggatggggcgaggcgctgaacgcttggcacgaacgctggaaaggattcatcgccgaacgcaccttcgcaagggacgaccccgccaaccccaaggcgtccagacgtatgcggtggtggacgcacgaggagccacgccgctgctaccggcggttggagaaactgttctgcgaggggaagctcttcgcctttctcgagccagcgcttgccgcaggtgggccggtggcccgcaccacgaaccggctggagggcggcgtcaactcggtcgtcaagaacgtgttgcgcaaccaccgcggactgtccgaggagcacatgctccgcgcgtgcgagtgggtgtgctacatgaagaccgcgcacccgcggccggaatcgttcattcccaacgatccgctggaggacgggaaagcgacgtcgcccgaaccggaaggcgacgtctcgcccgcatacgggatcggcgtcgactggaacgaattccacaccggcacgagatatcccaacggcaccgactgacgccgagaaccagacctaaagcaccacaaaagttcctataggcccgatgctctacggaaccgggatcgcctgggacgacttccaccgcccctccgaataccacggtacccccgagtaggctacgaccggacacacattttggcctataacccgtattttggacgccgcatagcacctcacaataaccaatggggcgcacgccacaagagtgccgccccacctggtaaaacccccgatataaaatcaaggccttctattcaaccgattttttatctacaatgagaaatgatgcatgtcaagcacggagtgttgcctcctcatctaattttgtggtctcggtctcgaacatgtgctggtcgaactgcatgatgtgctcggatgcggttcccacctcatggtttctaatcgcggtttttcgtcttggcggatgaaaaacgtacacaggacgcggaccatgcctttcgcgtcaggcctgaaaacccaaggagcacaagaatccggacgttatcgaagacaaaaggggagccataaaaggcaactaaagcacgaatggcaactgcttgcacttaggccttcacccccactaaaaaaacatccctcgaggagtgcgcatcatcgcgttgtccatgattctcatgcgtcatagccaagaagcggtcgtcatcatacatctagctcgagccctccatccacgacatgcagaccaagatcgtgagccctttgacgtgaatccaataaaccaacacttttcacaccgaattgtggcgaagatttaacaataggcaaacaattgaaagttaaagacgctatatcattaggctcttgacagagatcagacaaaagatttgacatctcatgtcgtttcattaagtcacgcaatgcctgactacatatcttagatttctcatgatgcataccgcttcccggctcaccactacgatacccttctttcgcaagtcccttcattacggaataacgaacccaatcagttgacatatctaactgaaatagccttgtacacaatgcagtagccgcaacaccccatcgtatcttcaaatttttcacagcattaatagatgcattaaatggacaaacggccttaacatcggccgcgggcatcaagaaagctgaagcgaatagattagcctcggactcacgcgttttggtctctttatggacgggagaattatgcataactaaatggccgagttcgtgcgcggcgtcaaaacggtcacgctcgggagttttcgatgtgctgaggaaaacatatggctgcccgtctgtgaaaaaggaaaatgcatcgaaacgcagatccgcattctcttcccgggcggagaaaacagcgatgccatgcagctcgagcagttgaatcatgttgccgattggctgattcccgagattccaatgcgcgcgaaggaactcggcggcggcttccggcccgtctcctccgttgacgcaaaacgaataatccggaagatcctctttcgggagggaataatgcttctcgatccaggaacgaagctcgactccttgggcggcgattgcgatcgcagcgttcttgtttcgcacagtcgtcttggtcggagcgcggaacgatagatcctcttgggtgagatcgctttgccattccagataaaaataggattctttcgcatgcaatgcctcggcgagtcgatgcgcttgctcccggttgggtgcttttccccctgactcgaaagcggagatcaaatgctgatcaatgtcggcgatctcggcaaggccttttttggtcagacctctcttccaacgcatattctcaagtcttttcccgacgaactcactattcgggcttttcgcattgttcattttttattttccaatatagaagtcaggctttcctctgaatactgaaatcgaattgatccggatctggcggattctgttgagaaacttcgccttcgggaccgatctcaggaagaatgattcgatctcgccaatccgtgattataatttgatcaccttggcactcatactctaccggaatactcaattccgctcgtatcgacttgtcctgacgaatatcataaagaagcacacgcgtaataggcccatatggaaaaatctcagtatcaagagtctccggaaacaatgagtaagtgctaacgcctagcatttttttgttcgtatcgaccaggcggcgagtcataggacctttagagcatgacgaagatggcattgagctcctatcgccagtcgaagaattccccctaaagaagataaactgctcatcatcagaccgattcgaaacgaatagaatctgattatggtcaaccactcgactgtaggtcggatgttcttgactacggaaatattcaccaagacatcggctgactcgagaatacgccgccattcccgaagcactcggcgcatccaaagaagtgtgttccagaacggcgcctctcgcctctatcaacgcgcgattaagcaacagcaaaggaagccccagccgttcaagacggttagccgggtcctcgtcaccataatccgacatattcagttctggtgaaatcatcactaccttctttcatttttacaaccaaaatcttggtgagaaaaatgataccacaggcagagcgcaaactcacattggacatccgcccgcttcgcaactatcgttcaccacgcaccaaggctgtcgaatgccagattcctcttaccacgcaagtcacgcacagcgaaagaaatccaccaacaaagcaaggacgtcaagagcaagacgataaactctggccgaacaaccaaggaccgccctaggcgatgccaaaatcttcggaaatcacgagatgaagcgaggctgagacactcactccaatcaacttatatccatgccgtccgtttgaatgaacccagttggcaatactgtcaaaaactgagaaagagctgatactgccaccgattttgttcggtcgctagagcgaccatcacgaaggagcccagaggccttctttgaaccgcaccccgattgttcgactgaggaaattcagattcgatgatcggaggtgcggttctttcgtatgcgtgaggatcggaggaaacgttacgatgatgagttccggcacaaggcgctggggcttatcaaggccggcgtgggcaagcatttccttgcccgccggcttgcgatgcccgtgcagaccgcgaaaaatgggtcatgaaacataggtccaacggagaggacgcggtcatgggcgcgaagggcaaacgcagctacgactgggagacgaaggtcgcggccgcccgcgaccacgtcgataacgacatggccaagacggaggtcatggccaaatacgcaatcgcgagcgtcgcgcccctggagcgctggtgtcgcgaataccgtaccggcgggcccgaggcctgtatttcgtcaaatcgaggtggacgctttcagcacttaatctgaacaccttcggcgttcaagttgaacgccatcggcggctggttctttgtctttgttgtttgtctggttggcttgtttcatgagggagtgtctgttccgataggattcgccgtggaagcggatgatcctgccgtggtgcacgatgcggtctatgaccgcggcggccatgtccccgtcgccgaacacgtcgccccacctgccggactcgaggttcgaggtgaagatgacgctgcgggtctcgtagctgtccgcgccggcctagaacagaagcctggccccgtcgatgtcgatgggcaggtagccgagctcgtcgatgcatcgacgagctcggctacctgcccatcgacatcgacggggccaggcttctgttccaggttatcgcggacagctacgagacccgcagcgtcatcttcacctcgaacctcgagttcagcagatggggcgacgtgttcggcgacggggacatggccgccgcggtcatcgaccgcatcgtccaccacggcaggatcctccgcttccacggcgaatcctaccggaacaaacactccctcatgaaataaaccaaacaaacaacaaaacaaggaaccaaccgccgacggtgttcaagttgaacgccgacggtgtccagattaagtgccgaacacgtccacctcaatttgacgaaatacagacaacctcgccgaccgcgatttcacggccgaacggccgaatgagaagtggctgacggacatcacccgggatcaaggcccgggacgggaggtgtacctctcgccgccggtcgactgccacgatggcgggatcgtcgcgtacacggccgggtccggtcccaacgcggagctagccaacaggatgctcgtcaaggccgtggaaacgctgccggaggggcgaggtccctggtgcattccgaccgcggctgccactgtcggcggcccggatggctggatctcatggaccgttacggcctggcgcaaccacgagcgtatcaaacggtcactcggttggatgagtccggtacaataccgtcagagccagggaatgactgcgtgatcatctccaagaaaacgtccgcagcctgctaccgatatcaatcgccctacatcgacaatgtattatcgacaatatattgcgataatccaagaatatttgatgattagtcggtaatgtcggctttgtagaagttcacgtaggaacggctcggcgtcggaccgcgctgaccctgataatgcgagccggtgccttgcgaaccgtacggatgttctgcgggagagctgagctggaaaaagcacatctgaccgatcttcatgcccggccacaacttcaccggcaacgtcgacacattcgacaattccaacgtgatatgaccctcgaaaccagggtcgatgaagcctgcggtggaatgcgtgagaatacccaagcggcccagcgagctcttgccctccagtcgggcggcaatcgtcggatcaagctgcacatactcccacgtggaccccaacgcgaactcacccggatgcagaatccacggttcgtccgaagccacctcgaactgctcggtcagctcgccctgattctcagccggatcgacatacgtgtacgcatgattgttgaacaggcggaagaaacggtccaaacgcacgtcaatggaagcaggctgcaccatttccggggtccacggatcgagtgaaatatgaccttcggcctgcgcggcgagaatgtcacgatcggacagcagcatcgaaactccttattgccaggcacgcgaatgtgccggtatggcgctcgccaacattcgaacgttcgcatggttgagcgtgcgaatgccggcaattgcgaaatgattattagctggctctagtctaacgcggtatcgctatatcgtggcttatatcgggctgtaacgattgccgtgtgcttggtacgcaaaatccgatgcatggattttctacgggattcttctgcaggatttcttacaagattcccggcgcgatatcatgtgctgcaagccagtcgcgcaaatcgctgaattcgttgagactaaccgcatgatcgagcccacggtagcttttcgacgtgagaaacgtatgctcgtccagccaggcggcagccgcgaaaagctccggcatcggaatcacggtatcgttcttgccataaccgtagaacacaggaatattcaactccgcgacataactgtcggcaggcgcgctaccggcgacgattcccggagcaaggaagccggaaagtgagattgatgcggcgtaccgttccggatggacgcgcagcaattgaatcgccagcaaaccaccctgcgaaaaaccgatcggcaccacagcgcgatcttcggaaacattgcgcgcgacccaatcgtcaatggcttgggcggcagcataggcgtcgcgatccaaatcttcgccggaaggcacgcaatcatggaaccacgaatacgcgccctgaccgaaaccgaattcaccggaaccagcctcctgcagcacgagcggcgcgcgcaacgacgcgaaatcgttgtagggagctacgtaacgcatcatgtcggccaaatcagcctcattggaaccccagccgtgcaggcagaggaacagcgggcgtcgtggagccgcattaccacccccgcgcgaatactgcacgtgcgtgacctgcagcggctcgccgaaccgccccggaaccacctgcgatttgcgcccgatcagaccggtcggggtgtttggattgctggaatcgtgggaatcgctggtttcgtgctcgcgtatttcactcatgcctccaatatacccgtttcagcggggcaatcctcccagtcactggaaggattgggacgctgagcggcttgtaagcgggcagattctcccactgactggaggaatccacccgttgaaggcaaaaagaaaccccggtggagagaagaccaccggggagagaaaggagagagaagaagaaagggttcaattgtcgggaactgctgtgggttcctggtcggctcttttgctgacatctcctatataagcagacgatgctgagtacatgtctggcgttttctgggaaatatctgagaatttcaattccctcatgttttagattgtggaatggcctccagtttgccacgttatacgcgtgttccgtttccgcgcagttgtctcatcctccaggttcccacagttcgttcgcaaacaaactcatggcggatcaccggctcacgccagcttgctaaccccatcagatcagcggatgctagatctgcgcgtcggcgtccacgctcatcacatacacgttgcgtcgcagctgcttggattgcgcacgcgtaatgtcgcccgcctcgtacatgtcttggatcacacccagctcgataccgtagctttcgcgcttcacatcttccgcctgcgcctgcgcctccgcgctcgtgcccacattcgggcgcgacctcagcgtagcctcgcctcgtcggtaatccagcagcagtgccgaacaatgttccgtattgtatgtgtcacggcccatctcctcatacaggcggtcgattacatgttcgatggcatccacctgcaccacgcgggtgtgcgcgaacagctcgtcgtcgctgaacagcggggtagtgcggcgaatgcggctgttcacacgcttcaacatggtgcccatacgcctctgcaacgctctgaagcggcctttggctcgccagatggtgcgtccggaattatgttccgtttcaatatggcgcagtgagctcatgatctggtcgagcaggcgctcgcatgcttcgatttccagatcgtgcgctgccttgtcgtcgttcggcgtcgctttgactttcgccagtcgcgccttgacgtattccttctcccaattgagcgcatcgatctgcaattgcatatacccttgcggatcgatttctccgatgcgctgcttcagccgtgtaatacgtttcgtatacgagtcgatgatcatcagcaccgcacgacgattgtcgggtgtgactcgtcccgtcagttcctccacggtccgtcgcagcacttcgatggtgatttcagccattttcacggaagtgtctttattgcgattcggcgccagcagaggcagcaggaagttggcgagcagcaaggttacgacgatcacgccacctgcgatgaagatcagctcgtcacgcatggggaaccacgcgcctcccgtaatggtgtacgggatcgtgaacatcaacgacagggtgatggtgcctttcggcccgccgaacgtcatgaccgcggccgaacgccaacgttgcgccgtcatcttgcgtcgcttaccggtgacggtatctcgtgcgagacgcagcatcaacgaaatccacagaaatcgcatgacgatcaccactgcggaaaccgtaagaattgcaaccagcagccgccaattgctgacctgaggatcatcccagcttgcgctcatcgcattcggcagcagcatgccaagcagaatgaacaccgtgccgttgagcgtaaacgagaataccccccatacgcttgacgaaacaatgttggtgcgagcaacattcgggccgatgccggttcggtcgaaacggatgatcaaaccggccgtcactaccgaaagaatgccggaaacatgcaccgcttccgcacccaaatacagaatgaacggcaggaacaattccatcaaaatacggcttgtggtcgtctcccaaccgaaagatcgcaacgattcaaataacaggtcggcgatcatgcctactgccaagccgaaaatagcaccgccgaagaacgagaacacgaactgtatggcagaatcgcccacttcgaatacgccgctgatggccgctgcaatcgcaaactggaagccgacgatgccggacgcgtcgttgaacagggattcacccttgagcacgctggtttgccgttgcgtaagagcggcttccttgccaagcgaagatacggcgaccgcgtcggtcggtccaagcgcggcaccgagtgccaaagccgcggcaaggggaattgcgggccatgcggcatgcaggatgaaaccaacggctaccatcgtagcgatcgctagtccaatcgccaatgaaagtgacagtttaacggatttcaacagctcgcttttgtcgatttcatgcgcttccaaatacagcagtggcgcaatgaacagcaccatgaacagttccgggtcgagtgtgacgttcggaaaaaacggtaattgcgatgccaacgcacccaacgcgatctgcacaagaggcgtggaaaccttgggaatgaaacggctgataaaggaagacagcacaaccgcggcgataatacatacaatcaattcgaataccgccaacgtgcctcctttgcgcgcattttccaaactcttccagcctaccaagaggtatttatgggtgtgtttcgccttttgcttcacgtgaatggaaccgtatagtggcggatatgcagtggagtgacgacatgggacttgcgatcgagttggctcgtgaagccgcagcggagggtgaggtgccggtcggtgctgtcgtgcttgacgctgggggagcggtgattggtcgggggcgtaatctgcgtgaggcgcatgccgatccattggctcacgctgaggtcaaggccatgacgcaggccgctcggtcgcttggtacgtggaatcttgccgattgcacgttgattgttaccttggagccatgcccgatgtgcgccggcgcgtgcctgcaaacgcatgtcggacgaatcgtgttcggcgcgtgggatgccaagttgggtgcatgcggttcgatttgggacattccgcgtgaccctcacgtcggccatgttccggaagtcgtcggtggtgtgcgcgaaatggaatgcgcacgattaatgactgatttttttgctggaaaacggtaactcgattttgcagtcgcaagaaatactttccgaaagaaagaaacacgctcgatgacgtcaacaaataaagcttgacatattatcgaaggtgacaatacaaggcaatcgcaatatgtaaaggatgctgcaatgacgctcattcagaccttccatggcaacgctaccaacggtaccgaactcactgcggtctacgccgaacagccagccgcgaacgtggcgttcgcactcgtattccccggcaatgatctgccgcgacttgtgcactggggccgcccgctcgcagccccggcaaccgcgatcgacatgttcgacgcgcaaatgccacagcgcgtttccggcgcgctcgactacacctcatggccaagcgtactgcccacgcaatccgaatcctggattggcgcaacccgcttcgacgtacgccgcgacggcgtggaactgttctgcaagttcgcagtcagcaacatcaccgccgaaaccgtggcagctggcaaaacctacgtcatgggcgaaaaagacggatacccgagctggagcgtggccgacgaacccaagcagaccccaaccgttaccgtcaccgcagaagacgtggaacagcatgtgaaactcatctggacctgcgaactcgacgaaaccggcctcatccgtcagaacgccgaagtcgtgaacactggcgaaggccagctcgaagtcggcaagatcgaactcgcattcaccgtgccggccgacgccaacgaaatcctcaccaccaccggccaccatctgcgcgaacgctccccgcagcgtcaagacttcaccctcggccgcttcgccaaagcatccatggccggacgcccagacttcgatgccaccctgctgctcagcgtcggcgaaaaaggcttcggcttcacgcacggcaacgtctactccgcacacgtggcctggagcggcaacagcgtgctttccgcggaacgcctgccctataccagcggcgtgattggcggcggcgaagtgctgttcggcggtgaaatcagcctcgccaacggagagtcctacaccaccccatggctcatcggctcctatggcgaaggcctcaacgaagtcgcagcgcgcttccacggctacattcgccgcgtgcatcgcgactggctcgctgaacacaacatcgcacccaagccacgcccggtcattctcaacacgtgggaagccgtctacttcaatcatgattacgacaccctcaccgcactcgccgacaaggccgtggaaagtggtgtggaacgcttcgtcgtggacgatggctggttcggctcccgccgcgacgacacctccggcctcggagattggcagatttcgcaggacgtgtggcccgacggcgacaagtcgctcaaggcgcttgccgattacgtgcacggcaagggactcgaattcggtctgtggttcgaaccggaaatggtcaaccctgattccgacctgttccgcgcacaccccgactgggtgttgaagcccactgaaggccgtctgccaatgcagggacgtacccagcaggttgtggacctgaccaatccggacgcctacgactacatttacgacgcaatggacaagctcgttggtgaactcggcatcgactacatcaagtgggatcacaacaagctcgtcaccgaagccgtctccccgcgcaccggacgcccggcagtgcaccagcagacgctcgccgtatatcgcattttcaccgatctgaaggccgcgcatccaggacttgaaatcgaaagctgctcttccggcggtggccgcgtggacctcggcatcctcgaagtggccgaccgcatttggggatccgactgcgtcgacccggtggaacgcgccgacatccagcgctacacctcgttgctcgtgccgccggaaatgatcggcgaacatgtgggcgcatccccggcgcactccacgcaccgcgccaccacgcaggaactgcgtatggccatggccttcttcggacacatgggcatcgaatggaacctgctcaaggaaccgcaggaagatatcgacaagctcgccgaatgggtcgccgaattcaagaagcatcgcgaatggttcgccgtcgacacagtcgtgcattccgacgcagccgatccggcagtgcgcttggacggtgtggtcatgcctaaccaagcggccgccatctaccgtttcacccagctcactacctcgcagacctacccggccgcgccggtacgcctgcccggactcgaccctgacaaggtgtatgaggtgtcgccgctcgacgtgagcctcgacctcgccaagcaagacatcgccaacggacagagcccgctcggctggtggaaggccgaaggcgtgaggatgaccggacgcgcgcttgccacgtacggcatccgcccgccggcactgcacccggcgcaagcagtccttttcaaggccgtgcttgcgcccgtcgagagcgctgaatagcgcgctctctccccttacctacgggaagcccactgggcttcccgcttaacggttcggcaagcagtccttttcaaggccgtgcttgcgcccgtcgagagcgctgaataagccgtaatcgcataacaaaaatcctccctgaacaaaagggaggattttttgtattgcaagacaatcaatcgcaatcaatcgcaatcaatcagccaacatattgccgaattgcctgtgatgcggccgccttggcccacaaagcccaatcgtggtcgggaatttcaaaatccactggcgcggcctggctatgccgatacatgttgatgccgttacgcaagtcgtcaatgccgaatttcgcgatgaacgacgattctccggcgatcatgattttgtctggcatggcaagattggcgatggtcgccaccagggtgccgagacggaagcaggtgcggttcaccagattcgtcgcttgcggtttgttcgcgcgtgcgtcacgtgcgaaatcgtcgaatgatgcgggatgtccgatgatttgcgaatattccgccgcgatcgagttgtcggacaggcattgcgcgcatcccttgtgtccggaaacacaacgcggcccatccggatcgaccagaatatgcccgaccaaaccgtaacttttatccggacagcttaccagctcgccgttgaacgtcaacgaatagccgacgcccgcgccgaacgtcagcaccgcgaagctatccaatccaacgcccggtccaaacaggcaggcgtcaaccaccaacgaatcgatatcgttgtaaattccggtaggcaatccggtcgcctcacgaaccatgacggaaagttccacgggctgcgaccagtgcatgaacggtgcgaacgtcaccacggtaccgtcgacaatatgcccgccaagcgagattcccacagcgcacggtttcggccagcccgccatctccgcctcgtcggaacagtcggtcgtcagttgtttgatcagcgcgaccacggtctgcggggaagcgtcttcgatttccagatcatggcatccggtgatgatctgcccgattgcgttgaccgcaactgccgaaatatgcgtcgcgttgattttcatgccaacgaaagatcgcgcattcgcaatcacctgcaatccggtttgcgggcggccgcgacgttccgtattttctttctgcacgaaacctttcggcagtttgccggccttgccggacggcatcggcgtctcctcaatcacgcccgcataaatcagatcgctggtaattcgggaaacagcaccctgcgaaagtcctaaaatctgcgccaacgtaatgcgtgaaatcggaccatatttcatgatgcaagccgcgactttatgggtatattccgagccttcaaaccactgtggcagaggtgaaaccgccatctgaaccatccttcgtgctcccgttcgcgcacatcgtgcgtcaaattactttctcagagtaataaaatctcgtcgtttttgttttccgccccgcacaggcgcgctgagttgggaatgaaaaccgcccccctctataattctcagtaacggtggtgtggtaaggaagccgctccaccgtaatagagaaaaaatacaaaggagtcgagaatgaaacctgattccaccactagtgtaggtaaattcaggaggattgtataccgcgctctcacggccacatgcgcaatcgcgttgacggccggtcttgcaggttgcggcaacagcaccgctggaaccgtcactttggatttcttccaattcaaagccgaagcagcggactggttcaccgcaaaagcaaaggaatttgagaaaacccatcccagcatcaaagtcaacgtcaacaattcgtccgacgcaaccactgatttgcgtacgcgactcgtgaaaaatcgtgaacccgacgtcatcaccatcaatggcgacattaatttcggcatgctcgccgaagcgggtgttttccacgatttcaccgacgatgacatcgtcgacgaactcaatccaggcatggtgaacatcgccaagagccttgtacaaaccaacgacgaatccaagaagcgcctgtacggcctgccgtatgcgggcaacgcgtccggctacatcatcaacgctgacgtgtgggaagaagcgggcgaggatcccgacaatccaccgcagacgtggagcgaattcatcgacctgctgcaacgcttcaagagcaagggcattgtaccgatcgaagcgagcaccgctgatccgtggacactccaggcgccgctggcgtcactcaactccacgctggtaccggaatccgaatatctttccctcaaagacggatcgaagaaattctccgacctgtggggcactgtcagcgatcagctggtcgagatctaccagaactacacgcagaagaatccggccgtcacttaccagcaggccacgcaggatctggccgcaggcaaagccgcgattctgccactcggcacctacgcgattccgcagatccgactcatcaacagcgatgccaacttgcgttttgcgcaaatgccggcaaccgacgatgccagcgaacagcaactcaccgcaggcgatgacgtgatcctgaccatgggcgcacacaccaagcacgagaaggaagcgcgcgaattcatcggcttcctgatgaacgacgaaaacatcaaggactactccaagcagcagtccgcctttaccccctacaaagacacgtatgtgggcgatgaagcgctgaacggtgtgcttgacttctaccaggcgggcaaactggccgacttctgcgaccattacgtgccagccagcatcaacatcgcaggcttcctgcagacgctggttcagtcgggcaacaccgaaaaattcctgaacagcatgcaatccgaatacgacaagatcgaagccagaaacttcaggtgagaggaggaacggacatgactaccgcacatactgcaaatactgcgaagaaatctgcaaaaacttccaagaataaggtttcgaaatattccaagcgcaaggtcgatccggcattttattggatgaccgttccggctgcgattctggtgtccatcttcctgtattggccgttcctgcagggcgcggcatactcgttcactaattcgcagggttacggtgattttaaattcatcggattgaagaattatattgcgatgttccaggattctcgcgtcggtcacgcgtacctgttcactattctcatcgcagttttgattacgctcggcacgaatattctcggcatgttcctggcggtgctgctgaattcgaaaatcgcattcaaaaatggattccgtgcgattttcttcattccgtacaccctgtcggtgctggtgatcggctacgtgttcaagtacattttcatgacgccgctgccggcgctcggccaggcgctgcatattgattggctgtcgacgtcgatgatttccaatccggatttggcatggttcccgattgtgttcctgtcgatctggcagggcgttgcctactccacactgctgtacttggctggcctacagaccatcgacaacgagatttacgaggcggccgcgatcgacggtgtgaacgcttggcagaacttctggcagatcaccttcccgctgattggcccgttcttcaccatcaacatggtgttgagcctcaagaattcgctcggcgcgttcgaccagatcatggcattgaccaagggcggcccggattccaagaccgaaaccgtctcgtatctgatcttccagaacggccttggcaatggcgaatactcctaccagatggcgaacgcggtcacgttcttcatcgtgctggcaatcctggccttcgtgcagctgaagttcttcagcggcaaggaaaaggtctgagcaagggtctgaaagtctgaaggtaaagaggaaatatcatgactagcgcaactgttgcaaagactgcaaagactggcgttcaagcgcaagcaaagccagagaaaatccgcagggatcataaggtcaactggtggctgaccgcggttgtgacggtgttgagccttaccgtgctcgtgccgttgtatttcgctgtggtcaccgcgttgaagacgccgggcgaggctggcacgttcagcttgccgaccacgtgggaatggcataatttcgccgacgcatggaataaggtgaactatccgaaggccgcacttaactccgcgatcatcaccgtgtgcgcggtggtgttgacgctgctgacgaacacgttcgtcgcgtatgctgtggcacgaaatatggataagcgattcttccgcttcctgtattacttcttccttgcgatgatgttcgtgccgttcacggtgatcatgctgccggtcgcgaaggaaatgggtacgttgcatcttgataatcagcttggtttgattattctgtacacgattcttggcatcggcaccaacctgtttattgcgattggttttattcgttcgattccgatttcgttggaagaggcggctcgtatcgacggtgcttccacctggcgtattttctggacaatcattttcccgctgatgggtccgattaatgccacgattgcgattttgaccgcactgtgggcttggaacgacttcctgctgccgttgatcacgctgactgatcagagcaatcagacgattccgctcgcacagtacgtgttccaaagccagttcacgtcgaactatccgatggccttcgcgtcctatctgatggccatggctccggttctcatcgtctacatcttcgcccagaagtgggtcgtcggtggcgtgatgaggggagccgttaagtgaacagcccagtggtctgttcataggctctccctgagcgagccgataggcgagtgaaggcagggacaacgcggccgtaggccgtccgttcaggaagtaacacttcaccgctctgagcgggactggcctatcccactccccagcgcgggacgttccatttccctttctggaacgtcccgcgttttttatttttgcggattggtttttcgcgtccgtaagaagcgtattcttttcttgctttgcacaactcgccgcgggaaagaaagaaaaacagggttgcataccataggggagtaggcaaaatcgatcttctgcatgaagctgacatgagctgaaaacgggcagagtcagtcacgaaagatcgaacgaaaatctaacaaacgtcaagcaaaggagctccacgacatgacgaatttcaatcgttccacccttcccgacaccgtgcgttccaacggcgcgaccccgaacccgtggtgggccaacgcggtggtgtatcaggtgtatcctcgttccttccaagacacgaacggcgacggcatcggcgatctgaagggcatcaccagccgtcttgactatctggccgatcttggcgtggacgtggtgtggttgagcccggtctacaagtcgccgcaggacgacaacggctacgatatttccgattatcaggatatcgatccgctgttcggcaccttggaggatatggacgagctgcttgccgaagcgcacaagcgcggtctgaagatcgtgatggatttggtggtcaaccacacgtccgacgagcatgcttggttccaggcttcccgcgacaaggacgatccgcatgccgactggtattggtggcgtccagccaggccggggcatgagccgggcactccgggtgccgagccgaaccagtggggttcctatttcggcggttccgcttgggagtacgatccgaagcgcggcgagtatttcttccaccagtattccaagaagcagccggatttgaattgggagaatccggaagtgcgcaaggccgtctacaagatgatgaattggtggatggatcgcggcattgacggcttccgtatggatgtgatcacgcaggtttcgaagactgttgataagaacggcaagctgccgggagaagacggctgcgagattgaggattatccggttggtgaggaaggctattccagcccgttcccatggtgctccgacggtccgcgcatcgacgagttccttgccgaaatgcgccgcgaagtgttcgaaggccgcgaaggctacatgaacgtcggcgaagcgccgggcatcactccggcacgcaacgagcatgtcaccgatccgaagaacggcgaacttgacatgctgttcctcttcgaccacgtgggcatcgaccaggaaggttccaagtggaacaccgtgccgttcgaagtcaagaatctgcgcgcccgcctcgccgaccagcaggaggctgtgaagaacgccggctgggccagcctgttcttctgcaaccatgatcagccgcgcgtcgtgtcccgttggggcaatgacacggaccgtgagtcgcgcgagctgagcgccaaggcgttcggcatgctgctgcacatgcaccgcggcaccccttacatttacgagggcgaagagctgggcatgaccaacgcacacttcaccacgctcgagcagtaccgcgatctggaatccatcaacgcctaccgccagcgcgtggaagaagcaaaatgccagtccgcagaatcgatgatggcggcgctcgcgctcatcggacgtgacaacgcacgcacgccgatgcagtgggatgcttccaggtatgcaggtttcaccgcgccggacgcggcgacggaaccgtggatcggcgtcaatccgaaccatgtcgagatcaacgcagccgaggaattcgacgatcccggatccgtgtacagcttctacaagaagctcatcgccatgcgccacaacaacgcgaccatcgcgacgggcgaatggaatctggtcgcggcagacagcgagcaggtgtattccttcacccgtaccagcggcgacgacacgattctcgtcatcgtcaatctcactgataggacggcgcaggtgcctgctgaggtcgcgcaactgcttgaggatggcgtgggcgagtcgcaggtactgctcagcacctatgatgccgtgcatagcgtaaagtcggtcgctcgcggcgagctcgctcgctgggagggggtcgtgatccagctctgatcgatctttcctataaactctctgcaaaaagcgttcgtgcgattcatcacgggatcgtacgaacgctttttctttatttgtattgtgatttatcagattatgtattgcgattattcctgattgcttgtgattacttttcgcaagcaatctcacttttcatcgcgaaagccgcatgataaggcagtttcggcagacgtacgcttacaataacgctcatggaacaaaacgaggttctcaaagcattgcagcgcgatcacgcagctgaactgaaactagccgccgaacgactcaagggcactgcgcgccacacggaaatcattccgtccaaggtgctgtccgacatgaccggacatgagattctgctcaagcctgagaatctccaggtcaccggatcgttcaagattcgcggcgcctacaacaagatcgcatccctgagtgatgagcagctggctcgcggcattgtcaccgcttccgcgggcaaccatgcgcagggcgtggcctatgcggctcgcgaacgtggtgcgaaggcaacgatctgcatgccgcagatcactccgccgctgaaggttgacgccaccaaggcgtacggcgcagacgtggtgctgtacggcgaggtgttcgacgaatccgcagcccgcgcccaggaattgagcgacaccgaaggcatgatctacgtgccgccattcgacgattacgaggtgctgtgcggtcagggcaccatcggccttgaaatcctcgaagacgtgccgaacgtcaccgacgtggtcgtgccgctgggcggtggcggtcttggtgccggtgtggcgctcgccatcaagacgttcaagccggaagtgcgcgtgatcggcgcgattccggagggtagcccagcatggaagaattcgctggccgcaggtcatgtggttgccgccgaccaggtgcgcacgtccgccgagggtgtcgccgtgaagcgtccgggcgatctcacgttcgcgctgctcaacgaattccttgacgacatcgtcaccgtgaccgagcgtgacatcaacgagatgatcctgctcatgctcgaaaagcacaagctggtggttgaggctgccggcgctgtgtctctggctgcgctcgagcacctcaacctgcgctcgcgcaagttcgctgaggcgaagggtccgcatgtggtggtgccgatcatgtctggcggtaatgaagacactgtgtccattggcgctgtgattcagaagggtatgatcacgcgtggccgcatcatgcatttcgaggtcgagctgcccgataccccgggacagctggtgaaggtcgccacattgctggccgagcagcgtgcgaacgttatcgcgctggatcacgaccagttcaaggcgtccagccattacgcgaatgccgtggctttgggcgtgacggttgaaacgaatggtcccgaccacattgatcgtgtgctcgaggcattgcgggaagccggtttccagccgaagcgcatttactgatttcagtaccgtttttcagtatttgataaccaataagggtcttggaaagccttgcgatgatttctgattgtcgcaaagcaatccaagacccttttgttgtttatattgcttgactagccgttacgtcattcggatttttgtcgttgaaaaattcggattttggtaacgaccaaccaaaaccggtgtaattccaacgatttgtgccggtactgcaagacgtacgagaaaacgtatttactgtgcggcttactgctcggcggtgatggtttcgtcgacgagctgcggcagggcgacggcgatatcgtcgtggataagccggtcggccaaccgatcgtattgcgtgcgtcccatgttcataatggtgatcggcacgcccgcctctgcggctatgggcacgatgcttgccgcgggcatgacttccagcgtggatccgatgacccacagttcgtcggcctgcgttgcgagtcgatacgatttttcgagcgcgccgtccggcagcgcctcgccgaagtagaccacgtcggttttgatgagtccgttgcatggcatgttgccgctgtagggcagtctgcgatggcagtgcggatcgggttcgttgtcgagattcgccatgatgtcggcggtgtcatattttgcatggcacttcatgcagtgcgaggtaccgatggtgccatgcagattgacgatgacgtcgctgctattgccggctttttcatgcaatgcgtcgaagttttgtgtggcgagcagcgtcagcatgccagcctgttccagtttgacgagcgctttatgtgcggtgcccggctgtgcggtccacacgggtgattccttctgccaacgccaggaatacttgcgatcttcctcgtggcaaaggaatgcttcgatgtcatacactttcgtttgttcagggtgcttagtccagacgccatccggtccacggaagtcgggaatacctgcggacgtggaaatccccgcccccgtcaatactgcgatctttttgctcatatcttaggtatagccgcacgacgtaacttctgatgtttcacgtgaaacagggaacatcgggcaatcaaattcgagaaaagcaatcttaataatcatgcatggaaaggaatgagaggtgcattatgactactgatattgcacaaaacattgcagatgatggcgctgatgcggccgagactgccgaaacgaccgagacggttacggcgatcggggcaatcgatatcgaatcgatggtggcgccgccgtcgccgacacagcttgccccgattccgacgccgcgagcagactaagttcttcccgcacactgatgagtttccggaaggctgccgagtgatttccgacttggaccaggatgattttggatatcccgtgaatatcgagcaggttacatacgtgacccgtcagctggctgatgacaccagtgttgatttgccgatgtgggtattcatgcctggcgttgacaatatgcccgagggcgcaatgccggaaggtggttggccggtgattgtgtttgtgcgcggttcggcattccacgagcagaatgtgaccgattactcgaattatttcgtgcgtattgccgagcaggggtatgtggtggctgcgctgaagtatcgtcacagcgatattgcgccgttccccgcgcagatgcaggattgcaagactgcggtgcgtttcatgcgcaagaatgccgaacgcttccattgcaacaaggatcgtattgcgctgtggggcgattcttcgggcggtcatacggtgctgatggctgggttcactggcaatcgcgcgcctgatacggatgcctatgccgaggaaagcgccgaagtgaacgcgatcgtggattggcatggccctactgatttcgcgaagatgaacttttatccgagttcgcagaaccacagtgatccgcagtgcccggaaggtgtggtgattggtggcgttgacgtgcttgaacatccggatttgagcgcccaggcttcgcctatgacttatctgagtgccgatatgcccactccgtcaacgctgatcatgcatggtggccgcgatcagttggtgccgttcaatcagagttgtcgcctgtatgccacgttgaaagcgcttggcaaggatgtgacgttctacaagctcgataacgcctgccatgcctgttacggattccgtagcgcttgcgcgttgcgtttggtgttcgattggctttccgatcgtctgtgacttgctgtgatgcgctgttgatctgctgattgccgtgttgttgcgttgtgtgacacgcggcaatcagctttttctgacgatttttgggttgtgctggagttggttttgcgatttatggtgtaagaaagacggatttcgacacgccgacgctttccagtgtttgcaagggttcgcgtcttgtttcgtcatgctgaaccgcgtctgaagatcctcaccccggaggtttccactccgaaggccgttggcgaaatcgttcgccagcagctcgagcattttgaggttcctgagtccgctccggtcggcatcgcattccccgctccgattcatgttggcgagaagctcggctatatggccaatctggaccagtcttgggttggcgtggacgtcaccgaagtgttctccgaagcttgcggccgtccggtcaccgtggtgaacgacgctgatgcggccggtcttgccgaacagcagttcggcgcagccaagggccaggacggcctggtcgtcgccaccacgctgggcaccggcatcggcaccgcgctgatcttcaacggcgagctcattccgaacactgagctcggccatttggaactgctcaagggcaagggtgacgccgagaagtacgcggcatcctccattcgtgaaaagctcgatatgggctacaagaagtgggccaagcgtctgaccaagtattattccctgatggagttctacttggatccgcagctgttcgtcgtcggcggtggcgtgtcccgcgtgtccgagaagttcctgccgtacatcgacatcaagaccccgatcgtcgcagccaagctgcacaatgaggctggcatcatcggcgctgcgtactacgcaagcatcaagcagaagtgatgtcgtgaaccataaaggttcctaaccttcatataagcgagagccgtccgattcatccgtcggacggctcttgttattcctctgatgatcgcatggcgaatgcatccttcttgctcgatgcaacacttgcgcaacccagagagtatggtggagaccatgcgtttttcctccagagtcgatatcagcgagcccaatcccatcgccaaagccgaagcggaagccaaagcaaacggcatcacactcggcaaactcaacgactccaatccaaccaaacatgcgctcgcgtcggaactattgccggacatctacgaagcggagccacgcggacaacgatacgcacgcgaagcgctggccgcattcctgcatgaacaaggcaataccgctaccgccgacgacctatacatattgagctcgacgtccgaagcgtactcatggctgatcaaactgctctgcaatgcaggtgacgccgtgctcgcaccgaagccgggatatccgctcatcgaatcgatcgcacgactcgaatgcgtcgacatgatcgagtaccagcaacgtttcgacggatcctggtacatcgacgtggccgaactacgcgaagcgcttgaaggtgaagatggcggccgcatccgcgcgctggtgctcatcaatcccaacaatccgaccggatcgtacgtcaaagcgtcggaacgtgaggccattgtgcggctttgtcatgaccatgaggtggccatcatcgccgatgaggtgttctacgactatgatcttgaaccattcgatggcaacgcgcgtctcgcgggggagaccggcacgctcacattcgcattggatgggttctcgaagacgttggccgcgccacatgccaaagtgggttggatccaagtgtccggcccggcggctgaagtggatgaggccaagcgcagactcgacgtggtcgccgacgactatctgccaatgagtgagatcatcgccaaacagatccccgccatgctgggcgccgcagccgcgcagaccgcgcgcgtgcgagagcgcgtgcaaaccaacctcgcagccttgcataccatgctggatgatgacgagcagggcatggtcagcgtgttgcgtgccgaaggcggatggaatgtgcttttgcgcgtgcccagcgtgcttgacgagaacgaactggtgttgtccatgatcgaaaagcacggaatttcaggacagcccggctatttcttcgatatgacgtcgaacggctatctcgcgatctcgttattgccggaacccgacgaattcaggcataacgttcagacggtgcttgacaccgtcaacacaatgatcggctgaaacatgttgtggttccatcgtcgacaccgatgaaggagccgcaacatgtggggaacgggaataatccgtgggtatggtcaggctttggaagcctcatatttagcgcggatgaggtccgtgtaaaaggccacggcctcatgcgggccaccgtcgaacaccacctgatgatcgtcgaccaccagcgtgcggtcgatcgcatattccgcgcatgtgatcagctccgtgtcatgcgtggcgaacactacctgtttgtcgtaactgaacagagctttcgccacatgcgcggacgccacctcgtccaaacccttggtcggctcgtcggcaacgatcaccgcgggggagaagctcaatgcggaagcgatcgccagcagatgacgtttctcgctatccaatgcggaggcgggctcacgtgcgaccgccgccagatcgaaatgcgcgaacagattgccgatgatcgcctggcgttcgctttccggcaccttatgcttcttcaacggttcatcaatcgcctcgcgaatggaatccgctttgtaataactgttcggaatttcctcgcgacgaacgcggccgatcatcgattcgatacgtttcagatcacgtttcaccgacggatcatacgcagcaccattcgcgtcgatacgcaccgaaccggacgtcgcagacaatgcgccatccaacagctgcagcaacgtggtcttaccggaaccattcaacccgatcacagccacacgtttgctttccggagtgatcgtcaacgatgtcggctccagaccgacattgccatcctcatacgtgtggcctgcctgatctagcgtgaacgtgacgtcatgcgtcgcttcgggacgtttggatgaaaacagcgaatcgaaaaaacccatggcaaccattgtacgggcgtgccgaacccattgcatacgaaacggggccggaaatccaaactcccacaaggagtttagattcccggccccgtcaagcctgcggacaggatgtcaggcgaaatagaatcccgagaaatcgtacttgtacacgcggtagatgtacgcactgttcaacgtcatcttgaactgcgccagcagatcaccatccttgttgtactggccgaacagacccttcatgcccgagtcgatgaggatctggccattatccaattcctgcgcggaactgacatacggcgaatatggcacgacgaacgatgacacttccgtatacgtgccggcattctcgttgaccagatacttgcgataccgcgaatttgccgtatcggacgacaattcggtcgaaatgccgtcgatcaccgaccagtcaaaatcaggacgcgtcaacgaagtgccgaaattgttatcgaacatatacatgtaatactggccgtcaggcagcgaatcatcggcgacatacgtgatggaatgctggccgccggtatccgaaaaatcaccggacttcgtcaggaaactgctggcctcatcggtgccggcccacacggatggctcgccgatcatataatcaagcgtcggatccgattccaaatcatccaccttgatgatggtggacgtctcacgggcggagaacaatgcggaaccgtcatccaacaattgaatggtattgcagtgcagccaatcccaacgattcttggcattcgaatccgactcgtcggttcccgcatgcgtggtggaggccttatagtcggcgaacagctcaccgaaatccaccaagcgggttacacttccggtggaagtgctgagcttgatgacctgatcctgcacggcgttgtcgtcacggccgagctcggtggccagcagcacgatgtcgccgttggaatccatcgcataatcatgatgcagaatgtagtcggatcccagatcgtagatcttctccagcttgccgagacggttcatcgccaccatatgatgcgtggacgcggagaaccacatgagaccgtcatcatcgaacagcagacggtgcgaacgatagtagagcaccggaatctcaccgcgcagcacgccgttcgtatcgtagtagaacatgaaatcctgttcgtcggaatcattgccgagaatcgcatacaggccgccgcccagatcctcacctgaatcggctgcgacggtcttctccaactgcacctcctcattgcccagcagggatgcgcccctgtgttcgatggcatgcgtgcgggacttgccgtcggcatcggtcagcgtgatggcgacggtgttcttctcgccgggaatgaggccgagcagctggaattcgtgggttttgctgtattgcgattcctgataggcgtcacgggtgaaatccgtatagccgtctgcatgcacggtataggagacggcaaccgcgtcgtcggtagtgaaatacacatacagtgacgtggtgttggtgccgtacggatcttcggtgacaaacatgtcatcctctgttgcggaggacctgcttttttcctgctcgagcttgtcgtcggccatatcctgatagtcggctgtgtacacgttctcgatacgtgcgttcagtcgttcaattctgttttgtttgatggccgcatcgacattgtcgtagctggcgaggcagacgcccaatgcgacggctgatgcgacgacggccgcggtccagcgtcttacacgaggatggttcgacaaaagtggaagcgatttcatgactgatgtctccaacaagggttcatctcacagcgaacagttacatcgccactgttatccgcaaaactcggaacaagccgaatgatttattggaaaaattgtgataaaaccctgaaataaccctgaaaacgccgtaacttacatcagggtgaaccacgactgcacgtcatgaaacaaaccggaattattacgaatcaactcgtcgtcgcggccgtacaggaacaacgacaacaccgtcaacgacaacgtgaacaacagcagcgccaacaccagcacgcgcaacagccagcgaagccgcggacgttcgcaatccagcgcaataagcatcaaaggaagcgaagccaacgcaaacagccagccgaaatcggcgatataacgccatccaaggccacccagccgcgcgtcaagagccacgatcagcaaacccaacagcaggaacatcaccaatgtgggccacatgccggcatggccacgaacgcgcatgcgcttacgtaggaacgggcaagccaacgcagccaaagcaagcggaaccatgacgaacaggcctccgggcatcgcctccgcaaacccccaatccttcaaaggcgcgggatcgacggcaaggaacgggaacgtatccgtccaacgcaacggcagaaacaggtaatatgcgaccgtccaaacaaaattcgaccacgactgatggtaactcgtcatatccgtaaccgtcagctgatacgacgaaccgaaatcgaacggcgaggagaaacgcaccatgttataggcgaacaagggcaccaccacaaccaatgcgggcaccagcacggccaaaggcgtgcgcaacgcatgcaacacggtgcgcgcacgcccacgcacgccggaaccagacgcgatggcacgcaactgccccacaatcgcacgaatctgcggccagaacaacgggaacgcggcaaacgccaccaccacaaacgacggacggcaacccacattcgcggcaatacacaccgaaccggcggccaaacgaggcagcgacaacgattcgaccgtattcgcaccaccatcgccaccggcatcggccgcgttcgggtgcgtcgcacccatccatagccataagcccaacgtgctcaacaacaaggacgccgcaatcggcaccgaataaaaattcgtccgataccacaagtacggggcgttcgacgccaaaaccacaaacacgcacaacatactgaccgcagccagcgaaacatgcggacgcacacgctcgatcacgcgaatcgtcaacaggcacgcgaacaccaaaaaaacaaacatcagcagcggcaccgcagcgccagacggcatcatcagaccaccatcaacccacaacgacgttatcgcacgatacggcacaaacaacagcaacgccggcaccacgccaaaatacgaataccaacgaccatcaaaaaacgcataatcccaatacaccggactcacaccatcggcaagcaattgctgacgagtcgtcacatcatacggattatccgcatcgcgcaacgcgtcgggcacatccaaatcaagccacgcatgaccatcaagcaacgcccgagccacatgatcatactgatcgtaatcatacgtatacatgccatccgtatgaaaactcaacggcaccgcagacaccaactgccacgccaccgccgcaacagtcaccaacccaggaaccgtcaacaacacgcccaacgtcacacgctgacgcacactcgacgtattcaacggcaccttccacaggcgcgagcccggacgccacaacgccaccaacaccatcaccaacaccaacaacgtcacacgcaacggactcaccgaaaacggcacacgcacattcgcgcgaaccgcatcaaacggaatcaatgaccccttcggctccaccacctgcacgcgcaccgtacgaccggccgcagccctcacatacaacgaacgagacgaatccaacgacaccgaacacaacgaaccagccacacgatccgcatccgcacgaacacgcaccgtacgcaacacgcgcgaaccggcaggcacaccacccataacctcatcggacaccggcacgatccgcacatactcagacgaaccatccgcagccacctgcaaatacgcctgcgtcggatcagtaacctccaacaacccgtcatcacgacgctcaagccccggccccaacgtgttatacgcagccgccgaatcacccgacgccgccaacgagcggaaaaacggcacattacacaacacgcactcaaccaacaccaccacaacaaaagcggctacaatagctgcgcacacacgatgacgcgcctgaaaacgctgtttcgaaaaagtcacgaactttattctaaaggctgcatgtcgcattgaattgaaagaatggcccacatgtcacacctcacaccagcatcgccatcagcacaccatccacaccaaggacggaccatgctcaaccacgccatgcaaggggtacgacaactcatcaaccacaacaaacacccccacaacaccgccgacgccaaccccttcggcaaagccctcgacacgccagacgacatcgtcgatgaactcacccgcaacgccatcaaactcaacccactcatcaaacgacacatcatcaaaggcttcgaaggcataccaagcacactccaactcggctgggcgcaactgccacaaacccaaggcaaagccttctccatcggactattcaccgacaacaaccacttcgcgcaaatcgcgctcgccgacagcaaagcacgcgtcttcgcgggcaccaatcccgaaatggacgtgcaggatctggaaccacgattcatattcgtcaaagaagaaaccctcaccctgccagacggtccacgattcggacacgcgacaaacggcgcgccgaagatggtgcgcgcgtcgcaaggcggtgtcgtgggacgcatgcccgatggccgcatgatgtggctcgcatcctggctgaaagtcggcaaccgctacacgctcgaacagatgcgtgccaacctgccggaaaccatgcgattcgatctggaatacagggatgccatcaccatcgcattcttcgcagcctacatgctgccgcaaatgaacgggctactcgtgggattcggcacgggcaacatcttccgcaggctcaaccgagaggcgccgatgggcgcgatccgccgatccatcagagacacgatgagcgcacgctcccatggcatgcgcgcatccggacttgaggattatttcgccgacctcatgcgcgaggcaggcgcccttgacaaagaccaggggctcgaagcagtacacggcgcggaaccattgcacctatacacgtccagctactcgggctgctatttcttcgcttgggattccacactgccgttctcggcatcgctgcgcgcgctgaacatcgaaggcaacctcaaccgtttcgccgcagtcagttcatggctggaacgcaacgcccgtatcggcaagctgcccacagaagacaccgtaacccgcgcggaagccgcgcaaatcgacatggcgctactggaaaatccggcgctgatcgcattgaaaccggacgacgaattcggcgcgatcctcgactcacagcaggatgacggcgtccaagccgtcatgcgcctggtggacatcgccgcggaaaccagacgttccatcgccgaaaacacgaaggacggcgaggatggtaccgccttcggagccgaaggcggttcggaatgggtataccgccagacaatgtcgagactattgcgcagcatgcgcctgccataccgcttcgacgtggacttccgatgcagtctccgagacggcaatatggccatcggtttcacctctgccggcgtttccatgatgccatccaccaaatatgacgtgtcccgccacgcatgggtggatatgacggacgccgaacgcgcccgcatgagcgcggactacaatctgcgtgttggactgatgatggccgcgttgagttttggcgccgatccgggcatacagcgtgtgtcgatgcatatcgattcgattggtttggaagaggccgtggccgagcaggattccgccatcagcgagctgatgagcgaggctttggcggctttcgaacgcattcgtactggagatatgggtgtttctgggtccaaggccgatccgaaggacggcgatttccacggagacccgtcccgtccggtggcgccgagatccgccgacatgggcgttgatggcgtcaactccgaggatacggatgatgcgttgaacagccaattcgaggatctgatgcgggatatcgacttcgacgaagtgacgttcgcggttcccgacgagactgcgaacgattcctctagcgtggacgacggttccgcacagggcgtgcatgatggcgctcttgacgcgggactgatcggcttcggcgatttcgatgggaatggtgatgatccattaagccagcttcgcaagaatccgaccgtacgcaatctggtgacggtcaccttcaccagaagcgaattcatggagcgtctgggcgagtgcggattgtctgatccaacaggcacataccgtatgttcgatgcggaaatggatgtggacggcctcggcgcattgaagccagtggacgccacgttcgatttgcgcgatagtcgtttctccccatccggaagtcaggaggagcctgagctttccgacgccatattcgaccatgacacggcacagctgtttggctgccgtgacatgtcggggttgtccattcagcgcgtcgacctgctgcagcgcgcggttggcgaattccacagaatcgcgcaggactcccatctggaatcggtggccaaggcaaagcaggccatggacgtcatcaacaccattgccgacccggaattgacgtcgttggctccgcaggtgacgagtgcgctcatcgatggcaaagacactccggacttctccttccgcttggccgacgagcttgacgcggaacgcatcaaggcgagagacctgctgttctcaggacaggtcgaccaaagcgtggaactggccgaagcggcgttggagcgaatggaccgactgttcgcttcgaatccgggcgtgccgcggtatttcaactcgtatgcggaacgcgtcatctacaatcgcatgttcgccacggaaggcgaacggaccgtgctgattccggacaatctgttctacgcgcatatggaactcgccgacgtgcttgcacaggtcaaaggcgtgaaggccgcgttgccgcatctcaatgcgatggtgcgatatgcgccggcctacccgctttcccatctcaagctggcggttcaactggcgcgcgccgaggattgggatccggccagagcggcttgcctcaacgcgttgcacgtcgcacttgaccgtgaggatgcgtcgttcgcctattacagactcgcctatgcggaatggatgtgcgaccacttcgacatcgcggccgccgcgtacatcatgagcgaggagattgcccccgggcgaatcgccatgctggagagcgagctgcaggaattgatcggacgcgcgcaatcgcaatgcattccggtgcccaccgacgttccggaagccatgcacgtgcttacccaagcgggactgccggtatggcccaatacccaggtcgcatccttggtacgcaaggccgcgcgggtctgtgtggatgaaggcatgttcgtgccggcacgtacgctttcggttgccgcttcaaggatggatgacgaggagcgcgacggtgccgacgtggtgcagatgcagttcctgaggtcgttgaacaactgaacggcgtgctttccgcagtgcgccaaacagacgttggcgatgcagcaaatcgaacatttgtgcgataatgtgtgcatggcggctctgaccggcaaaacattgaagacagtgacaaggcaatgacaatgacaaggcatgacgattccgaacaactcgcatgggattttgacgcttctgaaatgggcggcgatacgggctccgcgtcaaccgctgtggttcccgacgggggagtcagctcatatgcgccgggcagtgaacgctggatcgccgcattgcagccaaccgatgccgacgccatgcggttgacccgacttgatgtctcgtccatcagtgctgaagccgcggctcgattgtgggcgcgtgtggcggcgtgggtggaatccgaccagatcgcatactacatcgatgacgcgccggtctcgtccgacgccgcctatgatgcgagaatacgttgtctacaggcgttggaagcccagttcccatccctcgattccgcgcaatcgccgacgcatcgtgtcggaggcaccttctccaatgatttcgcatcggtacgccacccgtctcgcatgatgagtcttgacgatgtcttttcgcttgaggaactgcatgaatggtacgacggtgttattcggggacttgattggcctgagacgaagcctttgccgatgacatgcgaagtgaaaatcgacggtcttgcgcttaacctcatctaccgtaacggcgtgctcgagcaaggtctgaccagaggtgacggcgtgatcggcgaggatatcacgctcaatgtgcgcaccatctccaccattccgcagaatcttgcgggaccggaagaagacattcccgaattcgtggagatccgcggtgaggtcttcatgcgatgggacgatttcaacacgctcaacaaagaaaacgaggatgctgggcgcgcgcctttcgccaatccacgtaacgcggctgccggaagcctgcggcagaaggatccgcgcatcaccgccaccagaaggctgagcttctatgcgcatggcattggaacgctccagtggggcgccaaacgtggtgccgaccatgatgcggtcaacaaccaatccgaagcgtatgggttgtataagaagtggggcatacccgtttcgccacataaccgtgaggtcaccacattcagccagattctcgacatgatcgattactacggcgagcatcgtggagacatcgaacacgcgctcgacggcattgtcgtaaaagtggatgatttgggattgcaacgatcgttgggcgcgacctcgcgtgctccgcgttggtccatcgcctacaagtacccgccggaggaagtcaatacggaactgcttgacatcaccgtgcaggtggggcgcaccggccgtgtgaccccagtggccatattgaagcccgtatatgttgcgggttcgacggtgtcgagaaccaccttgcacaatccattcgaagtggaacgcaagggtgtgctcatcggagacaccgttgtggtgcgtaaggcgggcgatgtgattcccgaactcgtaggtcctgtgctggaacgcagggaaggacacgaaggccagctgcgccgtttcgtgatgccttcgcactgcccgagctgcggggcggaactcgctccggccaaagagggggacaaggacatccgctgcccgaacgtggaatcctgcccggcacagttgaccgaacgcatcatcaatctggcatccaggaaagcgttcgatatcgagcatttaggcgaccaatccgccatcgctttgacgaatccggaagaggaccgtcccgattcgacggccacctacgcgccgaacatcacggaaatcgtggtggagccgggcgcggagcccgaaccgtacgagcctgtggaaggtctggagctgccggcccgccaaacaccggtgctgtccagcgaagccggtctgttttcgttgacgtccgccgatctgcaggatgttcgcgtatggcgtgaagcgccgatcatcgaaatccacgaaaccatcggcaagaacggcaaaccgaaaaagatacgcaaacgcattggcggatcgggactgtggcatcaggttccggcgttctggacagctcctacagttgcaagaaaacgtaaggactccgtcgacgaatccgcggaatatcccgaatatgacgtgcctgaagatgccgtggtcgttcgcgaggaaaccaaggtgtcgcgttccggaacatccagtgtgcagccgatatatatacgccccgcggaaaacacgaggaaaatgcttgacgaaatggacaaggcgcgccatgccgacctatggcgtgtgcttgtggccctgtccattcggcggctcggtcctcccacggcgcgtaccatcgccaacacattcggttcgctcgacgccatcgaacaagccagcgtggatgaactgtcacagatagacggcatcggtccggaaattgccgaatccgtggtcacctggtttgcttcggccaagaatccaggcgattggcgtggcatggtgctggaagcatggaaggcagccggagtgggagtcggacaggcacagaccagtgctctgccgcagacactggaaggcaagacagtggtcgtcactggttcgttggttgatttctcgcgggattccgccaaagaggcgattatctcccgcggtggaaaggccgcaggatcggtcagcaagaaaaccgattgggtggtcgtcggcgaaaacgctggtgccaaagccgccaaagccgaggaattgggaatcgccatgctggacgaggaccagttcaaactgctgctggaaaacggaacggtgtgacgcgtgccatatcaagccggcaacgtaatcacaagaaggctctggcatgccgcgcttccagacgctagtctggtacgcggctaaaggaggaaccatgaccgacgagcgcaccatcgaagcgcgcatctatgagcgactcagcaaagtaatcgacccggaactgggccgatccgtgaccgatttgggcatgatcgcagccatagacgcgataccggtggaaggtaagacgaacacctacgaggttcgtgtggaggtcgaactgacggtggaaggctgtccactgtcgcagaccatcaccaaccagatcaacggagcggtgtcgtcatatccggaagcgacattgctgccgcgcatcgaagtcgggtccatgagtcaagacaagctcacccaacttgtggcaggcctcaaggccgaacgcaaacagaatccgttcaacaagccgggcatcaaaacccgtattttcgccatagcatccggcaaaggaggcgtcggcaagtcttccgtcactgcgaatcttgctgccacatttgccgcattggggtacgacacggccgccatcgacgccgacatttatggtttctcactgccgcgactgttcggcgtgcatgcgcaacccaccaatctgaacggcatgctcatgccagttaccgcatggggtgtgaaattgatttccatcggcatgtttgccggcgccgatcgtgcgatcctttggcgaggcccgcgattgcagcgttctcttgaacaattcctttcagacgtatggtggggcgagcctgacgtgctgctgctcgacttggcaccaggtaccggcgacatggcgatttccgtggcgcaggctctgccgaacgcggaactggtggtggtcaccacgccgcagccatccgcctcggacattgcggtccgctccggcctggtggcattgcaggtaccgatgaaggtacgcggcgttgtggagaacatgagctattacgagcatcagggcgaacgcctgcggattttcggcgaaggtgggggtgcgcgtgtgtcggagcagttgaccgaaagccttggctatgatgttcctttgctcgcacagctaccgttggagccggaattgcgtgagaccggtgaggccggccgccccgccgtgttgaacgaggatggcgcgttgcgcgccgatggcattggcgagacgttcaggaatctggccgaatcgttgatgcacagacctatgtgatgtgcggggcacgtatccaggccgtcatgacccgcggtatggacggtggcctaatgcggctgcggattcacagctcatccggggaacgtctgggtggaaaacgaagcgaaatgaaaatgacccttgtgaaaatcttgtgccttgtgtagtatcaagcgcagacacgggggccgtatggctgagacattcatgaccgtaaatgaatcttccgtggtgaagaagcataacaataaatggcgagttgttgacatcgtcgtggccgctatcatcgcggttgcggctggcgtgattttctggggctgggatgtcatctgcgccgctccgattacgcttttcgaagcggtgacgccgggcttcgaaggcttgttgaacggcatctggctgtttgcgggtccgctggccgccatcatcgtgcgaaagcctggcgctgcgttgttcgctgaaacctttgccgccgctctggagcttgccatgggcaatccgtggggcatcggcggttctttgattatcggtatctgccaaggcctcactgccgaaatcggttttgcgatttttgcatacaaacgttgggatttgctgtcgaccaccatcgctggaaccctcgccggcttgggatgcttcctgtataactggaccgtgaatcctgcttgggcaggtttgcgtattgtcgtcagctgcgtcacttccgttatttccggcgctctggtggctggagtcctgatgtatctgctgcagcaggccatcgctaaaacaggcgtgcttgaccgtttcgaatccggccgtgcgaaggccttggtatgacgattcgttaatgaagtcccgtatcgcattcacagtggtggatacgggacttctttgatgcgtgttcgttctgcaaacgcggaatgcaagaggaatgaaagaacgattcatgggtactgatgcagaaaaatcgttttccgcagccggggtggtcgcacgcgattggggatggcgacacgcctcacgtaaggatttcgcgttaaggcatgtggatttcaccatacagccaggggagcgcgtgttgttgttgggcgcttccggcgctggaaaatcgacgttgatgtccggtcttgccggcgtgctcggcggcgatgacgaaggcgagcttgaaggagagctgctgattgacggagtggacgcccgtcaggcacgcggacgttccggattggtgttgcaggatcctgacgcgcagacgattctggaacgtgtgggcgatgacaccgctttcggttgtgaaaatctgaatctgccgaaagatgagatttggagcagggtccgttcctcgctcgacattgttggactcggctacatgaaacttgaccgctccacacgcagactgtccggcggccagcgccagcgtctggccttggccggcgtgctcgccatgcatcccggactgctgctgctcgacgaaccgacggccaacctcgatccggagggcgtcaaggaagtgcatgatgcggtacgccatgtgctggaacagacccgtgaaaccttggtggtggtggaacaccatattgacgtatggcttgatctggtggatcgggttatcgtactcggcaagccggaggccgactcgcatgtcagcggcgtcatcgcagacggcactccggaagaagtgttcggcagcatggcatcggtgctcgcaaagggcggcgcatgggttccaggacgcaccatcgaaagtcatacccccgaatccagccaatcgtcgggagatgttgttctgcgaacggaggatctcagcttcgggcgtgacttcgcgcttggcgagcatgtgaacctcgtgttccatgctggcgagatcaccgcactgaccggcaaaaacggcgtgggaaaatccacgctcgcgttgactttggccggcttgctcaagccgatttccggccgtgtgagcatggatgagaccatggttcccgcacgtagggagaacgacgtcttcacttggaaaagtcgggatctgctcggacggatcggcatggtgttccaggagccggaacaccagttcgtcgcatccagcgtgcgtgacgaagcggcggtcggccccaaatccatgggcaagagcgaagaagagtcttacgctatagccgacaacatgcttgagcgtatgaatcttgctagattcgctcaagctaatccgttcacattatcgggcggcgaaaaaagaaggctttccgttgcctccatgctggccgccgcgccgaaagtcttggtgatggacgagccgacgttcggccaagacttcaccacatggacggaaatggtgaaactgatcgccggtgcgcgtgacgccggctgttccgtcatcatggtcacccatgacgaaccattgatcgaaacgttgggagcgcgtcgcgttctcgtaagcgagggggagtgagatggaacagttggaaaccatcagcgtggtaccgcacaaggaacgtcatgacgatgccaagccggcatcgccgtcatggttcgtggcaaaaatcaatccggtcagccgtttcatcggcgcgctgatactatgtattcccatgttcgtgacgctggacgtggtctccgcgtccgtggcactcgcattggaggtgttgttgctctggattggcggcgtcgctccgtggacggtgcttcgtaaaacctggccggtgtggattgccgcttcgggaagtttcatttccgtgtcgttgtatggcaagacctccggggccgtgctggtcaatctcggtgatgtcgttgtgatttcgcagggatcgttgtacttggcgttggccacgttcctgcgtgtggcggccattgccgttcccggcgtgattcttgcgcttggtcttgatccgactgatttggccgatggtctggtgcagattctgcatttgccgtcgcgtttcgtgtatggcggtttggctggcatgcgcatgtttactttgctgcaggatgattggcgtgcgcttgggcagtcccgtcgttctcgtggattgggcgacggcagcgccgtcaaacgtgtgttctcgcaggcgttcagtctgctggtcgtgtcgattcgacgcggcacgaaactcgccaccgccatggaagctcgtggtttcggcgcggacgctccgcgaagccaggctaggaaatcgagcttacatgccgtcgattggctgttttacgtgatttgcgtggccgtgccggtgattgcgttgtcttgcgcttatttcaccggttactggcattgggcttttaccggcactggcaattaatcggagcagggctgcgcagtacgaggtttgttgaatgcgcggcggatttgcgaagggcgtttcattcgttgtatggaatggaacgcccttcgcatttgcccgttgtttttctcaaaaagatatgtgatatccgctacttggcaagcttgtcaagcagcagcgcttcggtgatcacattgtttttcaggctgggaagactgatggattcgttcgggctgtgcgcgttggccttcggatcctcgggaccggtgaccagtacctgcgcgtccgggaaaatacgctgcaattccggaatgaacggaatcgagccaccttcgcccttattgaccggagccacgccaaacgcctcttccatggcgtccatggcgtctttggtagcctcggcatttggatccatggcccaacccatgccattatcaagcttgtcgacccacacttcggcgccaaacggagcatgctcgaccatgaacctggcaagtgcttcctgagcctcttccggacgctggtttggagcggtgcgcaggctgagacggaacgtcgtttcaggggagatcacgttgaacgatccctccactggatgagcatcgaagccgatgacggtcacgctcggcttggtccacagacgtgcggccaaagaaccggtgccggccagacggtaggaatcgacgatgccggcgtccgtacgcacggttgcctcatccatatctcgctgcagtccgccgattggatcttctgaggcgacgcccggtaccaccaaatcgccatgctcgtcatacatggaagcgatcagcatggaggcaagcgtgttcgcatcgaggatcggtccgccgtactgaccggagtgcaccggatgatgcagcgccttgacgtgcacgtcaatatcggtattgcctcgcagcgacgtggtgagcgaggggatttcagcggaccaattgcccgagtcggcgacgatgatcacatcggaatcgaattcgtccttatgctcctcgatgaagggaatgaagcttggcgatcccatttcctcttcgccttcgatgaagactttgatattgaccttcaaatcgtcgccgagcgcctgcaatgcgccggaatgaatggcgattccgccgccatcatcggccgcgccgcgtccgtacaggcgtgtgtcgattaccgtgccgacgaatgggtcggtgttccatacgctggcatcgggcaccggctgcacgtcgtgatgcgcgtacaacagcacggttggagcgtcgatatcgacgattttcgaaccgatgacctcccaagcgcccggcgtgccatcgggattgtgcgactgcaccacatgcgcatcgacacctaccttgttcagctcttcggccacgaattgcgcggactgtttcatatgatccgcggtaatgccttttgcggaaatggactgcaacgcgattttcttgttcagcacgtcgacaatgcggtcaaaatccgcttcgacgcgcgcgcgaatctcatcggcatgtaaaactgccatactgctcctccttatatatgcggcatatacgcatcttggaaacgtgccgccgcatgctatcgaatgaccattgtatccgtcgaaccaatcacgtccaatcgttgacatgaatgaggcaaggcgtcgatacgtcaatttacgctctataggcatgagtgtgtttaataagaaggaagatgcggaccaggagcctgtcgggaagaaggctgcggagcctactgccggcaaggggcgtccgacgccgaagcgcaaggatgcccaggcgcagaatctccgtccgctggttcccaaggatcgtgaagcgagccgcaaggccgccaaggcgcgtatgcgcgagcgtgaaaacgccgaatacgatgccatgcagaagggcgacatcaaccatatgccgaagtccgagcgtctgccgtggcgtatatacatccgcgactacgtcgatgcccgcttcaacttgggtgagttcttcattccggtcgccttcgtcattttgatcggttcgattttcgtgacctacaagtggccggcgttggcattgccgttgatgctgcttatgtacatctatctgtttgcggtgatcatcgacatcgtgatcatgtggcgcaagctcaagaagaagctcattgaaaagttcggcgagcagtccgtggccaagggcatgcgttccggttcctacgcgtggagccgtgccatccagatgcgtcgctggcgtctgccgaagccgcgctatcagaagcgtggacactggcccgagtgatccattctgcgagaatcgcagttgctttttcaagccgtcggcgaaaaccgacggcttttccattaccatgtaaccagttgtaacgcacgaatcaacgagggcaggcatgactgaacagcatttcgacattgtcatcatcggagcgggaccaggaggatattccacggcattgcgtgccgcgcagctcggcaaaacggtggcgctcatcgaacgcgacaaaacgttgggaggcacctgcctcaatcgtggttgcattccgtcgaaggcgttgctgacggccgcacacagtgcgcagaacatacgccaggcggaacgtatgggcatcagtgccaccttacagagcattgatttcggcaaattacgtgacttccgtacgtccacggtggagacgatgacgaaggggttggcgggattgctgtcgcaccgcggcgtcacggtgttccgcggcgaggctgagttgagggacgttcatgatgtgcatgtcgcgccggccgggggagaagcgcaggtcatgcgttccttcaaggcgggagtggaggaacccgtcgggtcggagcttaccatcaaaggcgaagatattgtgctggcgaccggatcgcgaccgttaccattgccgggcaacccgttttcaggtgcgttgatcgattcgacgcaggctttggaattggatacgttcccgtccagtgcggtgattgtcggagcgggtgcggtggcgttggaattcgcttcgttgtggaatgccgcgggatgcgaagtgacgttgctgatccgcaaggaccgcgtgctgtcgtcttgggagaagcgggcttcgatgacgttgacccgcgagctcaaacgtcgcggcatcagcgtggtgacgcgtgcgtcggtggattacgtggataccggtgcgaatttgggcgccaccgtgcattacaggcaaggcggcggcgaggaggagcgcaccgcatatggtgaagtggtgcttgctgctatcggacgtatgccgaacaccgatgccggctggttcgcatccaacggcatcgaattggaggaacgcggttatgtttcgaccgacgcgtatgggcgtacgaatgtggagggcgtatgggccttgggcgacatcactccggggcatgctttagctcatcgcgcgtttgaacagggcatcaccatcgccgaaaccatcgcaggacttgaccccaagccggtatccgacgaaaccgtgccgcaagtcgtgttctctttccctgaagcggcaagcgtcggtcttgcactcgacgatgcgaaatcgtgtgaaaccatcatcaatccgcaggaaaccgcatatcccatgttgtccaactcgcgtatgctcatgagtggggaaggcggatccatgaccatcgtcagcggtgcgatggcaggcgctccggatgttcccctcgtgcttggcgtgcatatcgtcagtccgctcgccagcgatctgatcgcggaagccgaacaattggtcggcaaccgggtgccgctcgccgccgcggcgaggctcattcacccgcatcccaccttcagtgaatcgttcggcgaggcgctgcttaaggcggatggcaggcctctacatacccgataatccccgtcaatcaaggaaaaacggcggaaaccgtgcgatatggcatggttcctgataaactaccgttccagtgtgagtaaccgcataaccaagtgaggaagtcgatggcagacaaagaagagccaaagaagaagcaaagcaccatcaagcagatcattcagatcttcaagtacacccacgccgaagataaggctcttccgtggttgtgcggcggcgtgttcgtggcgccgatcgttgtgttcgtggtgcttggcatcgtgttcaagtggtcggtgatcggatggatcacgtccatgatcctcgccatcatgcttggcctgctgttcgccaccatgatgctcaccaaccgtgccgacaaagtcggatacgccaagcttgaagggcgtcagggtgctgccatcagcgtgctcggcaacattaacaaggctggcttcaactttccgcaggagccggtgtgggttgatccgaagaccaaagacgccatttggcgcggcaccggttacaacggcatttatctgctcggcgagggcgattacaatcgcgtcaagcgtgccatggaccgtcaggagcagaatatcaagggtgtgaccgccggttccgatattcccgtctaccgtatctacgtcggccagggcaagaatcagacgagcctgaagaatctgcgcaagaccgtgctcaagtgcaagagctaccagccgaccagccacaagaacaagctgatggcagccatccatccgaagagccgcttcatgcttaccaagaccgagctgaacatcctcaacgagcgtctgcgcactctgcagatgaagaacggcatgggcattccgaagggcgtcgacccgatgcacccgcagcgcatcagccgtcgtgctatgcgtggccgctgattttcctggaatcgtaaagccggcttacatatgggaacctcgatgaacacgttatcgaggttcctttttcatatctccgttaccttccgctggcctgcgcgcatgcggtaaggtttttgagaaaagaaatggacgtcgcaagcgacatgatgacacgaatgtccacaaattgaacggttttgcagaggcaaatacgagcgttcgtaacaattgaaccccagtttttcgcgaaatcatccttcgaatatgtcattacgaaacattctcgtaacccaattggcgagtgagcgaaacgcgcgttcctagactaagagcctgtaagttacttattcgaaaggagcggtcccgtgactgcacttgaaaccaaggctgatgctgaggcccttatcaacaaggaaggcatcgagtatgtctccgttcgcttcactgatctgatcggtgttcagcagcacttcaccgtgccggcaagcgaattcctgaaggacgccttcaccgacggcatgccgttcgatggctcctccgtggaaggcttccaggccatcaatgaatccgatatgaagctggtgccggacgtttccaccgcattcgtcgatccgttccgcaagcacaagaccctcgacgtggccttctccatcgtcgacccgctgaccgacgagccgtactcccgcgatccgcgtcaggtcgcaggcaaggccgaggcctacctgaagtccaccggcatcgccgacaccgcttccttcgctccggaagccgagttcttcatcttcgacaaggtgcgcttcgagaacagcatgcagcgctccttctacgaggtcgactccatcgaagctccgtggaactccggcatcgacaccgaagacgacggcaccccgaacatcgcattcaagaaccgcgtcaagcgcggctacttcccggttccgccgatcgaccacacccaggatctgcgtgacgacatggtcgccaacctgcagaaggtcggtctgatcctcgagcgttcccatcacgaggtcgccggcgctggccagcaggagatcaactaccgcttcaactctctgcagcacgcaggcgatgacctgatgaagtacaagtacgtcgttcacgagaccgccgctctggcaggcaaggccgcaaccttcatgccgaagccgatcgcaggcgacaacggcaccggcatgcattgccaccagtccctgtggaaggacggcaagccgctgttctacgatgagaagaactacggtggtctgtccgaccttgcccgctggtacatcggcggcctgatcaagcactcctcctccgtgctggccttcaccaacccgtccctgaactcttaccaccgtctggtcccgggcttcgaagctccggtcaacctggtgtactccgcacgcaaccgctccgccgccatccgtatcccgctggccggcacctccccggctgcaaagcgcatcgagttccgtgctccggatccgtcctgcaacccgttcctcgccttctccgcacagctgatggcaggtctggacggcatcctgaaccacatcgagcctccggagccggtcgacaaggatctgtacgagctgccgccggaagagcacgcaggcatcaagcaggttccgagctccctggcagaggccatggatgcccttgaggaagatcatgacttcctcaccgcaggcgacgtcttcaccgacgacctgatcgaaacctggatcggcatcaagcgtggcgaaatcgaccaggcccgcctggctccgaccccgctggagtacgagctgtacttccacatctgaggcctatacccagtttcccttgaaatcaagctgttttggactccaagggtaatcagaaggtagccagattggttataaggagagcctctccaaattggggaggctctccttattcctacagaatttcttccatccgggacggcaaagaccttacggaccggtcttctgactcctcgcctccacgaacacatcagacgcatccaataaataaccgttgatatgagccggacgtgcttccacaggttcaccgttaatgtcgtcgtattcatacaacgcaggagcgtttgtgcctctgtcgaatccgacaatgacgacatgcacgttcgcattgtccgtagtctgagcgtcccagcagaacgtacggtgagcgaaccggatacgccaccctcgttcgaccacatgcttgaatagcggggcgacttgtgctggccttgtgtgatgctattcgtggatacgaacgcgaattgcgcggagggattcccgtcaaggaaatcaatagctttaaaataccatccagccacataatccagcgagcctccggccttgccgcacaccagttccatatcatccttgatctgctgcgtgtgctgctgatggccgatgaacggcgggttgcccatcacatacgagcattcatcaccgggcagcagaagactgacgaggtcataaccatagtcactcgcgaacgctctcgttggcgtcgcggcatcttcgaggatgccttcaagcgcctcacgagtccccaacgtccttctctgcatgaatgaacctccttgtatggctggaagttatcgtcacagatgatttcgtaaccacttacctctgttcaagcgccgcgttgacctgtgccttgagtgcaggcaaggtctcggcctcgaaccaaggattcctgctcatccatagctggttgcgcggcgacggatgcaccaaagggaagaatccccggccgatataggcatcataatcgcgcaccacggttgtaaggctgtccgaattcttgagatgcaggtacctgcggacggcatatgcgcccacaagcacagtgagccgaacattgggcatgagcgccaagagtgcaggatgccactgctcggcgaatcccttgcgcggcggtagatcgcccgacctgccatgtcccggaaaataaaagtccatggggagaagcgccacccgctcaggatcataaaacgtctcgcgagaaacacccagccaatcgcgcagacgctctcctgacttgtcgttccaggggatgcgcgtctcttccgccaccgcgcctggtgcctgcccgatgaccacgatgcgagcgccagccccgacggagtagagcggatcgatgccgcgcttggtgtagtctgcattcgccccatcagcctttatggcattaaaaatcgcaaggaaatccttgtccatgtcgaaaccatctccttggtgacatgcgccgttcatgcatattgattactcgtttcccacaaatataccttgcctttgctctgcagggtatatcgtaggaaatcatcctcatgtagtaattcccgcatagccgcttatcgtctttcaagatttttattgccaatgtgcatcacaaagcactacgcctaactggattaaataaatactcaggtttcaaccgtcttgcaagcgtagcgttaccgcgaaccactctctataagcacccatggcgcccatcgtagataacaagccgaaagaaggagaacgcggtccggacgacctattttaagcctctaaaggagcaatcctttcggggcttttctattgtccgaaaggaggcggcacgcatgccgagaaaaccaagacgcccctgccgccaccccggctgcccgaacctttgcgaggacggcgagcaatactgtgagaagcatcgcaaggaagcggagcggcagtacaagcatttcacgcgcggctactccgcgggcaagcgctatggcaggcagtggaagaagatccgcgaccgatagaagaacattggcatagtcctcaaagtgaaatccccttatgaggtcagacacatctggcagcgggacaccataggacgccgccacatacgttagatattcccggaatgtgaaatactgaaatgactgatcttccgctgcccctagatccagtgcaaatcagaaagtaaggggtgatctgcggtgtaccagacgcttaaatggttcaaggaaagaagtgccttgctgtccatgctgcattacctccgattgtttttgtctttctcccagagcgaataggcggagaacaggagcacgtcgccgaggaaaatgtacagcaggacaaacgggatgttcatggtaacgaaactgtaaatcatgcagacaataaaacgcaaatccattcttcgcgtggccgacggatacgggttccatccgatcagtaagttcggcaaacgaagcatcccggagttgaccggatgcgctgcggggcatgtggatgcatgttggttgtgatgggccggttggaggatattccggccgattatgagggtcgtttgggcgtccccgttttcttgaaaaacctgtcgaataaaaacgaccttactgagccgcctatgccttgtgcatggcgataatatgctctatctcggcaagatccgaagcgaaatagatgccatgctgacgttcccgtgtggaaaaaccatcatcgatcatgcgttgcagcaacgccttcatgtcatcgtagaaaccgttgagattgtagaaaatgcaaggctgcgtcaactggtcaaggcaaaccttcgacacaacctcactgatctcctccaacgttcccgtgccgccggggaaggcgatgaacacgtcgccaagctcgatcatgcgagtacgccgttcggtgatattcggcacgatggtgagctgggtcagattcttgtgcgcgacacccttgtccacgaacatctgcgcctcgatgccggtcacctcgccaccctgctcaagcacggtgtcggcaatcaccgccatcagtccttcgtcggaaccgccatataccaagcggtgcctgttttgggcgatccatgtggccagttccaccacggcttgcttatatacggggttgtcgccttcgtgagctcctaaatacaccgtgacatccatgcttgtacctccaacattcatgggatgatgtcgcactcccaaccgcaatcagacaataatcagataatcagtgtaacgaactgatgctcgcaaaccaatcgaaagtggcaagaaacactcgcaagccgtgcatgtctttcatggatgcgcaaaagccccgtacccgacctgccaaattcatgacatgtcgaatacggggcaaggcgaagggtgacgatcctgctgtgacaaatcgctgccgttgcacaacacttttccctctgtgggattcgcaagcccggaaatcagtaacagcatagtggttttgccagcgctggggcatcgctctgtgcgttgccggactgctgcgaatccggagaattgttatcggtattggaatcctgcgagccggcagagtcgctggaatcatttgtcggaccctgcatatcgcgaccgaactgcgccctctggctggtctgctgcgactgctgctggaatgaatggaaagttttctattttaaaaacgtgacatggatggggcattcgttgtggcaatggtgttagtctaacgcgtatgcctataaaatccgaagtcattgcgaatcccaagtcggagcgcgttcgccgcgtgtccgaactcgccgatcgaaaagggcggaaacggtctggccgtttcatggtggaaggcccgcaatcggtgcgcgagctgctgacatggcatccaggacttgtcgaggacctctacgttgaggtcgagtcggcacagcccgatgcctcgtttgcgacacctgccgtcgcgcagatggcgggcaaggccatgcaatccggcgtgtatgtgcacaaggtcactcatgcggtgatgcaccgtatgagcgtcgacgcgcaaggcgtgcttgccgtcgcggatatgcaggctttccttgattcgtccgccgttccggacgatttcgacgggcatgcgatggtcgccgcgttttggcaggttcgcgatcccggtaacgccggaaccgtgattcgttccgccgatgcggccggctgctccgccgtggtattggtcgacgactgcgtggacatgttcaatccgaaagtggtccgctccaccgcgggatcactgttccaccttccgattctgaccatgggaacggacgacttcttcgcatggtgcgatactcacgagctggcagtgtatgcggccgatgtatacggcacggattcccgacaaccggaatccctgacggatgtaattgccgcgccggaaacgcttgccggggccaaagcggtgttgttcggcaatgaggcgcgtggattgaccaaggaagttttggaacgaaccgataggatcgtgtccataccgctctatggcaaagcggaatccttgaacctcggcaccagttcggcggtaatgttgctgagcttggctatgtcgagtcatgttgaaagaatgtaaagtcggaaaacgttgaaattgcgcgtttttcgcgtaaaacaaacgggaaatgagaaaggtatctcgtggcagaaggtgcggtattcgacgcccaagcggtaaccaatgcggttgccgagggcatcgcgaaaatcgaaaacgcctccagcatggaggaattgaaagccatcaagacgcagtacgccggagcggaatccgcgatgacgcaggccagcaaggccatcggcgcgttgccgaaggaccagaagaaagacgccggcaagattatgggcaagctgcgcgccgacttcggtcgtgcgtatggcaccaaggaacagcaggtcaaggccgaggaagaggcccgtgcgcttgccgccgaaaccgtggacatgactcttccggtcaatcgcaagccgcttggcgcgcgccatccgttgccgaaactgatggaggatgtcgaagacttcttcatttccatgggctggcagatttccgacggtcctgaagtggaaaccgaatggtacgactttgacgcgctgaacttcggccccgatcatccggcacgccagatgcaggataccttctacgtcaagggcaatcaggccaaggacgccgcaggattcgtcggatccaacatggtgctgcgcacccagacctcctccgatcaggtgcgtggtctgctcacccgtggcgtgccgctgtacatcgcatgcccgggccgcgtgttccgcaccgatgagctcgacgccacccatacgccggtgttccaccaggtggaggctcttgcggtcgacaagcatctgaccatggccgacctgaagggcgtgctcgataagcttgccgtggccatgttcggcccggaagccaagacccgtctgcgtccgagctacttcccgttcaccgagccgagcgccgaactcgacctgtggttccctgacaagaagggtggcgcaggctggctcgaatggggcggctgcggtatggtcaacccgaatgtgctgaagtccgctggcctcgatcctgaggtctacaccggcttcgccttcggcgtgggcgtggaacgtaccctgctgctgcgccacgacatcaacgacatgcacgacctggtcgaaggcgacgtgcgattcagcgaacagtttgtgatgggggagtgattgacccatgccaatggttgacattgattggctcaaggaccatgtcgaggttccggaaggccttacgtacgaacagcttgccaaagatctggtgaaggtcggtctcgaagaggaagagatccacacctcccagctggtcggtccgatcgtcgtcggctacgtggtcgacgccactccggaaccgcagaagaacggcaagatcatcaactggtgccacgttgacgtcggcgacgaatacaatgagaccgatgagaacggcaacaaggtgccgcgcggcatcatctgcggcgcgccgaacatggctgccggcgaaaaggtcgtcgtaacgcttcctggcgctgtgctgccgggcgatttcaagatcgaaccgcgcaagacctacggccatatctccaacggcatgtgcgcttccgaacgcgagcttggattgggtgatagccatgacggcatcatcctgcttcgcaagtacggcttcaccccggaagagtatgagaagctccagccgggtgacgacgccatgcacctgctgcacttggacgagccgctgctggagatcaacatcactccggatcgcggctacgcgttctcataccgtggcgtgtctcgcgaataccatcattccaccggtgcggcctacaccgatccggctgtcgccctgaacgagaaggcgccgatcactaagggcctgccggaaggcaccaagaccgacatcgaagtgatcgtcgacgacaataatccgattcacggtgtggttggatgcgatcgctattacgctcgcgcggtcaagggcttcgatccggccagccatacgccgaattggatgcgtcgccgcctgacccgcgcaggcatgcgttccatctccttggcagtggatgtcaccaactacgtgatgctcgacttgggacagccgatgcatgcctacgatctggataagatcgaaggaccgatcgtggtgcgtcgcgccaacgaaggtgagaagctcaccacgttggatggcaaggatcacgatttgagcgtcgaggatctgctgatcaccgattccccgaatggcgaacgcggctcccgtgtgcttggcatcgcaggcgtgatgggcggcatgtatggcgaggtcactgccgaaaccaagaacatcctgctggaatccgcgcacttcgatcaggtgtcgatcgcgcgttccgcacgccgtcacaagattccgtccgaagcctcccgtcgtttcgaacgcggtgtggacgaccagctgcagccggcagccgcccaaatggccgccgaactgatggttaagtacggcaatggcgagccgagcgagcacccgaccgacttcaataccgtctctaaccgccgtccgatcctgttcaaggcttcggaagtggctcgtgtggccggacttgacacggacgtgaacaccatcagcgacattcttaccgacatcggttgctccgtcgcaggaggcggcaacggcgagttttccgtggcgcctccaagttggcgccccgacttgaacgagccgtgcgatctggttgaggaagtggcgcgtcttgtcggatatgacgagattcccgtcaccgtgccgccggcaccggtcgaaggtcaggtcggtctgactgctgagcagctgcgcaagcgccaggttgccgatgaacttgccgaatacggcatggtggaaacgttgagctacccgttcgtcggcgatgaggattacaagaacttcgcgctggacgtcgctgagacgaagaacgtcagcgtggagatcgccaacccgctcgccggtgatcgtccgttcctgcgtcgtgacattattccaacgttggcacagaccgttcagcgcaatctacgtcgcggcgtggagaatgtgtcgctgtatgagatcggccacgtgtatctgtgggatccgaacgctccggcgattccggcactgccgggtgcagtcaagccgacggacgagcagcttgccgcgcttgatgccggtcttccggaccagccgatgcatgttgctggcattctgaccggcaacgccgttgactccggttggctgggcgagcgccgcgcagtggattggtctgacgccgttgaggcggtgcagcgcatctccgaccgtattggtgcagctctcacgctggatcagccgaaggctgaagatgtgccggcacaatggcatccgggtcgtgcggctcgtgtgatggctggtgacgtattcgtcggtatggtcggcgagcttcacccgcatgtcaacgaggtgttgggcttcccggcccattccgcggccttcgagttggatttgaccgcgctgttcgccacgttgagcggcaagccggtgcaggccaagccgatttccaccttcccgccggtcaagcaggatctggcctttacggtgtctaccgatgtcacggtcgccgagctcaagcaggttattgtcgatgccgctggaagcagcctcgaaagcatcgagctgttcgacgtgtacaccggcgaccagctgggcgaggacgaaaagtctttggcctacgcggtcacattccgcgctccggataagactctcgcttccgaagacagcgaagccatccgcaagcgtattgtggatgaagcgtccaagctgggtgcgcagctgcgcgcctgatcccgaccttcccaagaacagaggatgattatgaacgaaccggagcagtatcagccgaccaacaccgacgaacgtcaggagacggctgatgctgctccggtttcgtcatcttccgatgccgctgcgtcttcacagccggagtatggtcagatcaatcaacccgaatatggtgcgatgagtagccagctgccggccggttacgatccatacgtgtatggtgcgcctgaacctgaaccgcaacctgcggatgctgtacagcagcagaatatgcaataccaaacggggcaatacccttcaaatgggcagcaaccgatgcctccgtacaatgcgaacggacaacggaatccatacggcgccaacccgtatgggccgaatccgtatgatccgaaccaatatccgcagcagggcaatatgccctatctgccgaatctggatctcaacgatcctcggcagaatcccgcatacggccattgggatgcctatgcgatcatgtctctcgtgcttgccgtgctgatgccggtgccggtccttcccgcgttggtcggcgcgatttcgatgtggcgtaccaagaagctccatatgaaagggtatggcttggctctcgccgcggtgatcatcaatgtgttgtacaccttggccgtgatttggttggcgatgcatggtctttccgttgccgacctgtataacgagacgttgcagaatatgcttggcggcgcgggatcggggcagggagacgagtcgatcgctgcctgattcggcgtgttttctagtcctttaataattgtcatagtcgcgcaatgaccactatgcgacacgaaatgaatgcataattatgcaatgtagtgcataaagtgtatgctgaatgtgttttcagtgagtcaatggaaagagacgtgacatggccaaatacacagtagccgtggccggcgcgacagggtatgcgggaggcgaggccctccgtatcctcgcggcccatccaaatttcgaagtgacgtgcgtggccgggcattcatccgttggggacaagcttggcaagcatatgccacatattccgcagcttgccgaccttgtggtggaagacaccactccggaggtactgaacgggcatgacgtgatcatccttgcgctgcctcatggggcatccggtgcattggcttcccagcttgatccgaatgccgtggtggtggatttgggagccgaccataggcttgaggaaaaaaccgcatgggatgagttctacggcggcgacttctatgagcactggacttacggcatgcctgagctcattaccggcatatccgaagatggttcttaccagcaccagcgtgaggtgattccaggaaccaagcgtattgccggtccaggatgcaatgtgaccgcaaccacattggcgctgcagccgggcattgcccaagggcttgttgaaccggcggatattgttgccgatctggtggtcggctactccggcgcagggaagaatctgaagcgcgtcaatttgcttgcagctgaggcattcggttccgcattaccgtattctgtcggcggtactcatcgtcatattcctgagattttgcagaacttcgcccatgctgcaggaaagaacgcatccgcggcaaacgagttcacgctgggattcaccccgattcttgtgccaatggcccgtggcattctcgcttcggtttccgccaaactaaccgatacagcattgaatatgtcagatgctgaaatcaggcaggtttggactgacgcatatgcggatcaggatttcatgattgttttaccggaaggcgtcatgccggccaccgccaatatcatcggatcgaacgcggcccatattcaggtggccatcgaccgtaaggcggggcgtttgctggccttcgcggcaattgacaatctcaaccgcggcacggccggacagacggtgcagtcgttgaacgtagcactgggacttcctgaagatgcaggcctgacaaagattggagtggcgccatgagcgtaacgtttgcgcaaggtttttccgcggctggcgtggaagccggtatttccgcagtcgaaggtaagaaggatctggctcttgtggtcaataacggtccgctggatatggctgccggagtgttcacttcgaaccgtttctgcgcagctcccgtgcagtggacgcgcaagatcgtggccgacggtcatgtgaaagccgtcatccttaattccggaggcgccaacgcatgcaccggccagccgggttatgagcaagccgaagccacggcacaaaaagttgccgaactcttgggcgcttcagccgaggacgttgcggtatgctccactggtttgattggtgaactactgccgctcgaccatgtgcttgccggtgcggacaaggcgtttgcggccctcgcaaatactgcggaagcaggagcggaagcgtcgcaagccatcatgaccaccgacaccaagccgaaaaccgtcgaacttgaagggtccaatgggttccgtgtcggcggcatggtcaaagggtcaggcatgatcgcgcctcagctggccaccatgctgtgcgtgatcaccacggatgccgtggtaagcgcgggacagcttcaggcagctctgaacactggagtggaaatgtcgttcaaccgcattgacgttgacggttgcatgtccactaacgacaccgtgcttttgcttgcgtctggagcatccggtatcgaaccggatcccgacgagttcaacgagcttgtggcgcaggcgactgcctccttggcacgtcagattgtcggagacggtgaaggcgcgagccatgacatccgtgtcaaggtgaccggcgccaccacggaagatgcggcgcttgcttgcggtcgtgcggtagcggcatccaatttgctgaaatgcgccatcttcggcaatgatccgaactggggtcgtatcgtcagctcgctgggtaccgtgccgccggaagtcgctccctacgattccaataaagtcacggtcgacgtcaatggcgtgcgtatctgtgagaacggcggagccggacgcgaccgatccgaagtcgacatgactccgcgcgaggtgcacatcgacatcgatctgcatgcgggaaaagcggaagcaaccgtctggaccgacgatttgacccacgaatacgtacacattaatgcagattacgaaagctgattgaacggtaatgaccaaggaactcaaaggacctggattccattttgacgtgcataccgatttgcgcgccgaccaaaaggcggaagtgctgatcgaggcactgccatggcttgaggaattcgccggacagcgcatcgtcatcaaatatggcggcaatgcgatgatcgacgatcatctcaaagcctgtttcgctgaagatatggtgttcctgcgacaggtcggcttgcatccggttgtggtgcatggcggaggcccgcagatctcgcacatgcttaaggctttgggcattaagtcggaattcaagggaggtctgagggtcaccacgccggaggccatggatgtggtgcgtatggttttgacgggcaaggtttcccgtgaacttgtcggattgatcaacgctcatggcccgttcgcagtcggtctttccggcgaggatggtgcgctcttttccgccatgcagcgcaagccgatcatcaatggctctccaaccgatattggtttggtcggtgacgtggtgagcgtcgacgcatccgcggttgaggatctgatcaatgccggacgcattcctgttgtttcctcggtggctccaaatgaggatgatgctaccgaagtgttgaatgtgaacgccgattccgcggctgcggcgcttgcggccgctcttggagccagcaagctggtcgtgttgactgatgtggatggcttgtacgccgattggccagacaaggactctttgatcggacgcatcggcgtggagaacctacgtgatatgctgccggatttggagagcggcatgcgtcccaagatggaggcctgcgtcagggccatcgatggaggcgtgccacgcgcccatatcatcgacggacgcaagccgcattccatcctgaatgagattttcaccacagacggcattggaaccatggtcgttcccgaagacggtattgaaatgaggagttcgtatggcaactgaacagttggaaaacctcggcagtgaggacgccaagtggctggggaagtactcccgggtgcacatgaacgtgttcggtactccgctgcgtgttatggaccatggagaaggtgcgcatatctgggacgtcgatggcaatgaatacctcgatttccttgcgggcatcgcggtgaacgcactcggctacgcccacccgaaatgggtgaaggccgtcagcgagcaggccgccaaagccgcccatgtgagcaactacttcgccacggagccgcagatcaaactggcgtcgaagctcattgagcttgcgggcgctcccgagggatctcatgtgtatttcggcaactccggagcggaaggcaacgaggcggcattgaagcttgccaaactgtatggacgcaccttgccgggcgcatcgcctgccattggaggcaaaccggcgcgtatcatcgccatgacccatggcttccatgggcgtaccatgggcgcgctgtccgcaacgtggaagccctccatccgagaagcgttcgagccgctggttcccaatatcgaattcgtcgaagctggtgacgaggccgcattgcatgacgcgtttgccgaaaccggtcccggcaaatatggcaaaggtcctgtcgccgccgtcatcatggagctgatccaaggtgaggctggcgtgcgtccgcttggggccggctatgtgaagaaggcccgtcagatgtgcgacgacaacaacgcgttgctcatcatcgatgaggtccagacaggcatcggacgcaccggatcctggttcgcattccagcgtgaggatcttgcgggcggagtggttccggatattgtgaccttcgccaagggcgttgcaggcggtttcccgatgggtggcatgatctccttcggcgccaagctttccgcactgttcaccccaggctcccacggctccacctttgcgggcaatccgctcggagcggccgccgcgatggccacgttggaaaccattgaggaagacggtctcgtggccaacgccgaggcacgtggccagcaattgcgtgacggcatcatggcttgcggcaatccgcttttcgtctccgtgcgtggacgtggcttgctcgacgcggtcgaactcgcccatccatgcgcgcatgcggcgatgaattgggcgttggaacacggtttgatcgtcaacgcggtggcgccagatgcacttcgtcttgttcctccgctggtggtgaccgaacaggacatcgatcaggccatctccatcctcgcgaagattccaacggatcttcccaacgactgaacatagccggcaatcaaagcagactggatatttttgaaaggagccaacaatggcaactcctgaactgcgccacatgttgcgcgatgacgatctcaaccatgaagagcagaagcaagtgctcgaactcgccatcaaattccacaacgaccgtttctaccatcagccattcgccggcccgcagggcatcgcggtgatctttgacaagccgagtacccgaacccgttccagcttctccattggcgttgccgaactgggcggctatccgctggtcatcgacaagtccggctcccagcttggccgtggcgaaccggttgccgacaccgcacgcgtgcttgaccgcatggcctacggcgtggtgtggcgcaccttcggccaggatcgtgtggaggaaatggccaagtatttcacccatccggtggtgaacgccttgaccgatgaattccacccttgccagattcttgccgacttccagaccattgccgagcatcgtggcggcgtcgacaatctgaaaaaccagaccatcgcctacctcggcgacgcggccaacaacatgtcgaactcctatctgcttggtggcgccgtggccggcatgaacgtgcgtgtcgcagggccgaacggctatctgccggatccgcagatcgttgccgatgccgaagccatcgcatccgaaaccggcggttccgtgttggtgaccaccgatccgaaggaagcggtcgccggcgccgactgcgtgttcaccgacacatgggtttccatgggcgaagaatcggaatacgccatccgttccaagccgttctgggattatcaggtgaacgccgaactcatgtcttatgccaaggaagacgccatcttccagcattgcctgccggcataccgtggcaaggaagtcacctccgaagtcatcgacgggccacagtccgtggtttgggatgaggccggtaaccgcctgcatgcgcagaaggcactgctgacttggcttgccggcaaggcccgcggcgatgaaagcctgctggcctgatgacggaccaaacacctgcgctgcaacgtcctgccacacgggccgctcgattgagcgccatcgagcaggcgttgctgacgcgcatcgtcacctcgcagtcgcagctgtcccagattcttgcggatcagggcatcgaagtgacccaggccaccctgagccgcgatcttgacgagatccatgccaccaaaacccgtttggctgacggaaccgtggcctatgcgctgggcagacagccggaggaaagcgcgtcggccaatcctgatgcaaaaacggaacagcagatgaatcgtgtgctttcgggactggtcacttcggtcgctgcggccaggaatctggtggtggtccacacgccgtctggcgcggcccagtatgtggcaagtgtgatcgacaagcagtccatcgatggagtgctcggcaccattgccggggacgataccgtcatggtgatctgcgccgatgacgattatgcgaaacagcgtgcgcaatggctattggacgtcgtgtccaaaggctgaatagccgtatagtggacacgacgcaccgtatatgcataaatatacagagcattgcatatactgatgaataacgtttgatgttagaaagggaaaccatgagcgatcagaatcgtctcgtcttggcatattccggtggtctggatacctccgtcgccatctcatacctaaaggaacgcaccggcaaggatgtcgtggccgtgtccctcgacgtcggccagggtggcgaaagcctcgaaaccatcaagcagcgcgcgcttgcctgcggtgccgttgaagcgtatgtggtagacgcccgcgacgaattcgccaatgaatactgcatgaaggcgctgaaggccaacgccctgtatgagggtgtgtatccgctggtttccgccatttcccgcccgctcatctccaagcatctcgtgcgcgccgcccaccagttcggtgccgacaccatctcccatggctgcaccggcaagggcaacgaccaagtccgtttcgaggtgtccatctcctccattgatccgacactgaaggccatcagcccgatccgcgacctgtcgctgacccgcgacgtcgagatcgcattcgccaaggagcacaagcttccgatcgtgcagaccgagaagagcccgttctccatcgaccagaacgtgtggggccgcgccattgaaaccggcttccttgaggatccgtggaatggcccgaccaaggactgctactcctataccgacgatccggcattcccgccagtcgaagatgaggtcgtcatcgaattcaagcagggcattcctgtcaagatcgacggtcacgacgtcaccccgctgcaggccatcgaagagatgaaccgtcgcgcaggcgcacagggcatcggccgtatcgatctgatcgaggaccgtctggtcggcatcaagtcccgtgagctgtacgaggctcctggtgctatcgcactgatcaccgcccaccaggaactcgagaactgctgcctcgaacgcgagcagcaccgcatcaagcgcgatatcgacaagcgctgggccgaactcgtctacgatgcgcagtggttctccccggcaacgcagtccctgaacgccttcatcgaagacacccagaagtacgtttccggcgaaatccgcatgatcctgcatggcggccgcgccgtcgtgaccggtcgtcgttccgacacctcgctgtatgactacaatctggccacctacgattccggcgacagcttcgatcagaagtcgtccaacggcttcatcgacatctacggtctgccgagccgtgtggccgcagcccgcgacgtcaagttcggcaatggcatcgaggttccggaaaacagcgtcgagtaagcgagttttttacgccgaatcgtcttgataatgggggagagcgtaccgttaggaccatcctgactggtatcctctccctcagtcatatctgcaaggagaatgaagtaacaatgaccgagagcacaaccaatggtgaacacctcgccctgtggggcggccgtttcaagtccggcccgtctccggaactcgcgcgactgagcaagtccacccagttcgattggcgtcttgccgacgacgacatcgcaggctcacgcgcccacgcccgtgcgctcggacgtgcgggactattgaccgccgacgagctgcagcgaatggaagacgctctcgacgagctgcagcgccgtgtcgattccggtgcgttcgctccgatcgaagacgatgaggacgaagccaccgcattggaacgtggactgctgcagatcgccggagacgagcttggaggcaagctccgcgccggccgctcccgcaacgaccagatcgccgcgctgatccgcatgtggctccgtcgccacagccgcgtcatcgccaaaatgctgctcggccttgccgcaacactgaccgaacaggccgaaaaggccggacgcaccgtcatgccggggcgtacccacatgcagcacgcccagccggtgctgctcgcacaccagctcatggcccacgtgtggccgctgctgcgcgatgtggaacgtcttgccgattgggacaagcgcatcgatgcaagcccgtatggttccggcgccctcgccggcaacaccctcggcttggagccggtggccgtggcccgcgaactcggcttctccaaggtaaccgcgaactccatcgacggcaccgccagtcgtgatctggtcgccgaattcgctttcatcgcagccatggcaggcgtcgacatcagccgactgtctgaagaaatcatcatctggaacacccaggagttcgcgttcgtgcgccttgacgacgcctattccaccggctcgtccatcatgccgcagaagaagaacccggatattgcggaacttgcacgaggcaagtccggccgtctcatcggcgatctggctggtcttctcaccacgctgaagggcctgcccaccgcttatgcacgtgatcttcaggaagacaaggaagccgtgttcgaccaggtcgacacgctggaagtgctccttcccgcgttcaccggcatggtcggcaccatggtcttcaacaaggaacgcctcgaagcggaagcgccgaccggtttcgccctcgccaccgacatcgccgaatggctggtaaagaacggtgtgccgttccgccacgcgcacgagctttccggtgcatgcgtgaagatcgccgaagaccgcggccaggaactgtgggacctggccgacgatgacttcatcgaggtcttcaaggaattccttccggccgacaaggctcccgaagtgcgcgaagtgctatccaccgaaggttctgtttccgcccgcaatggcaagggaggcacgtctccgctgcgcgtgcgcgagcagatcgtttccgcgaaaaccgccatcgaacagctgcgtgccttcgccaactccgtcagcgacggcccggcatacaagacgccggaatcattgctcaaataattacagcaacagtacatagcaaaggcaaagcggtgccactgacacgaacgcagatacagcagcttgttcgacttcacggccaggagatactgtgccatgagcatatgcagatcgaaagagtctgttaccagcatggcgtggtcaccacgtttgctcattccatccgtgtggcttgtctggccgtatggatcgctgacaggctgcacttatggcatagggtggatttgcattcgttgattcgcgccgctctgctgcacgattattttctttacgactggcatgcgcatgatggcggccgtcatcgtatgcatggtttcacccatggtggcaccgccatgcgcaatgccgtgcgcgatttccatctcaatagagtggaacgtgacagcatcgagaatcatatgtttcctttgacgccgataccgcctcggtatcttgaagggtatttggtgactgtcgcggataagatcagcgccacacgggaaacggtcagtcttgagcgcttctacaagccgaaagtcaatatgcatacaagtggaaagtgacggcgcgaaagcatgctcatgctggaatacctgttcttatggttcctgttctattcatttgccggatgggtatatgaatcgattctcgtgtccgtttcggaacgtcgcttggtgaatcgtggcttcctgaatggtcccatctgcccgatctacggttgcggagccgttcttgcgattgtgctgctgcatgatctgcataatcctttcgcggtttttctcatttcttcaatcggtgcatgcatgcttgaatatgtcacgtcatggggcatggaaaagctattccacgcacgatggtgggattacagtcatcgccgattcaacattcaagggcgcatttgcttgcttggagcgattgtgttcggtctgctgggtgtgctcatcaccgatgtgatacagcctgaagtgaatcgcattacacagatgattcctttgccagtagtgcactggatgtgcgtgattttcatggcgtttatcgtcgcggataccattattacagtgcttggcatcatcgatttggccgacaatcttgcgaagttcagcgaaaccgtgcaggcatatgcggagaaagccggtgattccctgcaatggggcaaagacattttccgagacaaattccgcgacaaggtgcaagacaaggtccaggattggtcggactcctcgcaggagattcttgccaatatgcaggccactgccgcatctatcctgaacaagcagcagcgtcgtatgattaacgcattcccgcgtctgcgtttcacggattccatcaaatacagcaagatcatcgaaactctgcacgaaatgctgcgtcgcaaataatcgcgcgataagcaacagcatgaaatcgcctgccgctcgaaagaacgacaggcgatttcattattgtttgcgatatgcgatttgcatgacaatcacgctatgacagtccatcggatcatttacggatttcgtatggagtgggcgcttccagcgacgtgtccgatcccttgtagtcggtgatgcccgcaccgacattcggatgttgcgcggaatacacttggtcggcgcaatacagcacgagcagcacggcggccacgatgccaagctttcgcgcatcgattctgctgagcaggttgtcgagggccggagccagcagatatacgatggccaatccgccaaggccgaacgtcaataatccttcggcgcagatacggccgttgatatttagaaagtatccggtgtaatcccaccagcgttgaccatcatgcgtcatctccagataccacgatgagaagtattccaagcagccgcacagcaccatagccgcgacgaattcaagcgctggcttttcgcgcagctttttgagcagaaccagaatgatcactccgccggtgccatagatgggcagccaagggccatgcagcgtgccacggttcacgaacatgtcttcggaaataaatgcgagacttacctcccacacccagccgacgaagcaaaagatgaagaacatcatgatcagattgaccagtgagtagctgtggtcggcgctgatggtacgtgattcacggaatttgaacggcatcggagcaggcgcaagacgccccggataaatggagccattcagaatattctcgccgatctgcatctggtgaagatcctcacgatactcttcatagcggttcactgcgctggcatgcagaatgcggatgccaagccactcagaaagaaatcctgtgaatccatgcggcttgggcgctggaacaagattctgttccagctgtgctacggattgggcgacatcggcgtacgtggtatggagcgtctgcgggtcggccttgaagtacaggtattcgtcgttgagcatctcactgcctgcaatgccggtagtcttggccatcgaacgcacgtacacatagtattccgcgaagaacgcggcattgtagccattggaatagaagatgccgctcaagccgaaggtgataaggttgagcaggtaccagccgaggaacgagcagtccgccacgaagcattcccatttatgccctttcatcatgcgtcgggacaagcgaatggcgtccaaagcctcgatattcggattctccgcaacgatgtacggcaccatacggtaggaatattgcttgatgaagaagccgacgatggtgagactccaaaggaacaggaacacgttttccacaaacatggtccatgccatgcgcggccatttgcgcgtgtgaatggggtagaagaagcgacttgccggaagcttgttataggaacgtccttccaacagcatacgtgccatgacgatgcggtatgtttcttgaatgaacagccagacgaaaatgtagacggccagcgagagtattaccagcacggcgatggagacgccgccgttatgggtgacggaattaatggcgtcggccacggcgatcaccatcgagccggatgcaaacgagttgagcagggacgcgattactccgcggcgacggccgaacgtggcatcggtatcgttgttgacgatctgctcttggttttgcttgaccttttcacgggcatcgttttcattgcctacggcaagatcctgcaatacgtcatacatgtcgttggattgcgtggaatcctccgtttgcggggtgctgatcgaaatgttggtgctgaccgagagcgtcgatgaagtgtacgcaacaccgaacaccgaagcgaacaggcaaatggcgactatcatccaataataatgttttctctgggctttcttagccgcaaccttcatgcctttgcggtccatgcaggtatctcccttcttgatatggggatgctccttctaactttacccgtatgcacgatggttggtggatgatggggaaacaccgcgtgcgcctgtcttcatcttctgcgaaactgtagggtgcgtaaaacgcagtatcatccgcaattcaatagggagaaaacacagctatggctcacgtcatcgatttcaaggaggccggtttcgagtccgtcctcgatgaactggaatggcgcgggttgatttcccagtccactgacagggatcgactcgccgaagcgttgaacggagatcccatttcctattattgcggtttcgatccgaccgctgcctctctgcatatcggcaatctggtgcagctcatcaacatgcgtcaccttcaggcagcaggccatcatccgattgccctggtcggcggcgccaccggcttgatcggcgatcctcgccaatcgggcgaacgtacgctcaatccgaaagacgtcgtggctggttgggccgagcgtctgaaagcgcagatcggcggcattctcgaagtggaaggcagcaatccggtccgtttcgtgtccaattacgattggatcgcctccatgaacgtcatcgacttcctgcgtgacgtcggcaagaacttccgtttgggtaccatgctcgccaaagacaccgttgcccgtcggctgaattctgaagatggcatttccttcaccgagttcagctaccaggtgctgcagggcaacgacttcctgcacctgttcgacgaataccattgcgtgcttgagcttggcggatccgaccagtggggcaacctcacgtccggtcttgacctgatccacaaggtacgtggcgtggatgtgaacgtgttcaccagcccgattatcaccgacgctcagggtaagaagttcggcaagtccgaaggcaacgccgtctggcttgacggcactatgctgagcccatacaagttctaccagttctggttcaaccgccctgacagcgagatggagaacctgctgaaggtgttcacgttcttgccgaaggcggagatcgaacgtcttgtggaggaaagcaagaccaatccgggcgcgcgtgaggcgcaacgcaccttggcttgggaggtcaccagcctggttcatggtgaggaagccacccgacaggccatcgaggccgccggtgcgctgttcggccgtggcggcgatcttgcgggcgttgacgagtccacgctcgaagctgctcttgacggcgtgaagatcgacggcgagttcgccaaggccgcggtgggcgaccgtgtggcggaagccggcatgaaggccggactgttcaagtcgatttccgaggcgcgcaagacgattaaggctggcggcgtgtacctgaacaacgcccgtgtcgaagacgaagagcaggttttgaacgaaaatgacttcctgcatggacgtttcgcattgattcgtcgcggcaagaaggccctcggcgtcgtcgaaaacgtgtgaggcaatcacgagcggcgcaaacaaacgtaaacaaagaacaaacgaagaccattttcaaggaatacaaggaatataaggaacagcatggcagaagaacagcgcggatcgcgcggcaagtcctacggcaaccacaagtcctacggctcgggcaagccgggcgatcgcggcggcaaaggattcaagccgcgtggcaatggcggcaagtcctacggccacaagtccggcagcttccacaacgacgatcataagggcggataccgcaagggcaatggcggcaatttccaccgcgaccgcgatttccgtcgtgacggtgagggggaaggccaggagcgccgcttccataacggtccgcgcaagttcaaccgtgacggcgagcgtcgtgacgatcatcgcgattatcgtggcggtcgtggagacaatcctcgctaccagcgcgatggcgagcgttccggtttccatcgtgacgatcgacgtgacggaaaccgtaaagacttccaccgtgatggcgatcgccgtaacttccaccgcgacaacgatcgcagggatttccatcgtgacggtgaacgccgcaattaccgtgatggcgagcgtcgtgacttccgtcgtgatggcgatcgtcgtaacttccaccgcgatgaccaccgtggcaatgatcgtcgtgatggcggccgccgtaatttccgtgatggcgatcgtaaggatttccgtcgtgacgatcagcgccgtgacttccacaaggatcgcgaccagcagcagggcgaggagcgtcgtgagttcacccgcgaagagaagatggcctaccgtgaggagaagcgtggcgagtacatggccaagccgcgccgcaattccgatggcacggtgagcttcccctcgcagaacccgtacacgcatcgtcgtcctgatgagccgaagatgccgaagggcatcgaatggcgtatgctcaccaccgacgatcgcgaacgcctgcgtggcctgtcgaaggaacatgcggaaaacattggtctgcacattcttgccgcgtacacgcttgaggagagcaacccggagctggccctcgaacatgccaagtgggtggcccgccaggcttcccgcatcgatttcgcccgcgagacactcgccttcgtggcataccgtcagggtgattacaagcttgccttgcgtgagttccgcaccgcgttccgtatgaacggtttcctggattatctgccgttcatcgccgactgcgagcgtggcgtgggcgagccgaagaaggccatcgaagtggctgtgagcgacgacgccaagtatctgcgcggtgaagccaaggctgaaatgttcttggtgtacgctggcgctctgggcgatctgaagatgtgggacaaggccatcgagatcgtgcacacgctgggccgttccaagggattggccggcgaataccgcatgcgtgcggtgcaggccgaacagtatttccttgaagaggccggccgtaccgatgaggccatcgcattggatcgtctgctcgacaagctcgaactgcagtacgccgatgttgaggatgatgagacttccgacgatctggttgtcgaatacgacatgcaggagctgaacgacgaactcatggacgtgcttggcatttccgaagatgacgcgcagtacgctccggaagaccctgagaatgaggaagacgaatccgaagccatcgacgagaacggcgaaaccaacgacgaaacccagcttgaggccgaagagacggaagcaggcgcggaatccgatgacgagccggcagaagctgacgatgctgcggaagatgacgccgatgatgacggtgaggctgaagaggccgaagagtcttcggatgcttcttccgaatcctccgaagataacaagtgaggtgacgtggcccgcatgctgaagtccacgaatcagccgctcagcgaagcatactcgctggcactgcttgatcttgacggcgtggtctaccgtggtaagaacccggtggaacatgctgccaagaatatccgcaaggccgaatccttgggcatggcggtggaatacaccaccaacaattcgtcccgacttcaggccgtggtggcagaccagctgaaggggttcgatttggatgtcgaatcctggcaggtcatcacctcgtcggttgtcgccgcgcgcatggtggcacgtgccgtgcctgaaggttcgaaggttttcgtgcttggcgcccagcatctgcgtgaggaagtggccaagcaaggtcttgaagtcgtcgattccgcagaagcgcagccggtcgccgccatccaaggatggtatcccgacatgtcttggaacgaaatggcccaaatcgcctatgccgttgagcatggcgcgacctatttcgtgaccaatcgtgatctgaccattcctcgtgagcttggcatcgcgccgggatgcggttccatgatcatggcggtgatcaatgccaccggtgtggaaccggtttcgtccgcaggcaagccggaatccgccatgtatgacgaggcgcgcattctcgcagcccatgatgatggcgagccggtggacaaggaacagtgcctcgccatcggcgaccgtctcgacaccgatatcgaggcgggcaatcggggcgggtacgattcccttgcggtgttgaccggcgtcaccgatccgcgcgaactcatgttcgctccggcgtatcttcgcccgacctacatcgccaaagatctgcggggcttgaacgagcccgctcctgaagtggtgcatgatgagggcgcatggctgtgccgcgatgcgaaggcccgcgttgacggcgaccgcctgtatgtcaccgacatcaccagcgtcgacgggttgcgtgccgcatgctgcgccatgtgggccgcggccgacagcgggcgagatgtgagtggcgtgatcgttccggaattccgtatttcctaacgaacaattcgtaccgattattggaaaaccattgcgaaacagtgattccactcaggttgttcgtcttgacgttgcgttgttggaacgtggtctgaccgacagtcgttccaaggcgcaacgtctgatcgcggatggcaaagtcagtgtgaacggtgtcaccgtcaccaaagcatcggcgaaagtcggtggtgatgacgtcatcgccgccgataggggagacggctacgtttcccgtggcgcatacaagcttgtcggcgcgttcgaacggttcgccgacgtcggattgcgttccgcgcaaggattacgttgcttggatatcggcgcgtccaccggcggtttctgcgacgtgctattgcgcaatgatgccgcgcaggtcatcgctttggatgtcggccatgggcaattggatccgaaaatcgcgcatgacgaccgtattatcgaaatgagtggcgtcaatattcgcgacgtgtatgcggaggatttgccgtatcgtccggaaatgattgtttccgacgtatcgtttatttcgctgacatatgtgattccggtgatcgcaagaatcgccgcaccgcaggcgcagatcgtgctgctggtcaaaccgcagttcgaggtcggcaaaggcaaccttgggaaaaacgggattgtcgaaagccaggaattacgcgaacaggcgctgtcctccgtcgtggcatgcgcggaacgcaacgggcttgacgtgcgcgccacaacagtatctcccattgaaggcacgcatggcaatatcgaatatctgctgtacgcggtcatgcagtgaaacagcgaccggttgagagaaccgtgtctgcagtgtaatcaaggcaaataagataagtaaaaaaaaccggaaatcatgattatgaaattccggatttttccatatggaaagagcgtgtcagctgcgtaggaaccggtcgatttgattctgcttgcccatgatgatgagttcgtcgttgcggtgcatgatgagctctttcgaaccgtattcgaattccttgcccggcgatttgatgccgaccacggtaatgccgaagcgttcatgcacgcgagcgtcttcgatggtgtagccgaccacatgcgcgggggtatggattttgacgacgttgtatgcgccttcaagctcgatgtagtcaagatagttgccggacacaagatgtccgacgcgtttgccggcgtcggtttccgcgttgatgatgtggcgtgcgccgatgcgttgcagaatgcgggcgtgttccttcgacacggacttggcccaaatgtcggagatgccggcgtcgagcagattaccggcggtaatgacggaagcttcgacgctgtcgccgatagccacgacggccgtgtcgaaatcggatgcgttgatctgctccaacgccatcacatcggtcatgtcggcctgcacggtgggaatctgcgaagaccaacggttcaccagttcgccgtctttgtcgacggcgagcacatcctggcccatcatgtcgagcgtggtggccacagagctgccaaaacgccccaaaccaactacgagaacgcttctggtgttgttggccatgatgttatgcacctttcgaaattccatcttcaaaaatctatattcatgtgtgattgcaggcaactgcaagtatatgaagccgtatcgtcagccgaccacgatctgctcggtggggtagcggacggcctcgagattgtgtggacgcgaaatcgcgtaggcgatggtgagcggtccgagacgcccgatgaacatggttgcggcgagaatgtatagcaccgtggggctgctttcactggctacgcccaccgagtagccacccagtccgaacgcggagcaggtatcgaacagtgcgtcgcacagcgagcagccggtgatgatcatcagcgccatcgacaccacggtgaccagcatgagacatgccgtgcttacggccacggcggtcataaccgcctgcgtgtggatgcggcggtggaatgcgttgatgtcgtggcgtccggtgaatgcggcacgacaggtcagcagggtcaccgcgaacgtggtgacgcggatgccgcctgcggtcgaggtgctgccaccgccgatgaacatgacgatggacaggaacactttggttgcgtcgctgacgcctggcatccacgacaggtcaaatccggagcttcgtggcatgacggccgcgaccatggcgtgccagaggcgcggctcgatgccgtttccggcgaacagcagcttgttgttccattccatcagcaggaaccacgtgaacgaggcgatcacaatgcagaacgtggtggtcagtgtgagcttggtgtgcaggctccaacgcttcggaggacgacgcatacgccaggaacgcatcaggttcagcaataccgggaagccaagggttccgcagaaagcactggctaggatcggcaggccgaccgcccagttgttgacatgcagaccggcgccgtcgggggtgaagccggcgttgttgtacgccatgaccgcgaagaacaacgattcccacaatgtgtggcgcacattaccgtggttgaccttgtagaggccggggaacaatgcgacgaatgtgatgccttcgatgacgaatgcggtggtgatgactacggtgagcacgcctttgatttcaccgagcttcgtagtgccgagttcgttggcggtcagcatgcgctgcgtggccttgagatggtggttcacggccaatgcgatcaaggaggcgaacgtcatgacgccaaggccacccatctgcacggcgaagatgagcacgccttggccgaaggtggtccaatgcgtggtggagttgacgatggagattccgcatgtggaaatggcggatactgcggtgaagaacgcggtggtgaacgtagtggtttcgtctttcggcgtggcaatgggcgtcatcagcaacgtagtggacaacgccgcgagcgtcagaaagtagaagatggtcagacggcctggatggttgacgagtcggcgcgtgaggccgcgcttgcgtggcttgcggtcttccgccatggccttctcgaaagtatctcccgagaaccaccatgcgtagccatgtgaggcctcacgattggaggaggactcgtcaaagacgaggtttgacatgccgttcctctctccttttcttacgatgttcggtcttcgttcctgtgagctattgtaagcatatgtgcgactaacaggctatttgacggctgacattcctgattcgtggcttgcatcggagacggatttgaggcgtgttcgcgggttttggcatgttttcgacgcgcattgccggttttcgttcatttgttcgattacactggaggtcggtgatgtcttcatgggcgttttccatagggcgtttccttttgctggaaagggattaacgatgttcggtacccgtcatgcggtggtggtgacgcatagtcgtctgagggagagtggcacggtggttgaggaggctgtcgggcagctgacccaggccggtttcgaagtgtcgatcattgacaatatcgaggcgccggatttcggcaagcagctgccggtggtttccgaacgtactgagatcgtggtggtgctcggcggggatggcaccattcttcgagcggctgaactggtgcactgcaccagtgtgccgattcttggcgtgaacttgggacatgtcggctttttggcggagtttgaaagcttccagatgagtgaggcgatccgcagggttgccgagcatgattattccattgacgaacgcatgattgcgcatgtcgatgtgtggctgccgggagcaagcgagccgattgaggattgggcgttgaatgacatcacgttggagcgtgcagaccgtggcaaaatggtcgaactgtcgattcgtgtggatgatgtggaaatgagctccttcggctgcgatggcgtgatcgtgtcgactccgaccggctcaaccgcatacgcgttctccgccggaggaccgatcatgtggccgaacgtgaaggcgttgcagttggtgccgttggccgcccacgccctgttcgctcgccccttgattattggctccggttccacattcgccattgatatccttgaggattccacgtcggatggttggatctgctgcgatggccgtcgccaatgcgcgttgccgcggggcactagggttgaggtgcgcgaatcgaagagcacattgcgcctggcccgtctttccggcgtgccgttcacgaatcgtctggtcacgaaattcgatcttcctgttgtcggttggcgcgagcaggcgcgtaaaaccgggggagtgcatcatgggcatgtgtttccggaagataaagaaacgaacgagtaaaaacactgatgcttgaagaacttgagattcataatcttgggccgatccgttccgcgctgatcgcgcctgccggcggtatgacggcgatcaccggtgagacgggtgcaggcaagtcgatgctgctcagtgcgattcggctgatttccggcggtccttccgacggtgggcgcgtgtcggtcggagcgagcgaggcgtgggcgcagggcgtgttcgaggtcgcttcgtcaccggccgcggtcgcagccgcgcacgaggcgggttgcgaacctgaagacggagaactgttcctgtctcgcaaggttcctgcctccggtcgttcccgcagcatgctgtctggtcgtagtgtgcctcgttccgtactggggtcgatcgcagcggagttggtgacgattcatggtcaggcggaccagttgcgtatcgcgtcttcggcgcggcaacgtgagtttttggaccgctatgccggcgatgatgtggcgttggtcgcatacggcaaggcttggaatgcgcttcgtgccatggatgagcggttggagcgattgtcgagccaggagtcgtccatgcgccagcaggcggattacctgcgcgagtccatcgaacgaatcaaccgcatcgatccgcagccgggggagatggccgagttgcgtgctcgccgtgatcgcattgagaacgcggccgagatcgccgaaggggtgaaccgtgcgttgagcgcgttggatgcttcgcaggttgttgacgatgttgaatcatccagcgccaccgatctgattgatcgcgcgtcgcaagcgcttcgcgccattcatgtggacggcgtgttttcggaactggccgatcggcttgattccatcagcactgatttgtctgatgtggtgttcaccttgtcgggcgaagtcgacaatgatctcggcatggaagacttggacgccatcaacgggcggatccatgagcttgacgaattggttcgtcgttggggcccggaattgtcggacgtgatcgcgtggcgagatcaagcggtgttcgacttggaggatctggacgcgtctccggaaaaagttagtcaattgcaggcggaacgtgaaaaactgttcggtgaggcgttgaaggcggcgcgtgcggtaagcaaaagacgtgccgccgccgcgaaggaacttgccgccaaagtcactgcggaactcgaatctcttgccatgagcggatcgaaactagagatccgtgtatcggaacgtgaacatttggacgcttccggcgctgacggcatcgattttctgttcacgccgttcccgggttcgccgcaaatgccgatgggcaaaagcgcgtccggcggcgagctgagccggctcatgctcgcgcttgaactcgttgcggcggaaaaacatgtggtggcgggcggttccgtacctcccatgacgttcattttcgacgaggtcgacgcaggcgtcggtggcaaaaccgcggtggagcttggcgcgcgattggcgaaactcgctcaatccgcgcaggtcattgtcgtcacccatctgccacaggtcgcatcctgggcggacgaacagtacgtggtcgccaaaggtgaaatggatgacggatcaatcgccaccaccatcaatcaagtgcgtggggaggcgcgtgtgcacgaaatcgcccgtatgctctccggcagtgaaagcgaagcgtcgctggaacatgccgaagaactgctcaaatcatcggttctcgattaacgtaagatgcacaataataaaggaggatatcgatggcaggcaatcaaggcaagggcgccattttcgatcttgacggcacgctgcttgattccatgggcgtttgggatcaggttgacatcgattttctttcaaaacgaggcattgacgtgccggacgattacatgacgaaagtcgcggccatgcaattccgccagatcgccgaatatacgattgcgcgtttcagccttaccgacactcccgaagagctgatggatgagtgggatcatatggcccgcgtcatgtatgccacagtggtcgaagccaaaccgtatgcacgtgaatatctcgctcaattgaaagagagtggagcgaaacttgccgttgccacatcgctgccgccgatgctgagagagccggcgatgaagcatgttggcattttcgactacttcgatgaagtggtcagtgtcgatgatgccggcgacgtcggcaaagaccagccggacgtgtatctgttggctgcatctcgcctcggagtcgagccgggggagtgcaccgtgttcgaggatttgctgatcggcatgcgttccgccaagtcggttggcatgaaggtatgggccatgcacgacgattcgtccgatgccgattggccggctatttgcggtctggcggatggtgtcatgttcgacttccatgacgcgcctgccgtattgtaggaaccggcgtcgtgcggggatatatgcatttggggctttccgttgattcggaagaccccaaatacgttccataagagtctaccggctggctcggttcagatgtccttgctaccgtaaatatgcagcgatatcttgctggagaacaccaaggcgagtacgtcgatgatcaagaatgtcgctaatgcaatggcttggtgccggctgatcgcttcggccagctgttcgacggtcttttcgaattccggcaatgccttgcgcagtccgatgaccgtgcccacgatcacgccgatgctcagaataatggcggccatggcgcgataaggggagaaccggtacaggaacggctgcacgatggcgttgagcagcacgagggtcagcacggtcatcgcggcgaagtcgatcgcatccgtcactttaactggctcgtgcatgatggtgccggcgcaggcgatgctggcggccacttccaatcccgccaccagatcgcaggcgataaggaatgcgaatcgtccgaggatctggtggttgcggttgatgggcacgatgccgttcatccaatgatggttgttcatttgttcataggagaacagggtgatattaagcatcaggaagccggaggccgccccgccgatggcggctcccgcaacgctgtcgagagtggaccctgtggccgccatcaggcatgtgaagcctggaacgtacgcgaagaagatggctatgtacgaccgcccgtagctgatggtgcggttccagtccaaggaaatctgcctaaggatggcggtcatggcgtccgcgttcgctgtcgtgttcatcgtacgtctcctttgttggtattgccgattgccgtatgtgccgcggcgttggtcagtctgatcacatcctcaatcgaagcatgctgtgtcaggagaccgtcggtgccgccgatgtgtgggatgtcctgcgtgcggaccaacgcgtcgaagccggttgcgtatgtgcggatgccgaccattgcccgctgtagaccatccgtaagctcatccggaccgcccttgaccaggcggaacgcgtcttcgaactcgtctttcggcccgctgtaatacagcatgccgttcgttatatacgcgaggaaatccgcgcaacgctccaaatcggcggtgatatgcgtggagaagattacgctgtgtccgccatccgcaacataatcggacaggatgtccatgagctcgtcgcgggacagtacgtccagaccgctggtcggctcgtcgagaatcagcagtttcgcatcgtggctcaacgccacggcgagcatgagcttcatctgcatgccgcgcgacagatccttgatcttcttgttccgtccgagtccgaaccgtctgagatatgcgtcgaacagattgtggtcccacagcgggtacattgggctgcttgtccgttccaccgcgtcgaccgtcatgtattcgatgaaatagctgctgtcgagcactacgcccagctgctctttggcccgctcctcatcggccatcgcgtcaaggccgagcacttcgattcgtcccgcgtctcgcgcggtcatattgaggatcagtttgatcaacgtggatttgccggctccgttcggaccgaccagacccatgatgtagccggacggcaggtcgaaggtcacgtcatccaatgtgaagccggaatcataatgcttcgtcaatccggttacgctcaaggccaaggttggccgcgttccttgggggagtgaggaatcgttcatgattgttccctgtacgctttctcgaacatgccaagcagatcaagtaggctgatgtcggcggctttggcctcgatggaaacttcacggagcttgtccatgatgcgttcacgcgcacgttccttcatgagttcgttgcctcgttccatcacgaatgtgcctttgccctgcacattctccacgagcccctcgtcggccagttcgttatacgctctggtcacggtgagcacgctgacgcgcagttccttggcgagcttgcgtagtgagggaagcgcctcgcctgctgtaagctcacccgacatgatcgcggacctgatctggttcttgatctgttcgtaaatcggttctccggacacggatgagatgatcagcttcaatctgtgcctctgtttctgtatgtttcgtaggtgatatatctcccggctgaacagttagatgcaaactgtttagctgttatatataacagtaacacagaaaacccgtactgttattacgtgtcgcataacagtacgggttttgttggaatataaggaaatccgccgctccatgaacgcctcttgcggtcgacgattgacggaagcgacatttacttgcgttcgaggattcccgtatggacggttatgcgcgagtcggatggatgatacggcggaaacacaggtagatcagctacgccaacggcatggtcatcaacataggcagtgtagggaaccggcgatgagtcccacgccaatcatgattgcgattttcttcgcgccgaaggagagagcgtccgtttcggcgcgatccgtcgcctgggtggtgttgctatcttgctgcatgattgtttgttggggaaaccatctgttattccattcccttatagagttctttggctagaccaatcagtgacttgtctgagcctgctgggccaataaggcatgcgccgcatggcagtccatctgctgtttccaatatcgcgtatcgtccgttcatagtcgggtagttgttgaaacatcgacagatcaatcagaccgtgaacgcctttggtgtgatatcaacgacttgcgtcacgttgaagtcgatggcagccgacagcagcaggtacacttgttgacgtggcatctcgaacatggcggcaatcatattgatggcgtgttcgacgctttgcgataatgcgtcatccagcgtactgctgaaacccattggaatcagcgtgccatgactgatcgcaaatggcagaggggctgcggacgttttcttggagatgatcacgcagccattccctggctctgacggtattgtaccggactcatccaaccgagcgaccgtttgatgcgctcgtggtcgtaccagcggatgcagtcgtcgaccgggacgagcacctcgtcgtgggtacgttcctcccaatgcccgggatggacggactccatcttcatgcgtccgaaggacccctccgcgccgtcgttcctcgggaccgaacatacgataatcctttcattcagtctccaagaaaacgtccgcatcctgtaacgtccggattcttgcatactttgggttttcggtcctgacgtgaaaggcggggacgtttccacgtgtcaagtcgacaatcggccagcccataatgatgtgcgttgattgggggtgtccgcagcgaaatcggtggaacttgtccagcaggttctgtgatacgtcgagcatcgtgaatccatggggtgggggagttgcggctgtgcaacttacttgagttctaagcgacggttcgcggattatttgtcgatcgttcacgtttaaggcgttgcgtgttcgccttccgagcctattttgtcgcccgggctggcttgtctgacagcttcaatgtggcaaagcagaagaggtagaagaatgaggataatggcgaaaaaccatacggcaacaaaggaacagcggcaggcaggagcctggcgcaaacgcggtaccaaatcggtgggcggtggcatgctcgcgttgacaagcgctgtagtggcagcggccatgctcgcaacgccagcggctttggctggggaaggaaccgcccggtattacagcagcaagcagccgtatgttgcaccggcgagcacatcatattcagcaattccgagcagataccatcttgcatacaccgagtctgtggcaaggcatggctcgcgtggcctgtcgagctacaagtatgacgctttgctggcactgatggctcagtctgctgcggaaaacaattatgctggattcgttagcccagaggttggcaaggaattcatcaacaatgtcaatgccattactgcggtcaacgtgggcaacgggtatggcatgctctctggtcagggcgccatacagcatcagggcattggtgagagaatataccagcgtgatgctgatctgttcgccaatgccgcaaagcagggactgcgcgtctcataccagagctcgggtgagcctcgtgcaaccgaatccggagagaatttcaaactaggattcgatcaggcttccaacggtttgctggcgaatgcggttgtagcaccgaataatcctgcggataacaattccggcaagaatttcgacaagaacaccaccacgttgtatttccataagactgataatccggatggtacgcagaaaacgggcgaggccaaggagcgcgcggaacgttaccagcagttcgtcgcgaatgatgggggcatcgccgaggctgaggaaaacgtgacgaacgatccgtccatgaccaccgcttcgcataatctgctctctcaaatcttcactgacgatttcctcgcgtccatcggcaaggaggaaggccagcgcatctggtacaacacggctgacggcacgaaaaagggtgcggccaattgcgctgctggcgccgaccctgccaaggatgcgaacgcgtgcggtgacgccaagaagaagatcgcgtcggaacaggatgcggcaatggatttgtacaatctgtacatcatcgcggccgatatggaacaggagaacaccggatcccacacgttcaatttcgaccagtacttccaaggtcagcacgcccaggaggctaagacgtttgcttggtcgcttgatgccgaggacttctatgagaagggaccggggcgcgcaggtcaggatgagacctaccgcattgcccagccgttgctcgacgatttcttcaatgcgatcgacacgagggagcgggccggtaccgccgcgacgttccgattcgcacatgccgaaaccattattccgtttgcggcattgctgaagctgcctggatcgcagcagcaggcgagtgaactgtacacgtatgagaataatccgtggcgtggcgaaagtgtgacgccgatggctgcgaatgtgcagtgggatgtggttgtgcgtgatggtacggacgtctcggggcagccgtatcagccgttggtcagaatgctgtacaacgagaaggaaatcggattcaacgattcctgcacgccaattgcggatggttcgacctggtataaggaaagcgagctgaaaagctgcctgaatggtaagggaaccacggttgatgcccgactgacggatgaggaaggtcagcctgaaacgccgggccatgaatcgacaccagatgattcgcagaaggctccgggtgcgaatgatgcgaacggccagcggaagcatccggtgaaatcgtccgcgaacggcggcgatgcggtcaagctcgccaaaaccggttcaaacgtgacgcccgccatcgtggcgaccgtcgtgatggtgtcctccgcgatttttggaggaagctacgtgcggcgttcccgccggaaggcttgatttgaaaccttatctcgaccgggttacggcctgacttgcaacttggccgcagccggacttcggtctagcgttttacatctgatgcgctgttcccaattcccatcctcgggcttggaagcagcgcatcattgcgtcaaggtgcggtatgaggtcagtgcgtatgcagctggggcttttcgcgtactttggcggtgagatagtccgcttccaccttccatacggtgacggcgcgtacctgctggtcggtgaattccgcatgttccatgccggcctgctgcttcatcagcagtgcgagcccctggcgtgcctcgtcaagatcgtcgatgatggatgcggtaccattgccgacgatcgacttgaacgcctcgccccaattgcacagcgtgtgcccctcgaccacctcgcagtcagtcgccatttcgaatgctacaagaagcgcgttgcctacggccttgaccgcgtccatcttgcgcccggtcgcagaaccatggaaatacaaggtgagatgattggattccgtgtcgaacacgtatccgaagttcaacggcacgatggtgatgccttccgcatcggtgtatgcaatattcacgatcttgcatgttgcgacaatcgcctcgacctgccgcggatcggccacctcacggtcggcacgcctcatcatgcgatgccttcccgcaaccgtctgctcataattgcgccgcattaccatggcacgtccctctccgctggatacacactagcttaccggacctatcagccaacgctgtatacgccggaaccatcatcccaccaagcatgatccaccggctccggctgcacaagacgtttcggctccttcaacatttcaatcgccttcaactccaaacgttcacgctcctcagccaacgcatcgccaacacgatcaagcaaaccgcacacgcgagccgtggactgacatgtcggaagacgatgatttattgttggaagtctgagtctcatcgcgcttcccctcttctcttacgaggccgtgccccgcgccgttacgagaccttcgaaaggcttgtcgaagagaccatattcgaagacatcggcacactgcacgaccgctatcaggaattcggcatctacccgctactgacgctgcttgcgtcattcgcatgaaaaagctgatctataaacaaagcggcatcgcattccaaactagaaaacggaaccaccaagcttgtcgagcgcccgcagcaaagaatcaacatgacccttcgcacgcacgttgtaccgggcgatacgaatcactccatcaccatcgatcacgaaagtcgaacgaattacaccctcatagaccttgccgtacaatttcttctcaccatacgcaccatacaaacgatgcacagtcagatcggcgtccgacaacaacgggaacgtcaaatgatcgcgcccgcggaatcggatgagcttgtccaacggatccttcgatacgccgagcacggtgaatccgcgggaggagaggcgcgcgaggttgtctcggaagtcgcaggcctcggtggtgcagccgggagtcatcgcggcagggtagaagtataggatgatattctggccgcgcaatgcggagagcgtgatgctatcgccgttgtcgctgggaagtgtaaagtccggggccgtctgccccgcttcgagtcgtatagatgtgcgggagtcctgtgctgccgtggttgctgacggattgatgtcggacatgattatctccttactgttcttcggacttcaaatgccgataccaagcaagaataaacgtcatcatacccgcctttgcgtgtgcacagttcgttgactcgttgcgcgccgccgcgaactgcccaagcagtaggtgtcagacctgtcaagggaacaaatcggaaaaagatcctgcgcgaagtatggtttgaaacgtgtcatcgtgcgcattttctggatctgtcggccttgtgctgagcaaagcaggctgtatctcgcctatgtatggcagatttcgggatgcgacgggaggtatttcgcttatatatggcagcctgttcctcaaaaatgaagcttttcataccccctacctactgtttcggcagactggcctgccatatataagcgagaagcctccggacaagtccgtgaatctgccatgcataagtgagatgagggcaatgcacatcgaggtgatgatgttttgtctttgccgacgtgctgggcatccctgtcgaaaacgtcgcagtaaacgagctcggcggccttggcgacgcgatgtgctccgccgtgggaaccggcttgtacaaggatttccaagaagcgttcgaccacatgtcgaagccgggcaaaagattcgaacccagaatcgaccagactgccatctacgaccgcaagtacaaggcctacgagtcggtcctgcgcgtcacggacgcgggatggaacaccctcagcgttatgcaaaacagtccgacccactgaactaatcaacagaagcacacgaagcaagagtcggacacgacgtgtcgatcgtcgtgcccgacttttatatggcgtgcgcctgttggatgccgattatggtttgaaggtttttggattggcgtccccccggaatatcgcgaatggggctaatgaagggaaacgaaaacatggcgtctaaacatgttctgaactgcgctccgttcattgtctgtttttgagaataaacttgaaagacaaaggtgattccttaaaggcgaggagggtctcatgagcgctatggagctgtcggagtgggagggaaagctcaacgaagaggtccgaatcgactgcactctggaggccttggcaccgggtcaacttatcgattgtgcgggtggagaagaaaaagggaacgcaacacgagtcgatgacgaggtaaccgtcatcaatgtcgaatgcgaggaagcatctgacggaaaacaggccaactattatcggctggcgtcgtggtgtggagtaatcgcgggtgccatcgactcgttgtgggtcggacgatttgaccttgatcgtgcaagagaatggggaagcggtcagattgatgcgttcgtgattgctgtagcgaggatggattcggaatacaagggtgacgatctgaaatcggcgattaggttccttgagaagatgcatccgttcgtcggtgacaaggccactcaggagttcggcggcggataccagcatcatttgcgggatttttcgcatcacatgagcttgggaggtcttgctttctccatcctgacgcagttcacggggaaggtgtatgggacggaccggcatggggaattcctggccgtgcctgtggaacgggatgagctgattggtgggaatctggaagagaagctcatgcttggcgtggtggggtggttcttccatatggtgagcgatatggcggggtcgagcgggtcagtagggaaggggactggtactcctgggccggtgttgtccttggtgaaggagttgtcggcattgccgttattcaaagacgcgatggcggatgagaggtcgttccgtaagatgctgtcgaaattgtttaatggaacactgctgaaggatgttggtgaaggtggcgaacggatttatcggcgcttcgatctcagggcggaactgggtgtgggacgtgagctggcaaggcagtccgtgcctgtgataatcaacgaatgtttggtatgcgtatgctatacggcgcaaaaactgtatgaaatgtgttcgaaggggatgttggaccgtgagtcgctgatgcggtttgggattgatacgctgctgccgaatgggtctgcagtcgctgcaaggatggtcaccattgcgacgggagtgttttcgctgtttgacgttgctgacggggttatccgcgcgctcgtgggaggtaaatcgaagataggagcgttggcggttaaggatttctttctgcacgtgaactttgtcgggatcgctcggtttgcgtttgctgtgcgtacggattatcaggtgagttccaacgcgcgcaaaaaggcgcaatcgatcccatattccgggtttgagaatcgaggcaatgggtatggtgatgattcctcggttatgcgattcttcgaaatggatttggcgaagacgaacatgttggtctccatcgagtatcaggcgcttcttgccgatatagagcagacgaagaaaaagtctttgcgggcaggcaaagagcaatggctccaagattgggagagagacgtcagtgccgaattcacgctattttcctttgaagagctcagggaagaggcgcagagaatccagacatattcggcagtgggatggcaggagctggtggcgttggaagcttcgcagttcgtgccgtatcagtttatgtctgagggttccggaaataagactggcaagaaactgaagttcgattcagagacgttggatgaggtatgcgatagattaccgggattcgaaaaaggaagttgcagaaaatacgcgaaggcgatagccgggcaggagaaacggctgaaaggcgtgaatgagacaatactggtgggtgctgtcggcagtgtgtgcctaatcacagcgacagggggagccgcatttgtgttggctccgaccatcgctccggtattggcgggatcgacggtggcaggcttgtccggagccgcgttgacgagtgcgagtctggccgcggttgggggcggatcccttgcggctggaggcctcggcgtggcaggaggtacggccatcattgccggtggcggcgcactggtgggtgctgccgccggtggaggcgccaccacactaggcacgtggatagtgtcgaatcaggacgcatacgtactcaatacgtgcgcgaaattgacggtgttctgccggaacgtgctgctcaatgatgagcagggaaaacagagagttaccgagatatgccagtacatacgtcaacagatatggatggctgaagcgcaactggggttcatgtcgcagcttgagagtctcgtgaagaaagaaggcgggatctccctcggttcaggacgtcaagccaagcgggaccgtaatgaggctgtgaaagggattgaaggcagcatgaagaacatgaagaacactgtgaaatacatgaaggcctgcgagaaacaactcaaaaagatcgcgggtattgatagggagagtgaaaagagttccacatggagggtagctccgcaaatcgaaagccagtgagtgatggcggaataatggagcaagccgacgtgccggaagaaggcgattcgcttgttggtggctggggtcgtcgcgctctttcctctgcaaggacttctcctgcgagacgcctaattaatgcgcgtaaattagcttgcacctttcatatggaaaaactgattcaaaagaccgcatcgcattccaagctagaaaaacggaaccatcaagcttatcgagcgcacgcagcaaagaatcaacatggcctttcgcgcacgttgtgccgggccacacgaatcactccatcaccatcgatcacgaaagtcgaacgaatcacaccctcataaaccttgccatacaacttcttctcaccatacgcgccatacaaacgatgcacagtcagatcggcatccgacaacaacggaaacgtcaaatgctgtcgggctactggcgaattgatgccggcgtgattgcttcttacggtttttggacttcgtgccgatataaagcgcgaatagacgtctgttgaggtcggtcggagggctgtgagccatggccggcctcaacgcgttagatggtcgttagaggttagaagacgctgtagccgccgtctacgcgaatgtcagtgccagtaacgtacgaggacgcgtcgctggcgaggaagagcaccgtgctggcaatctcgtcattcgtgccgaaacgatgcatcggcacgacctcgagcatggcgtcgtggccaggcatgtcgatacggccattgaaaattccagaccacacgtatccgggggagatggtgttggaacggatgccatctttggcgagcgctgcggcaaggtaacgtgagtgttccatgatggccgctttggtggcgccatacgcgttcaccggcgtcggacttcccatcatgtagttcgcgttgtgtccggacagggaggctgtgaagatcagtgagccgccatgaccgtgttcgcgcatgatttcatgcgcgatgcggccggtacggtaggtgccgttgaggttgatgttgatggtgcgcgtccatacttcttcggtggcgtcttgatcgtcgcccggtacgttgactccggcgttgaggaacgcgaagtcgacggtgcccagctgttccaccaattgtgttttgagttcggctacttgttcgacattggtgacgtcgcaggtgagcgcgatgacgttggtgccgaaacgttcgctcatgtctttcgccagttcggtgagcttgtcttcttggctgggcaggtcgactagtgcgacgtctgctccggcttgggcgagcgcggccgccgcgttgcgtcctagaccgcctgcggctccggtgacgaagcctttgcggccgcgcattgagaatttgtcgagtatcgagtagtttgaatcctcccatttgtcgaggggataacgttcgtcgaagatttgttcgacggttttctctggaatcttcgatgattcgtctgccatgtttcgctcctttgcgtgatggtgaccgcttttttggatgcgtccgcgcatcatgtttggcgcatctatggaccatgtttgcggttgcctatattcgtgcctgcggtcgttcgacgtccgtgccgaactaatccgagtgtagcaaataaaacgatggcggtgctgtcagtatttgtcaggtaaaacgtagtgagaaaaccgtaaggtcaatataaattgaaaggggagtggtgatgacggatttgaaaatgttttccaagcctgtggtgttcacggatttcgatggggtgctcaacgcttttccggatgacaagcttttgcgcaggggcggcgtgaacaaagttatgacctgggcgaagcccgacagtccctacgcgaaaatgtacaatcctgaaaaagcgttccacttggacggcaacgaaaaagcccacacgcccgtaggctcatggcgcatccactggtccagcgaactgtccgacgccatgtacgcgttggcagttgacggcattgtggaattgtggtggctgtccacctggcagccatactgcagtcagattctcgacccgatgctcggctgggatcccatgctggtcgatgtcatcacctggtacgatcctgtcaccaaatggggacgtgagacaggcaaatggcagaccatccaacgacgcgtacgcatcgaatgcgaagagaatgaacccgcgccgatcgtatggatcgacgatgatgaatgcttcgaacagcgcgcgcagctcttggaggaactccagccgaaagcgccggtgcttatggtccgtccggactatcgtatcggcatcagccgtcgccaatggaaactgatcgatacgttcgtgcaccatcccgaacagttcgacacggtcacgttcgacatggaaccaacctgcaggatatacgacatccaccacggtttctagcctaaatgaattaccatgggaggatagtcgagcggaatgaaggaaggatggggttatggcggaacgtatcgtggaacgtcttatccgagagcgtgatactcgatatggtgacggcatttacacgactacacaaatccagttcgcatggaattccaatcatatggaaggttccacccttactgccaaacagaccgcgcagctatttgccaccggtacctataccacggatggcagcgaacaggtcaatcctgacgatgcgttggaaacccgtaatcatttcgctgcgttccgttggattctcgaccatgctgatgagccggtggaccgggatatggtctgtcacctgcatgccattctcaagcagggcaccagacaggtctccgactcgcttttcaacgtgggcggctacaagactcggccgaactttatcggcaatcctgtcactccgacaaggactgcgctgccgcaggatgttcccgaatttatggacaggctgtttgatatgtgcacgaaacttgaggatgaaccgtatcagatcgcccgtgtccattggacgtttgagaagattcacccattttcggacggcaacggtcgaatcggacggcttatcatgttcaaggagcttttgcgtatcgatgcgttgcctgtccttgtccatgacgcgtatcgtgcggagtacgtcaatggcatcagcaagtttccggacgagccaggatggctggttgatacgcttctattcgaacgggacctttaccggtcgcatgttctgaaaacggatgccgaggcattgcgttatacgtaccatgaccaatggaatatggctgagcatcgggtggaacgagatgaggatctggaattcgccaagctcatcgacacgaaggcccagccgttgttcgatgaggagtatcagcagctcgaacggctcctatggggcgaatagcggtccgactgtgttgttgtggtggttcctccttccaaacgtgacatgaaccgaatgtgcattgagatgtgcaatttgtgcacattgcggtcgccggccgttcaccttggtgtaagaaggaatcagccttcggactttagcatgaggtgcaatggcgcgtattgaatgcgcgcatacgaggaagtgagagctgcatacatgcgtgtattcgacttcgatggaaccatctatgacggggacagccgtttcgatcaacccatgatcgacatggcccgccgtgcctacatggtcaaaggcaacaaaatccaccaagtcaaataatcagaaagcggaatgcggatgaaataccagcaccaacgtcttcataagtcgcttcctcacaacgtctgttctacgatatccgccataataaccccaaccgcaatcgcagacacgaaacgcaaccgttcaacccacggctcaaaaacacaatcaggctttcattcgcttttataatccgaaaccctgcaacgaaacttcgaacctccaagtccaaaacttcgaaaaaagaaagtttcgaacatgcaagccagaaacttcacaccatcattcaacaactaccgcgaaacacgcttcacacacaacaaataaatcaaccaagcaacaggcatcgccaacataaacaccggataaaaccacacagcaggcaaatgcccatacaccaaaccacccacaaacggaccaaccgacatacccaaatcaatacccgcataatacgtactattcgcaataccactgcgctcgcggcctgcgattaccacggcctgcgcctgcgtgactgaactcatcagaccgtagccgacagcggtgaaaatcgcagccaacaacagcatccaatcattgaacaggaacgtcatgcatgcgagcatcgccagcatgcccaacgagcagaccgtcagccagaaacggaagcccttgctgtcgaacaggtcgcgcaagcccagtcgcaacaccaataacgcgaccgcgtaaaacatgaaaaacaggtcggatgataccggcagatgacgagactgaacataactcacgatgaaggactgatttgcgaaatacgctatcgcaaacatcatgaacgtcagcgacaacggcaccacacgcggttccagaatcgaacggatcgaaaaacgatgctttttggttgcgctagcagaaccgtcaatgtctacggcagtggagggattctccgttatggaagtctgctttttgcgtaccggctgtccgccattcttcaccatcagtgtggcgagcagcatgatcaccgccagcaccagcgaactcaaaaacgtcagacgataaccgatgtatttttgcgcgcgaatacccaatgccggtccgaccgccatagccagcgcgttcatcgtgccatacaatcccatgccggcacccatatgccggatcggcagcaaaagcgacatccacgtggccaggcagaccgagcagcatgcgaaaccaacgccgttgatcacgcgagccatgatgagcatgatgggggagtttgcgaaatagtacagcagtccggcggcgaaatagagcaccgtgccaaccgccacaagtgtgcgcttgctggttttgtcggaaagattgcctgcgatagggcggcagaacagtgagatgaaactcatcgacccggccaccgcacccatcagcatgccgtccgcgcccaacgattccgcatatccggcaacgatcggattggcaagcatattgctcgacatgaaacagaacgtcgcaagcatgaccaacgccatatcacgggtgatgagacgatcatgcttacgccggggctgttcgggctggttcgattgttgtgccggttgcttctgtcgtaccgattcagatgcgggtatcgttggtgctgtcatgctcgttcgcctccgagcatgcaactgtagcagccttgacgaaaaacggccgtccacatatcgcggacggccgatggagatggctttaacgatgtgaaagtatgcttcgcttacagagtttttacagagctttggcggcctgctcgacaaaaccttccataccgtcgatgtcaacgacatggtcgaaacgcacgtcggcggtttccaaaccgcgcaacgcggccggagcggtagtgccggtcgcctcggcaagcacgtccatgcattcgaaatccgtgccggaagcatccaaacccaaggactcgttgaccacacgcgggaacttgtacgggctggcggtgctcaacagcacgcgcggcgtcagcggatcgcgaggcatctgctgcatcacgtaatagccgcacgcggtatgcgggtcgatcacataatggttcttgttccaacaatccgcgatcatctcacgcacctgatcctcatcggcccagccagtgccgaacagggaacgaatcttggccagcatcggttcgggaacctcataggcgccccattggttcaaatcgttcatcagcatggcaatcagacgagtgtccttgtcggacatgtaatacagcatgcgctccaggttcgaggagataagaatgtccatcgacggggaaatcgtctgatagaacggacgctgacggttatacgtgccggaagtcaggaaatcgaacagcacattgttcttatcggacgcaacaaccagatgcttgaccggcaagcctaacagcttcgcataatatccggcgagaatatcaccgaaattaccggtcggcaccacaaactcgacctcatcgccaacattgatgacctgctgttcgagcagctgcgcgtaagcggagaaatagtagacgacctgcggcaccaaacgtcccacattaatcgaatttgcggaagacagtaccacatgtgagtcggacgccaagcggtcggcaagctcgcggtcaccgaaaattcgcttgactgcggactgtgcgtcatcgaaattgcccttgactgcgcacacgtttacattcgaaccggcctgtgtgctcatctgcagttcctgtacctggctgaccttgccttccggatagaacacggtgatgcccgtgccctcggcatccgcgaaaccagcgagcgctgccttgccggtatctccggaagtggcggtcacgatcatgattttctcgttgtcgtcgccgccggtcggggtggtgcgtgccatgaaacgcggcaggatctgcaatgcgatgtctttgaatgcggaggtcggtccgttgaatagttccatcacgtagtcatcgccgagcggcttgaccggggtgatcttttcgtcggaccattgcacgccgtatgcctcgctgatgcatgctttgagttcggtttcggtgaagtcgggcagcaacacgctcagcacgtcgaatgcgatctgctggtaggacttgcctgcgagggatgcgatgtccacgtgggtttcgcccagtgagtcggttacgaacaggcctccatcgtcggcgatgcctttgcggatggcctgcttggaggtgagcgaatcggtggtgctgcgggtgctgtggaacgtggtcactggatttccttagcaatagaacggacaataacgtcaaacagtattgagtgtagcgttacgggcgggaagaaacatgcttggcgtccgtggaatgggacgacatgcaatttgcaaatcggcgattgtttccttcttgtttcgtgattacttccatgtttcgaaacgccctattcccccgtatgatttatgcacgtacacttcatcgttaagcccgcatgctcgtacgggcaacgttttatcctccaagccaaggagagctcaatgaccgcgtcgcccctcgcgcaaaccccgaacgacatattcaacgcacccattgccgaagcggaccccgaaatcgccgaagtgcttaacgccgaactgtcccgacagcaaaacggcttggaaatgatcgcctccgaaaacttcgtgccgcgtgccgtgcttcaggctcagggttccgtgctgaccaacaagtatgccgaaggctatccgggacgccgctactatggtggctgcgagcaggttgacaagatcgaaaccattgcccgtgagcgtgccaagagcctgtttggcgccgaatacgtcaacgtgcagcctcactccggcgcacaggccaatgcagccgtctaccaggcgctcgtcaagccgggcgacaccgtgctcggtcttgccctcgatcatggcggacatctcacccacggcatgaaaatcaacttctccggacgtttctaccatgccgaagcctacggagtcaatcctgaaaccttccgcatcgatcctgaaatcatccgccagcgcgcgcttgaaacccacccggccatgatcatcggcggctggagcgcctacccgcgtatcgaagacttcaaggccatgaaggaaatcgccgacgaagtcggagccaagttctgggttgatatggcacacttcgcgggccttgtcgcggccggactgcacccgagcccggtcccgtacgccgatgtcgtatcctccacggctcacaagactcttggcggtccgcgttccggtttcattctcgccaagcaggactatgccaagaagctcaactccgcggtcttcccgggtcagcagggcggtccgctcatgcacgtcatcgcaggcaaggccgtcgcgttcaaggtcgcagcctctccggagttcaaggaccgcatgcagcgcaccctcgacggtgccaagatcctcgccgaacgcctcatgtccgacgatgtcaagaacaacggcatcagcgtcctcaccggcggcaccgacgtccacctcgtcatggttgatctgcgcaacagcgaaatggacggccagcagggcgaagacctcctcgcccagtgcggcatcaccatcaaccgcaacaccgttccgttcgatccgcgtccggcaagcgtggcttccggtctgcgcatcggcaccagcgccctcgccacccgcggcttcggcaacaaggaatacgaagaggtcgccgacatcatcggaaccgcactcgcagcaggcaaggatgccgacgtggaagccctcagggctcgcgtcgacaagctcgccgaagacttcccgctgtatccgggtctcgatcagatccactgattccatgtcgaataacggttgatcgagaacggtttcggatataaatctctgaggacacgtgacgtgcgaaatcgcgccctgtttccgatgctacgacgaaataatggtcgaagctacggaacaaggcgcgatttcgcgctaatctaggaaattatgacgaacccacagacccaatccaacgccatggagcccgatgtgctcaacgaggtgtgcgccaaagccgacgccgcccgaatcgcgcaagcgcaacttgcccaaaccaacacgcagcgtaaaaacgaacttctcaacgccatcgctgacgcactcgacgcgcgcgccaatgaaatcgcggaagccaacgccatcgacatgcagaaatccgccgaacatggcatggacgcaggcaaactcgaccggctcaaatttgacgtaccccgcgtcaacgcagccgcacaaggtgtgcgccacgtagccaccctacaggatccgatcggtgaaatcgtgcgcggataccacctcgacaacggtctgcgactcgaacaaacccgcgtgcccatcggcgtgctcggcatgatctacgaagcacgacccaacgtcaccgtcgacgtcgcgtcactctgcatcaaatcaggcaacgcggcactcctcagaggaggacacgcggccgaacgcaccaacgcagccaccctcaacatcatcgccgacgtattgcacgaacacggatatgatgccgcactcatcgcttccgtcgacgaatacgggcgtcaaggcgccaacgccatgatgcaggcccaaggccacatcgacctgcttattccacgagggggagcgggcctcatccaagccgtcgtgcaaaactccaaagtacccgtcatcgaaaccggagcgggcaacgtacacatctacgtcgaccgaaccggcgaccaaaacaaagccatccccatcattctcaacgccaaaacgcaacgcgtcggcgtctgcaacgccactgaaaaactcctcgtgcacagtgacatcgccgaagcgttccttccgcaaatcgccacagcgcttgccgcagccgacgtcgaagtgcatgccgacgaacaggcctacgagatcatcgacaaaaccggtattgacggggtgaaactgatacatgccactgaggaagactgggataccgagtatctcgcgttgaagatcggcgtcaaagtggtcgactcactcgacgaggccatcagccacattaaccgccactccacagggcataccgaatccattatcgccgaagactattcggccattgaggaattcacctcacgcatcgactcggcggtggtgatggtcaacgcgtccacgcgtttcacagatgggggagtgttcggcttcggcgcggaacttggtatctccacgcaaaaaatgcatgcacgcgggcccatgggactacgcgaaatgaccacgaccaagtggatcggctacggaacaggccaggtacgggcatgaacgaacacaacaataatgacggccagatggaggaaacaatgactgacgctaagaacccatggaatgcggatctcaatgacccctatctgggattgaagctcgcatccgaacgattaagcatcgtacgatacgtgtttctcgtgcagatcgaggacggcatcgcatcggcggcacagcgtgcttcactcgaatacgccgacgcggtgctgatcggttggccggaagtcgatgccgaagacgtggtggaactcgacgaagagaagcttaaaagcgtcgatgagcagatgcggctcatggaacagtacatcgccaaattcagcgccatggagcgcgaacaggatattgacggcatgaccgatacgctgattcgcgtcaccgaacgtgtggcggaagtgcgtcgcgcctatcagccggacttccctctgccgactttcgcggagatcaggcgcgtcgtgcaggacgagtgggatgaggatatgggcaaaatcgacccggacaacgcatcgccaacggcagacagcatcggccgtgagaccgcggacgccgatcaggaacaaaaaaacgaggatgcctcatgaccggcccgaaacgcatgcggcccgaatccgccgaagccgattccgaacttgccatcagctatgtggtggaaccggaacggcgcatgtccgacctttccgtggaatcagcaggttccgcggtggccacaggccgacgttcagcacgcggcaactggcatagcaggcctcgcatcggcatcatgggcggcacgttcgaccccatccacaacggccacttggtggcggcctcagaagtgtcgtgggtgtacgacctcgacgaagtgatcttcgtgccgacgggacgccccgtattcaaactcgacaagaacgtcaccaacgcggaagaccggtatctcatgacggtcatcgccaccgcgtccaatccgaaattcaccgtatcacgcgtggacatcgaccgtccgggagtcacctataccatcgacacgttgcgagacatccgtgcgcaacatcccgacgcggaactcttcttcatcaccggagctgacgcggtcgcggaaatcatgcaatggaaagacgccgacaaaatgtgggatctggcccacttcgtggccgtgacccgccccgggtactcatcgccggaaggggtgaaactgccggaaggcaaggtcgatacgttggaaataccggcactggcgatttcctcgaccgatgtgcggcgacgtgcggagcatggggagcctgtttggtacctcgtaccggacggcgtggtgcaatatattggcaagcacggactgtaccggtaaatttcaggtgaacacgcgcgggtgagacggtctgcgcagatggttaatatgggtcacgtccacttgacgcgaaaacagacgtttggagacatggtgagcgcaatccttgaaggaaagccggataaaaaccttatccttgtcacaggcagaacacatccgaaactggcggcggaagtcgccgaacaacttggcattgatgttctggaaaccacagcatacgacttcgccaacggcgaaatgtacgtgcgctacaccgaatccgtgcgtggcgcggacgtgttcgtactgcaaagccacgcagccccgatcaaccaatcgattatggaacagctcatcatgattgatgcgctcaagcgtgcatccgcgcgttccatcaccgcggtctgcccactgcttggctactcgcgccaagacaagaagcatcgcggccgcgagcccatttcctgccgtctcatgttcgacctgctgaagaccgcaggtgccgaccgcatcatgagtgtcgacctgcatgcggcgcagtcccaaggcttcttcgacggtcctgtcgaccaccttatcgctatgccggtgctggtcgactacattcgcgaccgtttctccaaccagcttgacaatgttgccgtcgtctctccggatgcgggccgcattcgtgttgcggagcagtgggcgcagcgtcttggcggtggtccgctcgcattcgtccacaagacgcgtgacatcacccgtccgaaccaagcggtcgccaaccgagtcgtgggcgatgtcgaaggtaaggactgcgtgctcgtcgacgatctcatcgataccgccggaaccattgccggtgcatgcagcgtgcttaaggatgccggtgccaagtcggtgactgtcgtcgccacacatggcgtgctgtctggtcccgccgtcgaacgtttgaagaacagcggagcccgcgaagtcgtgcttaccgacaccgtgccgattcctgaagagaagcgttgggacggtttgaccgtgctgtcgatcgcgccgctgctggccagcgccatccgtgctgtgttcgaagacggctctgtggctgagttgttcgacacatatccggagcatcacggacagggcttcttgttcgcctgatgacgcgttgtgcgggcatgcttagcgtacgttccgcatgtttgtggggtaactcccatatcagtgaagcgagtaccgttgtttaaggtgcgcataacactttttgtgcaccttaaacaacgtttttaattagtgcgacacgtcgagacacgcggtgttggcgacatgtggcataatagacacttggcggtaaccgcaaggttttccgccattcccccatggtgtaatggcagcacacgggtctttggaaccctttgtcttggttcgagtccaggtgggggagcccattctcagacggctctgcggcgaatgccgcagagccaattttttttatttttcttgagcgcacttagaggagtgtatgcccggtaacataactttatgtgagcatatacgaacaaacatgatcattatctttcagtgaaggctaatgccgttcatttttactaagcgtttttgagacgaacttagggtttttcgccaaagaaggattctctttgctttttcaacgatatgccaccttttttgtaatgttttaggggtataaaatttatctttagggtgttctaaagtgtttgaaatatctgaagttatccacttatccacaagaatcaaatgtcaacttgacgggggatggcttttgtgccttaatggttcttacaccccctctcaacgatgagtcgggcgaataagaaagggattcatcatggatgattcatgtgaaaatgatgttccgccgccggaggctaacgagcccttctcggaggttccaccttctgaccagggatcagcggccaatgcgaagcgcgctgataaaagtgggaagaaacgcgagggagaaaacctgacagagtgggaaaggatatctcttgagcttggcagaaagccggttttcgattacgataaaacgcttccctcgtatgatgggtttcttaattcagatcttttcggcaggaaaataccattccattacatccagataatgcctgggccgtgcgatgctgaatttgcctactccatgaacatgttcgcggcgcagttgatctgcaatgttgtcgatatcttccgtggcaggcagaaagaagcacgcgtggaaagggtattgagcgaggcctgcatgagaaagctgagaaatgcctccgctcagatcgcagcacagatgaagaaggatgtgaggatatacgcgcagttgggtctgcttccgatcaccgtatattacgttgacagctggttggtctctccgacatgcttcgaaagcaccgtgctgatgggcattggaggacgaaggctgtgcagcaatttgaagtgcgtcctcaagggatctgcttggaagtgcgaagtcgctgatttcggcgtgtgacgtataacaagtaaccattcaaaacccttggaattggctgaattcagccgttttcaagggttttcagcgtgccttgagcatactgcaactactatagggactcatgttgagagaatttgtaccggaacctgcgtatagcactacggatgaggataccgttttcgcactgctctccagacgcgctaaacgtgatcctgatgatctcatcgcccaatggcaggacgacgagactcgtcgatggcatgacgttacggcgggggagatgcttgagcgtgtgcgcgcggttgcgaaaggtcttcttggcctaggggtcaaggccggaagcatggtagtcatctattcgcctacctgctacgaatggggagtcatcgattttgcctgcgccgcaatcggcgcggtaagcgtgcccgtgtatgaaaccgattccgccaggcaggccgcgtccatcatcgaagaggtggatccgatcatcgcctttgccggtgatttcgcgcatacacaaacgcttgaacagattcgcgatgagcacagcagcctgcgctacgtcttcaacttcaaggcggatggtcttgatgccgttgctgattttggagaaggtgtcggcgaggacacgctcgatcaggtgatttccagggtcaaggccgatgacatgctcaccattgtgtacacgtctggttccactggcaagcccaagggagcgatgctgtctcaccggaatttcacgcatatcgtgctgaacggctacatcattctcgatgaaatgctatatcagccgaatcgtctgatgttgttcctgccgttggcgcactgcttcgctcgctatattcagtatgttgcgattggcgggcagggggtggtcggctatctgcccggagccaagcatctgcttgccgatctgcgtagcttcaagccgacctatctgctgggagttccccgtgtgttcgagaaagtgtataacgcggcttcgcaaaaggccggagcgggtattcgtggaagagtgttcgccaaggctttcgatcattttgtgcaatggtcgaaggacgagcaggaaaccggacgccattccattgtggctcgtgccgaacattcgttctttatgtctgtcataggcaaatccattcgttctgctttgggtccgaacatgagatatctggcttgtggcggcgctcctttgaacgtcgatctcgcccatttcttcaacggtatggatggcattaccttcattcagggctatggcatgacggaaaccgccgctcccatgattgtcaactggcaggacgccaaccgcgtcggttccgtaggcaagcccgggccgggcatgggcgtgcgcaccgatgacgacggcgaactgcaggtgatgggccccaacgtgttccttggctactacaagaagccggagctgacagccgatgtcaagatggctgatggctggctgaagaccggcgatttgggaaccatcgacgacgacggattcgtgtacattacgggtcgcaagaaggatatcatcattacggccggcggtaagaacgtcagtccggcacctatggaagatgtcatcaacacttgcccgatcgtgtcgcatggtgtggtggtcggtgatggcaagccgttcatcggagctttgattgagcttgatcaggagatggttcgttcctggcttgcacagcagggacttgatagcaacatgcccatggagcagatcgcgaagaacgatgccgtgcgcgcattcattcagcagtatgtcgaaaaggcgaatgcgaatgtctctcgtgctgaatccgttcgcaagttcgaaatcctcgacgaggagttcagccaggagaagggcactctgacggcgagcctgaaagttgtcaggccgaaggtgcttaagcggtacgaaaatgtcatcgacaatgtgctgtatgcgccgaagccatccaacaaaccgctgccaaagacggtgcagattcttgaccgaaccaccgaaacggtcaagcaggcttccgaatccatgcgtcaggcttccgaatccgtaagtccgaaggttcggcaggcatttgataccatgcaggagaaaattaagaagcagaccgaagacgccggcgagttccaaacgccggaagactcatcggaaactgaggaaacaaccatgaacgaggagcgataatcttggcaattcgtgagattcgagtcgtacctgatccggtgctacgtaccccctgtgatcctatcaaggaaattacgccggccgtgcgtcatctggtacaggatctgcttgataccgttgacgatccaggaagggctggcttgtcagctaatcagattggcgtgaatctgagggcattttcctataacatcaacggcaagatcgggtatgtgctcaaccctgtcctcgaagagaccagcggtgaacaatacggagatgagggatgcctgtctgtgccgggattgtggtacaagacccgtcgcgctgattacgctcgtgtgcgtggcatcgatttggaaggcaagacggtcgtgctggaaggtcatggcattatgggccgcatgttgcagcatgaaaccgatcacttgaacggtcatgtctatcttgatcgtttggagaaagaggaacgccgagaggcgatgcgctacatgcgcaatcaccacaagtgattgttcgcatctcaccgatatgacgacttggggtcacgtctttgcgaaaagacgtgaccccatggtattttatgccttgtgtgccatccggcgaagggctttgtcgtgaaagtcctgagccacccaatattgtcaaccggcatacaaccaattcgcgtcatgttcgcgacgacctgtgtcggtcggccgacgccgcaaggctttggctgcacgcaggaacgcatgaccaggcaagaaccgacagaaagaggtagtaataccatggctcagatcaatatgagcgacatgctgaaggcaggcctgcacttcggccaccagacccgtcgttggaatccgaagatgaagcagttcatcctcacccagcgcaacggcatccacatcatcaacctgttcaagtcgctcgacatgatcgacaaggcctacgacttcatcaaggctaccgtcgctcacaacggcaccgtgctgttcgtcggcaccaagaagcaggctcaggaagccgtttccaatcaggctgtccgcgtgaacatgccgtacgtttccgagcgttggctcggcggtatgctgaccaacttccagaccgtgtccaagcgcgtctcccgtctcaaggaactcgaagagatggacttcaccgacgtgcgtggttccggtctgaccaagaaggaactgctgcttctcgagcgcgagaaggacaagctggctaagcagctgggcggtatccgcaacatgaaccgtactccgtccgccatgttcgtggttgacgttaacaaggaagctttggccgttgaggaagctcacaagctgggcattccggtcgttgccatcgtcgacaccaacgctgatccggagtccgtcgagtacccgatcgcagccaacgatgacgccatccgcggcatcgaactgctgaccagcctcatggctgacgcagtggccgaaggcctgctggagcgttccggcaaggccgctaaggctgagggcgagaccgagcagccgatggccgcttgggagaaggagctcctcactgagggcgctccggccgccgatgcaccggctgaagccgaagccgaagctgaaggcgaagccaaggctgagtgaaaatatccactatgatgggaggtgttgtgcctcccatcatatggggcatcactatttttcagaggagacaaatcaatggcagcaatcactgcagctctgatcaagcaggtgcgcgaggaaactggcgccggcatgatggacgttaagaaggctctgaccgaggctgagggtgacgtggctcgcgccaaggaaatcatccgcgccaagggcatccaggccgctggcaagcgcgaaggtcgcaaggctcaggaaggcaccatcgcctcccaggtcgtggaatccgccaatggccagaccggttacgccgtcgaactgaattccgagaccgacttcgtggccaagactccgaagttcgtggagttcgctgacagcgtgctcgaagacgccgtcaaagccgaggccgcttctgtggacgaagtgctggcagccgcttccggcgaagccaccgtgaaggaagccgtcgaagaggcggccgctctgttcggtgagcacgtcaaggtcggccagttcgccaaggtcgagggtccacacgttgagatctacgcccacaagaagtccgctgagatgccgccgagcatcgtggccatgatcgccaccgatgaggccggcgctgctgtggctcacgaagccgctctgcagatttccgcaatgggtgcccagtggctgacccgcgaggacgttccggccgatgtggtcgagtccgagcgccgcgtggccaccgagaagtccttggccgaaggcaagccggagaagatcgttccgaagatcgtggaaggccgtctcaatgccttctacaaggagaacgtcctgctcgagcagtcctatgtcaaggatccgtccaagaccgttggcgacctgttcaaggaagtcggcggcgcagccgtggctttcgctcgtgtcgaggtcggcaagggcgaggctgagtgaattcggcttcaatggtgaatccgtgcgttagacgctagagattccatgaggttggccatcatccacagggtgatggccaactttgttttcttctcgacgctgtgtcgttgcggtgtggtgtctgtgtttgccgatactcttgagagcggtaaatttcgtgagttctcgggcaagaaaggcttttcatgactggcgaaaacactggtgataatccacgcagagtgctgctcaaactatccggagaggcgtttggcggcggcaaagtcggcattgacacgtccgtcatccgccgtatcgctgaggaaatcgttcccgcggtgcagcagggcgttcaggtcgccatcgtcgtcggaggcggcaacttcttccgcggcgcggaacttcaacaggctggaatcgaccgctcccgcggcgattatatgggcatgctgggcacggtgatgaattgcctcgctctgcaggacttcttggagcaggagggacaggccacgcgcgtgcagaccgccatcaccatgggtcaggtcgccgagccgtacattccgctcaaggccattcgtcatctggagaagggccgtgtcgtgattttcggcgctggtgccggtatgccgtatttctccactgacactgtgtccattcagcgttctttggaaatccattgcgatgaggtgctgatgggcaagaacggcgtggacggcgtttataccgccgatcctcgtaaggacgagaacgccaagcgtttcgccacattgagctataatcgtgccctcgtcgacaatctcgccgttatggatgcatccgcgctttccatggcccgcgacaacaagcagcgcatccgtgttttcgggctcgaaggcaatggcaatgtgacccgcgcccttctcggtgaggaaatcggaactatggtttccaccgcggagtccacactcgctgaataacgacattcaacgtcgaatatcgatcaaacaaccaacaacaaggagtacaaatggcaactattgtcgaacaggccaaggcacagatggccaagtccgtggaatccaccaaggagaacttctccggcattcgtaccggccgcgcgaatccggcgctgctcaacggtatcaccgttgattattatggagctccgaccccgctgaaggccatcgccaccatcggcgtgccggaaccgcgtaccctgtccgtcactccgtttgacgcgtcccaggccaatgccgtcgagaaggcgttgcgtgattccgatctgggcgccagcccgcgtcgcgacggcaacgtcattcgcctgaccatgccggagctgaccgaggaacgtcgcaaggaatatgtcaaactcgccaagggcaaggcggaagatggcaaggtcgcagtgcgcaacatccgacgcaaggccaaggaatcccttgacaaggccatcaaggacggcgagatgggtgaggacgagggcgatcgtctgctcaaggagctcgacaagatcaccaagcagaccactgatgaacttgataccctgctcgaagccaagcagaaggagatcatggaggtctgagagacctttatctcctgaaaagaatcgacgcacagccagacagggaacatgatggaacatcaggaacagctcgaaaaagaaaccgaagaggccatcaacgccatcaacaagaagacggggcgtaatatgccgcaggccatcgccacaggggcggtgctcgtcatcctcatcttggcgtgtctgctgatcagcattgacttgttcgtctatctggttgtgctgttcatggtgcttgccctttgggagctgcgcgtcgatttcgccactgcgggacttcatattcccgtggcggtgttgtgggtatgttcggcggcgacgttgctgtccacctattacagcgaacgtcatatcgtcgccatgacggtatgcgtgctggtgtctttggtggtcgtagcgatcgccgccagcgctaaagtgacgttcggcagccgcatctctctggccgtggcggataagctttcccacaccgatgcaggcgcaagacttgaatcctccttcaaccatgagcagggagaggtaagccatagcaggctgagccatgtcgcggtctccatgttcaccgtgctgtacattccgcttctggcttcctgcctcatcatgccgttgacattcaatgatcatcccgtcgcgcatgctattatgatggtattcatgcccgcgttgagcgataccggtggtttgttcgccggggcatggctgggcaagcacaagctaagcccccgcatttcgccgaagaaatcgtgggagggtcttgcaggttccattctgttctccatgatcggatcttttgccgtgatgttctgcacgtacgggtcggatgtgtggatttcccgctggtgggtccctgtcgtggccggtttcatgatcggcatcgccggaacgtttggcgatttgtgcgcatccatgttgaagcgagatatcggcatcaaggacatgggacacctgcttaagggacacggtggcgtgatggatcgtgtggattccattctgctgtgcgcgccgttcgtgtgcgtgctgctgtgggcaactggaatgtgagaaaggcaaacacaagcatgagcgactccgtgaattccacgaaggatttgccggaaaccggtattactccaggaggcactaccggtgccttccgcgacgtgctttccaaagatcatgcgcgtcgaggcaagccgccgctgcattttgctgatatgactgaagacgaacgtatcgcgaaagccaaggatcttggacttccgaaattcagagtcaagcagcttgccaatcattactatgggcatttcgacgtcgctgccgaagagttctctgactttcctgcagcgaaacgagccgaagccgcagaggcgtttttcccaacgctcattaccgaagtgacccgtcaagtggccgatgagggcactactatcaaaacgctatggcgtctgttcgacggttctcttattgagtccgtgctcatgcggtatcccacccgcaccaccttatgcatttccagccaggtaggctgtggaatgggctgcccgttctgtgccacaggtcaattgggtctgacgagaaacatgtcggcaggcgagattctggaacaggttcgtgtggccgcgaaagccatgcacgacggcgaagtcgctggtggtctcgggcgcctgagcaacatcgtgttcatgggcatgggcgaacctatgggcaattacaagtccgtattgagcgctgtacgccaaatcagcgccatgccacctgaaggtttcggcatttcggcacgcaacatcaccgtctccacggtcggtgtggtaccaggtatcaagaaactcacggcagaaggcattccggtgcgtttggccgtgtccttgcacgctccgagcgatgagttgcgagacgagctcgttccaatgaacaagcgtttcaatactacgcaggtgcttgatgcggcacatgactattacttggcttcgaaacgtcgcgtaagcatcgaatatgctctgatgcgcggtatcaatgatcaagccgagcatgccaaattacttgctaagcgattgaaccattacggtgacaattgggctcatgtcaatccgattccgctcaatcccatcgaaggatcgaaatggaccgcttcgaagcctgaggatgaacagcagttccttgatatccttcataaagcaggcattactgcgacgttgcgagacacgcgcgggcaggatatcgatggtgcatgcgggcagctcgcagctaaggaacaagattagatttcaaggaaagatgcttgttctgtccgctactcggacttccgacgaacatgcgtaacgtaaaacggttactcttgcattcgttgcacacatgattatgcgcgaaggagtaaaacagcatgtcactggcagtccgagtcattccatgtcttgatgttgatgcgggacgagtagtcaagggcgtgcatttcgagaatcttcgcgatgccggcgatccggttgaacttgccgcggaatactaccgtcagggtgccgacgaactgactttcctcgatgtgaccgcttcgagctcgcatcggcagaccatggtcgatgtggtgagtcgaactgccgaacagattttcatcccattgaccgtgggtggaggcgtacgtgcccctgaagatgtggattctctgctgcgttgcggagctgacaaggtaggagtcaacactgcggccatcaatgatccgacgctgattggccgtgtcgcagaacgattcggcaaccaagtgctcgtattatccgtcgatgcacgccgtgagcagggcgagcgacacactcagtcgggctttgaagtaaccaccatgggaggccgcaaatccaccggcattgacgctatctggtgggtcaagcgtgctcaggagttgggcgcgggggagatcctgctgaattccatggacgcggatggtacccaacagggttttgacttggaaatgattaaagccgtgcgtaaggaagtgaagattccgatcatcgcttccggaggtgcgggcaaggctgccgatttcccctcggcgatcgaagccggagcggatgccgtgttggccgcgtcgatcttccattacggcaaagtcaccatcggcgaagtcaaggatgccatcaaggccgccggctataccgtgcgatgaaagccgaaaaccgcaaaacaggcgaataacgtaatcaataatcgaagaaacaaatcaataacaccatcatgaccaacgaagcatacgacaacagcactattcttgacccacgaatcgcagaacgtctcaagagggacgataaaggactggtggcagccgtcatccagcaattcgacaccaaagaagtgctgatggtcggctacatgaacgacgaagccatacgacgcaccctgatgactggtcgcgtcacgttctggtcgaggtccaggcaggagtactggcgcaagggagacacttccggacatgcccagtatgtgaagtccttcgcactggattgcgatggggatgccattctggttgaagtcgatcaagtgggagcggcctgccataccggcaaacgatcctgcttcgaagaaggcgggcaactgcccgtggtcgtaggataccgtaccaaggaacaggagggccagcgatgagtgaatgcagcgtacaagcactcaagtggggcgccacctggccgagtcgcgaacaattccacgaattggctgatcagggatatcgtgtgattccgattgtgcgccgacttctggctgattcgttgactcctgtcggattctatgaacgccttgctgcaggacgttccggcacattcattcttgaatccgcggaatttggcggcacgtggaacagatacagcttcatcggtgtgaattccatggctcagttgcgttccaacaacggcaaggccgattggttgggtcaggttcccgcaggcgtgcctaccgaaggcgatgtgatggaagtcgcgcatgctgcgctgaaaacactgaaagcgccgcatgtcgaaggactgccgaacctgaccagtggtctggtcggtaccgtcggttgggatgcgattcgccattgggaaccgaccttgcgtgccgaggcaccgaacgagaccgggcagccggaaacagttctggcattggccacggatattgctgtggtcgaccatgtgtccggatcggtatggatgatcgccaatgcggtgaacgtagacgatcgatccacccgtgccgatgcggcatacgacgaggcggtggcgcgattggatgatatgcagcgtaaggccgccacgcctgtcgaaggtgaagctcgcgtcaatgtgttggatgagaccattagccagcccgagcttcgtttccgtacggagaagagcgattatgagcgttccgttgaaatcgccaagcagcacatcatcgatggtgacgtgttccaggtggtcatttcccagcgtcttgacattgattcgccagccgatccattcgacgtgtaccgcgtgcttcgtacgctcaaccccagcccatacatgtatttcatgtcgttgaccgatgcgcaggggcgtgacttcaacgttattggatccagcccggaaacgctgatcaaagtggacaatggccatgccatgaccttcccgattgccggttcgaggcctcgtggcaccactattgaggaagacgagcaacttgccaaggatctgcttgccgatccaaaagaacgtagcgaacacatcatgctcgttgatctttcccgcaatgatctgagccgtgtatgtcttccggaaagcgtggaagtcgtatccttgatggatatcaaacgattcagccacattatgcacatctgttcgaccgttaccgggcgagttaaccccgacatgacgtcgttcgatgtgttcacgtcggcattcccagccgggacgctttccggtgcgccaaaaccacgtgccattgaaatcatcgacgagcttgagcccgcagatcgtggcatttatggcggcactgtcggctatttcgatttttcaggcaacctcgatatggcaatcgccattcgaacggcattcatccgcgaccatgaagcgagcgtgcaggccggagccggaatcgtacttgattccgtgccggccagtgagtggcaggagactcgcaacaaggccgaggccagcgtcgaagcggtgcagatcgcctcgcagcttcgccagttgtgagtcaaatcaagctaaccaatcgagtaaaatgctgaaaggaacaccatgtctgtactcgatgaactggtggcgggagctgtcgaagaccaacgagcacgtgaacagaacatttcccttgatgaggtgaagcgtcagacattcgaagcgccggcccctattgatgcgcgacagtggctgaaaaaagcggatggcattccggtgatcgcggagattaaaagggcttcgccatcgaaagggcaccttagcgacattcctgatcctgccgcattggccagggaatacgaaaaaggaggtgccagcgcgatttccgtgctgaccgaaggtcgtcgattccttggatcgcttgatgatttcgataaggtccgtgcagccgtgaaaattccagtgttgcgcaaggatttcattgtcacggaataccagatttgggaggcacgggcgcatggcgccgatttggtgctgctgattgttgccgcgttggatgacgacaagctcaagtctttgctcgaactggcgcatagcctcaatatgacggtgctggtcgaaacgcacactcgcgaggagattcagcgcgcgatcaatgccggagcgcgagtcatcggcatcaatgcacgaaatctcaaggatctcaaggtcgatgtgaacaaatacaacgagcttgccgccgatttgccggacgatgtgatccgcgtagcggaatctggagtgttcggatcggtggaacttgaggattatgcccgcgccggagccgacgcggtgctggttggcgaaggtgtcgcaaccgcatccaaccatgaacaggctgtggagcgactagtaaaggcaggagcaagagtgaaagcatccgaacaaaccccgttggcaagtcatgaaggaccgtatttcggtcagttcggtggacgctatgtgccggaagcgctgattacagcgcttgacgagcttgaacgtgtctacgaggaagccaaggctgatccggaatttcataaggaactggctcgattgaaccagcagtatgtcggtcgtccgtcaccgttgaccgatgcgccgcgctttgccgagcgtctgagggaaaagactggtcttgacgcccgcgtgttcctcaagcgtgaggatttaaaccacactggcgcgcacaagatcaacaatgcactcggtcaggccctgctggtcaagcgcatgggcaagactcgggtcattgctgaaaccggtgcaggtcagcacggtgtcgccaccgctacggtgtgcgccatgcttggactgaagtgccgtatctacatgggccaaatcgatgcgcgtcgtcaggccctgaacgttgcacgtatgcgcatgcttggtgcggaagtcgtggaagtcaccttgggcgatcacatccttaaggacgccatcaacgaggctcttcgtgactgggttaccaatgtaaaagacactcactacctgctgggcactgttgccggtccgcatccattcccggctatggtgcgcgatttccagaagatcatcggcgaggaagctaagcagcagcttcaggattggtatggtatcgatcacccggatgcggtttgtgcatgcgtcggtggcggttccaatgccatcggcatcatgaatgcgttccttgatgacgaacgcgtgaacctgtacggctatgaggcaggcggcaatggtccggaatccggacgccatgccattcgcttcgcaccgggaaccggtgaactgggtatgttccaaggtgccaagagctatcttcttgagaattccgaaggccagaccctcgatacgtattccatctccgctggtttggactacgcctctgtgggcccggagcacgcatggctcaaggaaatcggacgtgtcaattattcttgggcgaccgatgaggaagccatgagcgctttcaaggatctctgcgagaccgaaggcattattccggcgatcgaaagttcccatgccgttgcaggcgcatacaaggcggctgaggatctcaaggccaagggatatgagcatccggtcatgatcatcaacatttccggtcgtggggacaaggatatgaacactgccggcaaatggttcggttatctgaccgacgagcaagccaaagcgctcgaagccaatggagcccagggcaataacgcggacggcgagtgaaagaaggagtatccattatgacgaacgcaacagtaaccacgccgtccgggcagcctctcggcatcagccataagccgagtccgacggaagccatgttcgatgaattcaaagcggcgaacaagcctgcattcatcggttatcttccatatggattccctgattctgactattcgttgaaagcattccgcaccatggttgagcatggcgtcgatgccgtcgagattggtctgccgtattccgatccggttatggatggtcccgtcatccaagcggcttcgcagatcgccattgacaacggcgagaaaatcgcgaacgtgttcaaagccgtcgaaaccgtggccaacgccgggggagtccctctggtgatgagctattggaacctcatctaccattacggcgtggaacgtttcgcacgcaattttgaaaatgccggtggcgccggcctgattactccggatctcattccagacgaggcaggtgaatggatcgaagcttcggaccgtcatggacttgaccgaatcttcctcgtgtccccggactccaccgacagccgtttgaaggtcgtggcaggcaacgctcgcggcttcgtctatgcggcagcccgtatgggcgtcactggcgaacgttccaccatcgatgcttctccggaagagttggtggcacgcacgcgcaatgccggcgcgaagaacgtctgcgttggcatcggcgtttccaccgccgaacaaggcgcgcgagtcggctcatacgctgatggcgtcatcgtcggatccgcattggtgcacaccatgcttgacgaatccgggaaaaacgcagtcgatgaggccacgggtctcaaggcgttggccgccaaagccgaagagcttgcggacggcgtccataacgcgcgtgtcgcaaagtaaaccattctgacgatttcggtggtccacgcaccatatcggatgcgtggactaccatcaggaaaccatgacacttgcatacattccatcgccaacgatttcgcagttttccatcggtccagtaacgattcatatctatgcgttgtgcattttgatgggaatcgtccttgcagtatggataaccaccacacgttggaaaaagttgggtggcaatttcgaccaagtgcttgatatcactctggtcagcgtgcctgcgggcattatcggcgcacgactttatcacatcatcaccacgcctgaacgtttcttcggaccggatggcgactgggcggaaatgttccgcatttggaatggcggacttggcatctggggcggcgtgctgttcggagcgctggccgcatgggcatggtgccgtcataagcactatccaatggccttgctggctgacgccatcgctccgggcctgttggtagcgcaggctgttgggcgtttgggcaactggttcaaccaggaactgtatggcgctccgacaacgcttccatggggtttgaaactcaacatggaaggcactgccatcgggcatagcgaacagtgctatgacggagccacatgcccgagtggcacgctgttccatccgacgttcttgtacgagatgatctggaacctcatcggcgccgcgattatcgtatacatcggttccaaagccatgaagaaactcaaggcaggttccctgtttgccgtgtacatcatgtggtacaccctgggacgcacttggattgaatccctgcgtatcgattatgcgcacgaattcttgggcgtgcgcatcaatgtgtgggtctccatggcggtgttcgtgctcggcgcggtgtcattcatcgtcgtgcagcaaatgggcaaagacactgacctgttggcggagaagcttcgtaccgtcaccgaaatcgagcagcgtcttgaaaacggtgaatcggaggattcttcggattccgtggtgtctttccccgagcaaacggttgatgaaatcaaaaccaacgatgccgaaactgtctcgaataccgacaagcagcccggcatcaaataacagcaagtcgattacctttcatagaataagagccatgactattcaaatcgcaccaagcatcctgtccgctgatttctgcaaccttgagcgcgacctcaaggccatctccaatgcagatctcgttcacgtcgacgtgatggatcatcatttcgttccgaatctgaccttgggcgagccgattgtggctcgtatctgcgaagtcaccgatcttccggtcgacgtgcatctgatgatcgaggacccggatcgttgggcacccgaatatgccaagttgggcgctgcatccgtaagcttccacatgggggcaacccacgctccggtgcgtctggcgcgccagctgcgcgagatgggttgcaaggcttgcttcgcggtgcgtccggccgaacctgtcgagccgattttcgatattctcgacgaattcgacatgattcttatcatgaccgtcgagcccggcttcggtggacagaagttccttgacaaccagatggccaaggtacgtcgtctgcgtgacgagattacccgtcgcggcctcgccaccaagattcaggtcgatggcggtgtcagcccgaagaccgcgcacattgtagccgaggccggtgccgacgtactggtcgcaggttccgccgtgtatggtgccgaggatcctgcggaagccattgattccatccgtgagaaggctgaagccgcattcaaggcctgaacctaccaatatttcgaggatagatacgaataatgaagacttttgaatccctctttgctgaattgagcgagaaggccgcagccaagcaggctggctcgttgactgtcgacgaactgggcaagggcacgcatttcatcggcaagaagattgtcgaagaggcgggcgaaacctggatcgcagctgagtacgaaggcgccgatcgtactgcggaagagatgagccagctcatctaccatctgcaggtcatgatgatcgaccgaggcatcacactcgaagacatctacaagaatctgtgagtttttggccgtgccataggaggcgtggcctttttgggagggaaaatgctgagaatcgccgtgcccaacaagggcatgctgtccgaacctgcatggaacatgctggccgaggccggctatcgcctgaggagcaatccgcgtcagctggttgtggaggatcccgacaatgacgtggagctgttctacctgcgtccgctcgatatcgctgtctacgttggccgaggcaccatcgacgtcggcattaccggtcatgatctgctgctcaactccggtacggatgccaaggagcatatggagcttggctttggcgcttcaacgttccgttttgcagcccccaatgattctccgattagcaagctcgaagatatcgaaggcaagcgcgtcgccaccagtttcgacaagcttgtgcatgattatctggctgagcatggcatcaacgctgaaaccgtacaccttgatggtgccgtcgaatcgtcagtgcaactcggtgtggctgatttgatcgccgacgtggtatccacgggcaccacgctccgtaacgccggcctgcgtattttcgcggaaccgctgttgcattctgaagctgtgctcattcgttccccgcgtcttgctgaagatgatgatcgtttgacgattcttagccgtcgtctgcagggcgtgctcactgctcagcgttacgtgctcatggattacgatattccagtcgagaaggtttccgcggctgtggacatcacgcctggattcgaaagcccgacggtttccccgcttcatgacaagcagtgggcggccgtgcgtgtcgttgtgccgaaggccaaggtcaaccaactcatggaccagttgtatgaagttggtgctcgtggcataatcgtcaccgctttgcaggcctcgagaatgtaatattgctcgaagtatgagcaaactgattatcaaaaaacagtacagtccggaaccgcgggatatctatttcacggttccgaaccttatcagcctgttgcgaatcatttcgattcccttcatctcggtattggtctctcgccatgagatggtgcttgcattgattgtgcttgcgctgtcggcggtgtccgatggcttggatggtctgattgcacgctcgttcaatcaggtgagcaaaatcgggcagatcctcgatcctattgcagacagattattgattttctgcagtattctcgcgcttggagtcgctgacatcattccatggtggatgctgatcgtcgtcggattgcgagatttgatcatggcgattcttgtactggttttggcgcagcgtgattacggtccgctgccggtgcatttcgttggaaaagcaggcaccgccatgctgatgattgccattgtcgccttgattttcgcagatatctggtctaattcggctacggatactttgcatttgtgtggtctcgccaccggcatatggggtgtgggattgtactggcttgccggctatatttacatacgtcagggaatccagcttctgaagaacgataaggattgactcacatgatgcatgatgctccggaacgtgcgtcgttcccggtgtctccggagaatacgcctacgaagcggcgcgccgttttctcggcgtccttcgccgggctgacttcgcatcatgtgcagcctgatatcgtgacatccacttcgcgcagaaggcggaatctggatgatgactcattgcggcttattgacgatttgaccaatcgtccgatggacgtgatgtacacggactcgaggttggccaccaaaactccgtcattgttttcggtctggttcacccgggttttggtattccttatctgcattgccgtaggcacggcgggaagcgtgttcgtccgacagctgagtaccgatccacgtaaggaagtacgcaagcaactgtcaagtcagttatctgatcaaacgaaaaacgtcgaaaccctcaccaaagacgtgaacgcgctgcgagcccgggttgaggaggaatcgaaatccgtgtcgaactggtctctgaaccagaccatacaggatgacgaaatggtcaatggcgtacttcctgtgcaaggcgaaggcatcacgctcaccatcgccaatccaatatcggtgagcggagacaacgcggattcgtcactgccaagggaaaacggcagccaagtccgtgtggtcacggattccgatctgcaggtgcttgtctcgctgctttggcagtccggtgcggaggcgatcgccattaacgggtatcgtctcggtgtgcagacttccatacgaacggcagggacgacgatccttatcggcgtcaattccgtgcaaagcccctatcgcatcgaggcgatcggcaattccagtgcgcttgccaatgcggtgagcaagaaaacgcaaaaacgtttgtacgatgatttcaaagaagccggtatctatccgcaggtgagcagaagcaaatcgattacgctggaagcggcggtgaccggcgaagtgacatatgcaaggaaggtcaagtaatggcagcggtcttgggacttatcataggcgtggtcattggcgtgttcgtccggccggacattcccattgcgcttcagccgtatctgccgattatggtgctggcggcgctcgatgcgctgctcggtgccgcccgagcctattttcagcgtagcttttccgataaggtcttcgtgatttccttcttctcgaatgttattacggcaacattgttggttttcctaggcaaccagcttggcgtcggttcccagctgcagactgcggtcatcgtcgtgctcggcattcgaatcttcaccaatgtgtcatccatccgacgtttcatcttcaagggatgacggcgtatgagcagacgcaacgatgccaacaaggatgtactctccaagatccacgagcagatcgtcaaagaccaaaacaacgacagcacccaaaccggatcgtttcctgtggtcaggcgcaaaccgaagagggtttcgctgaatgcgaaggccactcgcgcgcgcctgtattcaagcgtgctcgtaaccgtgctttgcgcgttgctgggcttcagctacgctatccagctgaacaacacgacctccacatatgagacgatgagcgaggacgagctgaccaagcttattagcgaaacgagtacgcaggtgcaaaagctcgaacagcgtaaaagcgaactatccaatcagcttgactctctgaaggataccgccgacaagaacgagaaggcagcggaaatcgccaggcagaacgctgaatcgaatggcattctttccgggcgtttaccagtatccggcgaaggcgtggtcatccgtatttctaaaggatcaaagcgagatattgacgcgtcgattttattcaccctacttgaggaactacgcaatagcggcgcggaagtcattgaaatcaacgatattcgcgtgattaccagtacatacatcagcgatacggcggacggtctcgattgcgacggtacgaatatcaaggcgccgttcatcatcagggcgattggagacagcgacaatctgcagaacgcggtcaatctcgctggaggcgtcggttcacgtttgaaagtgaaatacggagccaccgtgtcgatcgtgccatccgataaggtggagatcacgtcgacacgaagcgcgccacaatacacgtacgcgcatgtcgtcgaatagcatcaaatacgatccgttaaaatataatcgcgctgtagcatgctgttcactctttcagcgtgccgatgtctgcactcaaccctatcttgttcatcgttgacatacagtccaggcctgcacattagtaccgcggaccccgatagcaaaggacaactcatggctgaacagaccatctccattacactcaacggcgaagcgaaggaggtggcagcagatcagactggcgtccagctcttcgcggaagacaagaatatcatcgcagtgcgtcttaacggcgaaccccgcgacctgtataccggactgcacgacggcgacgtcgtggaaccgattgcattggacagcgaagatggcctggccatcatgcgtcactccgcaacccacgttatggcacaggccgtgcaggagatccgtcctgatgccaagctcggcgtcggcccggtcatcaaagacggtttctattacgatttcgatgtcgagactccgttcactcctgacgatcttaaagagatcgaaaagcgcatgcagcgcattatcaagtcctcccagtccttccgccgctgcgtggtgaccgaagaggaggctctggcagaagagtccgatcagccgtacaagattgaactcatcaaagacaaggaagcccacctcgatccagaagccgccaccgaaatcagcggcaaggaactgagcttctacgacaacgtcgaccgtgacggcaatgtggtgtggaaggatctgtgccgcggaccgcacctgccgaacactcgctatatcaaggcgttcaagatcgagcgttctgcagccgcatactggcgcggaagcgaagccaatccgatgctgcagcgcatctatggcgcggctttcgccactaaggaggacctcaaggcatatcaaacccgccttgaggaggccgccaagcgtgaccaccgcaagctcggcgcggaaatggatctgttctccttcccggacgagatcggtccgggcttggctgtgttccatccgaagggcgccgctgtgatcaacgcgatggaggattactcccgcgaaatgcatcgcaagcaccactacagcttcgtgcagactccgcacatcaccaagggcggtctgtatgagacttccggccacctgcattggtacaaggatggcatgtatccggcaatgcgtttggacgaggaaaaggatgagaacggcaacgtcgtcaagcagggcttcgactactacctgaagccgatgaactgccccatgcacaatctgatcttcaaatcccgtcagcgttcctaccgtgagttgccgttgcgtctgtttgaattcggcacggtgtaccgctacgaaaagtccggcgaagtgcatggtctgacccgtgtgcgcggcttgactcaagacgattcccacatctactgcacccgcgagcagatgaaggacgagctgaagaacctgctgaccttcgtgcttggtctgttgaaggactttggtttggacgacttctatctggagctgtccaccaaggatccgcacaagtacgtcggctccgacgaaatctgggaagaggccaccaatacgttggctgaagtcgccaaggaatccggacttgaactggttgacgatccatgcggcgcagccttctatggtccgaagatctccgtgcaggctcgcgatgccatcggccgtacgtggcaggtgtccaccatccagcttgacttcaaccttccggaacgtttcggcttggagtacatcgctgccgatggcacccaccagcgtccggtgatgattcaccgtgcactgttcggctccattgagcgtttcttcgccgtgttgctggagcattatgccggtgctttcccggcgtggctcgctcctgtccaggtgcttggcgtgcccgttgccgacgaattcgccccacacctgcagcagttcattgccagcttggaagaggagacggttcgttgcgaaatcgacatgtccgatgatcgtttcggcaagaagatccgtaacgcttccaagtcgaaggtgccgttcatcctcatcgtcggcgaggaagacatgaacaacaacgcggtaagcttccgcttccgtgacggcagccagctcaacggtgtgccggtcgatgaggccaaggcgcagatcatgaccgtgctgaagaagcgcgttcaggtcaacaacgtcgacgatttcaaggccgccatcgcagactgatctgattcgttcacgttcggtcgcatacggttatgaattatgggggcgtgcaagcatcacatactgacgcttgcacgcccttttgctttccgaagaacaggaattcgcatgttagaacatctccgtgcaccattcaaaagacttatcgagccattcgccaaggcactggtatcccttggcctgacagcgaatgcggtgacggttattggcgctattggaaccattgtggtggctttcgccactggcattacgggatggttgttcgccggagcggtggtgctgacgttgctggtgctcgccgattccctggatggctcaattgcggcactgaccacgggaggcacccaattcggtgcttttttggattccacattggaccgtatcgctgattgggcattgcttgccggagtggtcatcttcttcatcctgcatgccgattggtggtatgacatcaaccggtcaagcccggattgcattagttggattggtatcgccgcagccatggtgtcgatgatgacgtcgttcgtgacgtcgtatgcgcgcgcccgtgccgaatccgtcggtttcgaagtgaaaaacggcattgcaacgcgtgccgacagattggtcatcattctggtgggcatggcgattaccgggctcacgcaccaagggttatggctggccatcgccatggtattgcttgcggttttgggactcattaccgtattccaacgcattcttgaggctcgttgccagatggccgtcggtcataagacgtatcagttgtgaaccggctgcatgaaacggccgttgacgcgcctgacatacgtatgtcgggcgctttgtcttagaaccgctttagaatcgtttcgtttgaaacatccgcaacctgcctaggagcattatgtcaggtcattccaagtgggcgaccaccaagcacaagaaggccgccatcgacgcaaagcgtggcaagctgttcgccaagctgatcaagaacatcgagatcgcagcacgtatgggtggtggcgatcctgacggcaacccgtccctgtacgacgccatctacaaggccaagaaggcttccatgcctgccgataacatcaagcgcgcagttaagcgtggctctggtgaagaagccggcggtgccaactatgaagatatcgtctatgagggttacgctcccgcaggcgtcggtctgatcattgaatgccttaccgataaccgtaaccgtgcggccgccgaagtgcgttccaccctgaccaagggcaatggctctttggctacctccggttccgtgagcttcaacttcgagcgcaagggccagatcatcgttccggccgagggcgtcgattttgatgatctgtttgagaaggccgcagaagctggcgctgaagatgttacggacgacggcgacgtgttcactgtcgtcaccggtccgtccgagatgatcgacgttcgtaaggcccttcaggacgctggattcgattatgattccgctgatctggtcatgatgccgaagaacgaggtcgaattgactctcgaagatgcccagaaggtgtccaagctgatcgacaacctcgatgatctggacgacgtgcagaacatctactccaactggaccgcctctgacgaggtcatggctcagcttgacgaggagtaatcaagcgtgattattcttggcgtcgaccccgggctgactcgctgcggggtcggcgtgatcgaagccggcgcataccgccggctttcttttattcatgtggacgtggtacgttccgatccgaaaatgtcgcaggacttacgtctgttagccatctataacggtttggtggaaaagatcgaacggttcgcaccggatacggtgtccatcgagcgtgtgtttgcacaggagaatcgcaacaccgtactggggactgcacaggccgccggactggccatgctggctgcggcccagaggggcattcccgtcgccttgcatacgcccactgaatcaaaaatggcgattaccggcaacggcaaggccgaaaagattcagatggaacgcatggtcgcccgtattctggggctcaataccttgcctaagcccgccgatgccgccgatgcgttggctatagcgatttgtcatgcgcttcgccccgcaggcgcgttacaggggggagagcgtgaacaacacttgaccgatgcacagcgtcaatgggctctggcctcacagaaggcggcgcgacaacgcggcgtccgtaggggaatgtagactatcgaacagatgttctacagttgtatgcgggaggtgacggcatgataggcatgttgcatggccaggtcgatttcattgacgccgcttcggcgattattgaggtcgggggagtgggatatgagacccgtatgccttcagcggatttggcgtccatgcacgctgggcagacggtgaaggtatacacgtcattgaatgtttcgcaggatgcgattacattgtatgggttttcctcgcttgcttcgaaacgcatgtttttgcaattacagaaggtcagcggaattggtccgaaagtcgcgctttccttgctttcgacgttgcctccggaacgtttggcgaaagctgtggcggacggggatgccaccgcgctggcgaaggcgcctggtctaggcaagaagggtgcgcagaagattattctcgaactcaaggggtccatcgatctcagtcagatcgagggggcttccaaagaggttcgttctgcggaagatgccggttcggaacaggtcgtggaaggtctgatgtcactagggtggcgtcagcaggatgccttgcatgccgtgcagacagtctgcgagagcaatcatatcaatgttccattgagggacgatgatgtgccccgcgtgctcaaacttgcattggcttctcttgaccgaggtaggtgaaacgcatcatcatgacgaacgacgtcgcattcgaacagtcgaataccggtgccaatgaggaatcgcttcgcatggtttccgcgtcgcctgtcggcaacgagccggtaagcgatgaggaactgcgtcctcacgtcctcgatggttttattggacagccaagactcaaggcgcaattgcagctgtttttggatgctgcccgtaaacgtgacgttccccctgaccacatcctgctggcggggcctccgggcttgggaaaaaccacgttggccatgattgtagccaacgagcttggagtgccgattcgagtcacttccggacctgctatccagcatgctggtgatttggcctcgattctaagctcccttgacgcaggggaggtgctgttcatcgacgagatccaccgccttccacgagcggccgaggagctgctgtatatcgccatggaggatttccgtgttgatgtgatggtgggcaaagggccgggtgcttcctccattccccttactttgccgagattcacggtgattggcgccaccactcgcgaaggcatgctgccatcaccgttgagggctcgttttggttttaccgcgcatcttgacttttatccgcatgaggagcttgaaaagctcatcgaacgatcctcttcggtgctgggcatcagtctcgaagagggagcggcccatcagcttgccatgcgttcaaggggcacgccgcgtatcgccaaccgattgcttcgccgcgtaagggattgggccattgtgcacgatttagaaactgtgcatccggacgatgtcaaggaggcgttggcactgtaccagattgataccgagggcttggatcgtttggatattgcggtattgaaagccattgtcaccaatttcaacggcggtccggtcggtctgaacaacctgtcggccatggtcggtgaggaatcggagaccgtggaaacggtgtgcgagccgtatctggtccgagaaggattccttgtgcgcaccccgaaagggcgtgtggcgacgcgcaaggcatgggatcatctcggcttgacttctgacgaatctcaggttgatgtcagcaagctagcttagactcggtgttctggacatagagtcctgttcgagcgtccatcccaaggagttgtgctttggattacatgtttcttatcgtcatcattgtcgtcatgtttggcatgatgttctggcagtccaagaaggctaagcagcagcaggccgagcgtcaggatttccgtgccaacctgcagccgggcactgaggtcatcaccattggtggtgtgatcggcaaggttgtttccgtcgataccgaatacgaggagatcgtcatcgattccgaaggctctcagattcgtttcggtttcaacgccatcagccgcgaatacgtgcgtcctgcgtacgtacacgacgatgaggtcgatgaaaacggtaatcctctttccaccgattccacagacgaagatcaggctgctcaggagccgattgaaggcgaaatcgaagcggcgcagactgagaccgagcagaagaacagctgacaagctcattaaggcatcggcgaaaatctcatttttgaggttttcgccgattttattcctgacggaaacctataatgcaaagtgccgtagcactacaaaagaaggacaatacagtcatggcatcgtcggatattaccgtttccggtcttagcaagattggaaacgaaaacgccgagtaccttgtttcaaagattcgcaccattccgggattccccaaggaaggtattctttttcgtgatttcatgcctgttctggcagatgcgcgtgccttcggattgctacttgacgcactcgaagccgcgttgccggtcgctgccgatgaattcgatatcatcgcaggtttggaagcccgcggattcctttttggtcctgcgttggcagcgcgcctgggcaagggcttcatcgcagtgcgcaaggctggcaagcttcctccggaaaccgttagcgaaagctatgaccttgaatatgggcaggccaccgtcgaaatcgagacgaatatcgtgcatgagggatctcgtgtgcttgtcgttgatgatctgattgccactggaggaacagcgcgtgcggctgcttcgttgatcgaaaagtgtggcggcacggtggcaggtttcagcttcgtcatggagcttgtcggcattggtggcatggcatcgctgggagactgcccgacaagttcactgatcaccatgcctgcgtgagttaagtacattcttcgtaaataaccaatagcatcaagggaaaagaatccatggatctctatgagtaccaggctagggaactgcttgaagagcagggtattccaacgcctaaggcagtgttcgcgcagaactctcacgaagtggctgaggctgccgagcagattggctaccccaacgtgattaaggctcaggtgaagattggccaccgcggtcaggctggtggcgtcaagctggcgaagaatcgtgatgaggccattcttgcatccgaagacatcctgccgatgaccattcacaagcacaaggtcagcggcgtgttggtggccgaggcaaagaacattcttcacgagtattatgtctctatttccgtggatcgttcgtctcgcgattttgacgtgctcgctactgcgaatggtggaaccgaggtcgaggagatcgccaaggaacacccggaatctgtgaagcgtctgcatatcgacgctctggaggatttcgatatcgaggctgcgaccaagatggcggaaagcattggcttctatcatgccgacgtcaaccaggcagcacagattctgctgaagatgtggcagtgcttcaaagagaacgacgccacgcttgtggaaatcaatccgcttgccaagatcggcgatccggatgacgagtcttccaagacattgtgcgccctggacgccaagatttctttagacgacaatgctgcgttccgtcatgatggctggaagcgcttcgctgacccagtgcatgtggatccgtttgagcagaaggcgcgagagcatggtctgcactatgtgcaccttcagggttccgtcggtgtcattggcaacggtgctggtttggtgatgagctcacttgacgcggtttctggagctggagaagatcagggcaccaatgtcaaaccggcaaacttccttgatatcggtggtggtgcgtccgccgaagtgatgtgcggcagtttggagatcgtgctgtccgacccgcaagtcgaatcggtgttgatcaacgtgtacggtggcatcacatcctgcgagcaagttgccaagggcattctggaagcccttgacaagcttggcagttccaagcctctggtagtccgtttcgacggcaacgcggcggcagaaggtctacatattctggctcaggccgatcgtgtcaatctgcatgttgcacagaccatggaagaagccgcacagcaggccgcgcgtcttgcggccaatggcaaggaggttcgctgaaatgacgcttttcattgaggatggcgcacctgtcatcgtgcagggtatgaccggacatcagggcatgacccataccgcccgcatgctgaaggccggcaccaatatcgtcggcggcgtcaacgcccgcaaggccggccaggaagtcaatttcccagcggccaaagacggcgaggatgttacgttgcgtgtgttcggcaattgcgccgaagccgtggaagtcaccggcgcccaagcgagcgtcgtgttcgtgccgccgcgtttcgccaaggatgccgtggtcgaagccattgaagccggcatcaagctgattgttgtcatcaccgaaggcattcctgttgccgatagcgcgtactttgttgaactcgcattgcgcaaggatgtgcgtattgtcggtccgaactgccctggtctgcttaccctgccttctacggaaggtgtgaatggttgcaatcttggcattattccggacggcatcgtctcccgtggacctttgggtttggtgtctaagtccggtacgctcacctatcaactgatgggagagttgtctgacattggttttaccgcatgtttgggtgctggcggcgaccctatcgtcggcactacgttgcaggaggcgcttgaggcgtttgaaaacgatgatgccaccaaggctgtcgtgatgatcggtgaaatcggcggtagtgccgaacaggatgcggccaagtgggcatccgagcatatgaccaagccggttgtcgcctatattgcaggcttcaccgcgccggaaggcaagcagatgggccacgctggtgccatcgtttccggaggcaagggaactgcgcaagataagaaggaagcgctcgaagccgtgggtattcgtgtcggacgcactccggggcagaccgctgaaatcatgcgcgaggtgctcgcttccaagtcgatatgatggcgaacctgaagtattggttgaaggggcttgccgtggcggcattgtccatggtcgtctatgccggtgccctaggctgctacattgcgctgatgcttctggttatttccatggaagaaggcggcgacaatctctccgccttctctgtttccttgaccgaggcggttgtgcttctcagccaagggaacggtttcaaaaccggatccatcactttgacgattatgccgttgctgcttacggttttgctgatcgctcttatcgcatcgctcgccaaacgcgtcggaacgagtctgtccggatgcgtggcaggaaccataggctgggtgttgatcaatgtgttcttcgccaatagccttgacatcaaactcgttgatacgacgggcgtggttgctgtgaaaacagcgatcgtctttgtacttggctatgccattgccgcgattcccgaatcaccactgaccaaacgagatttggattggatcagcgagcatgtttcgtctccggtccgtaaaaccgtcaccattggtgttgccttgggtgtgctgttgatcacggtctatctggtcattggactgattgtggtcttgtactgggcattcagcaaccagtcggccatggtgaagttgtatgagctatcgggaatgcagaacggttctcgcatcctcaccacgatcgccatgatcgcttggattccaaatatcgcgatttgggctatttcctgggtattcggggccggtttttcgattggcgatctagcggaattcaccatgtggagcggtcaggggtcggcattgccgtctctgccgatattcggtttgcttcctcaagcgattgaaacgaattggattcggatcgcgttgatgtgcgttcctttggctttagcttgtgccgcgggcatggtggtcatgctgttcaacaagggttttcatatcagagtaggcaactccgatcagcagattgatgtcaagagggtagtgcttggctttgcctatccagcgggagcgttctgcatttcctgcaccgttgtatcggtatgttcgagtctgctttttgccatctccagtggagcgttgggctcaaaacatcttgcgcacatcggcgtcgacgtgatttcatcgacccgtaagattggacagcctactgccgtgggactgttttcgtcatggctgctgactttggtggccgtatccatgttttttggaatacgctggatagtaaagcgtgtccgcgagagcaggagtggtgcatccactgcggctcttgaatcagataatcgtgaggtcgcaaatgcggcccgcacagtgacctcaaccatcaataacaaggaggatcagggtgacaacaacgaatcgaccgatacggcgagctctggtatcggtcttccataaggaaggcatcgaggttcttgccgaagcgttcatcaaggccggcactgaagtggtttccactggttccactgcgaagcgtcttgcggaacttggcgtcaaggtgacggaagtctcggaagtaaccggctttccggagtgccttgacggtcgcgtcaaaaccctcgacccgcatatccacgcgggcattctcgctgacatgaccaatgaggaccacgcggcacagctggaaaagttcggcatcaagccgttcgatctggtggtcgtcaacctgtatccattcgccgatacggttcgttctggcgcggatgaggctgccaccatcgagaagatcgacatcggtggtccgtccatggttcgcggtgcggccaagaacagcgccactgtggccatcatcaccgatccgaacgattacgcactggtagctgcgcgcatcgaaaacggagagggcttctctctcgaagaacgtcgttggctggccggcaaggcgttcgcccatactgccgcctacgatgccaccattaacgagtggactgcaaagcactggccgaagcctttgaccgttgagcagccaaccgccgaagacgagccggaagtgaatgagaccaagttcccggccgcattcactcgtacttgggaccgtgcccacgtgctgcgttacggtgagaatccccaccagcaggccgcgctgtatctggatccgctgaaccaggatggtttcgcgcatgccgaacagctcggtggcaagccgatgagctacaacaactatgttgatgctgatgctgcttggcgtgccgtatgggattttgctccccagattgccgtcgccgtggtcaagcacaacaatccgtgcggcctcgccgttggcgccactgttgcggaagcgcacaagaaggcacatgcctgtgatccgatgagcgcctatggcggtgtgatcgccgcgaacagcaaggtcaccatggaaatggcggaaagcgtccgcccgattttcaccgaggtgattgttgctcccgactatgatgccgacgctctcgaactgctgcagaccaagaaaaagaacctacgcattctgaaggtttccgagccgccgaagtccaagacgcagttccgtcagatcgacggcggtctgttggtgcagtccacggatcttatcgatgctccgggcgacgatccgaacgcttggaaactggtttccggcgagcctgctgatgagcagaccgtcaaggatctggttttcgcttggcgggccatccgctgtgtcaagtcgaacgctatcctgatcgcccacgatcaggccactgttggcattggcatgggtcaggtgaatcgtgtcgattccgcgaacctgtccgtcgaacgcgccaacacgctggctgatggcgcaaaccgcaccaagggcgctgtcgctgcatccgacgcgttcttcccattcgcggatggtgcggaaattctcatcaatgcaggcgttaaggctatcgttcagccgggcggttccattcgcgacgaggaagtgttcgaagcggctcgtaaggccggcgtcaccatgtatgtgaccggcacccgtcacttcttccactgatacgccgcctctcatgtgagggtattggtcaacgtggcgtccgattccgtattggtttcggacgccacgttttattatgattacggttgttgtacagcaagcaagatgaaaggccccggaatgagccatccttacgtttccgaagatcatgagggcaaaccgtggttcgaatggatcgtcgccgcggtagtgattgttgcgacggtgcttgcggtcgcaggatatacaaaagccgccaccgctgcgattgcggtgacggccatagcgactggactggtcagactggcattgcgtgagcgcagtccatggaaggttcggtcagttgctttcgacgctttcatcggcattggcttgggcgtaggactgttcatcctgctcaccatcgttcccgtcggcaactgacgcttcgccaagaacggtattgccttcgaccttatcgattgtctcgacagtatccggcacgttcttcttcgtaccaatcatgccggcgacgatgacgacgagagcaacaactgcagcggcaagaacagggcaaatccagaagacccacagctgttgcagcggctcttcattcagtccttgattctgtgcgaaaatggcaatgcccgtggcacgtgccggattcagtgcggctccggtcaccggataggtgatagcggtgccgatgccgtaggcaaggcccatggcaacggcgtggtttgttttggactcgccgtgtccgtccgtggtgcgcagtgcggaggcaacgataatgatacctgcgacgacttcaacggcgatggccagagtgatgccgagggtcactccataattgccgagggtggagtaggagacggaattcttatcgaaaccgttgaccgttggtgtcatccagatcttgaatgtcacctgctcggaagtcggcagaaggaaccggatagcggcacccgcgccgataccgccgagcacttgggcaatgatgtacagaatgccatcaagcacgtgggttttgccagtgagcatggcggcgacggatacggccggattgaactgtgctccggaaatggaaccgaagattacggtgacggcggcgtatacgatgcccgtcaacagggcgatgaacgccatgttaatgccatacaccgcggaaccaagcgagcagatcgcataaatcgcgaagcaaatgatgaagcttcccacaagttccgctccgacacgaagtgtcaacggcttgctttgttcttccttggttatgggcgttgcttcaacagcagtcatagtctttcctctgtcatatagtggacaagttgcgattttgggaaatcgccaaacgactgccatagtaccagcagtccctataagtattatccggccacgttgggagaacgatgccaaacgcatattcccgcgccgcgaaggcgcacacacacgataatgaaggtatccgtctgcagaagcttcttgctcaggcaggattcggatcccgtcgcaaatgtgaagagatcattactgaaggacgtgtcgaaatcgacggcgagcttgttaccgaattgggcactcgcgtcgatccgaaacatcaggaagtccgtgtggacggctcccgtgttcgcgtgaatcccaatcatgtcacgctcgctttgaacaagccgaagcgtgtgctgagcgccatggaggatccgaagggacgctacaccctgagcgatatcgtcggcgacaagtatgaccgtattttccacatgggccgtctggattatgattccgaaggcctgattctcatgacgaacgatggcgagctcagccagcacgtcatgcaccccaagtacgaggttgagaagacctacatcgccacgttggaaggtcgcatcagcggtcaggtgtgccgccgactggtcactacaggcgtgcagctcgacgatggttggatcaagctcgaccgttgcgcgattcttgatgccagccgcgacagcacgctggtcaaggttgtgctgcattccggcaagaaccgtatcgtccgtcgcattttcggttcgatcggattcccggtcaagcgtctggtacgcacccagatcggcccgattaagcttggcgatctgaaatccggatcgtaccgtgtgctttcgcagaccgaggtgcgttccctgtccaaggcggtgggcctgtgattcgcgtagcgattgatggacctgcgggtgtcggcaagtcttccacatccaaggcgttggccaaatattacggtttcgcttacctcgataccggtgccatgtatcgtgcctgcgcatggtggtgcatgaacaagggcattgaccttgacgcggagacgatcgatgaacaactggtcaccgaaaccgtgggagagttctttaccgaaggtcatttcgacatcagcgtcgatccagacgattcgaaggtatatgccgacggcgaagacatcagcgacgttattcgttcctccgaagtgtcatcccatgtgtccaaggtgtcgaacatcattcccgtccgtcacgtgctgattgccgctcaacgcgcgtacatcgcacgcgaagctgcgtctgactctttttctgagggtgccggagtggtcgccgaaggccgtgacatcactacggttgttgcgccggatgctgaagtgcgtgtgttgctcaccgcccgtgaagaggtgcgacaggctcgtcgttccggtcagtcaactgatggtgtcggatcagaaaatgttgcggcgcgagatgcagctgattccaaggtcacgaatttcacatctgccgcggaaggcgtgctgaccgtcgataattccgatttgaatttcggcgaaacgcttgatgtgcttgtgcgcattgtcgacgatgccatcgaagagcagcagtatcgccagtacgcttccaatcttgacgattatgagttggatgagggcgatgaaggactgatcgatggatcgtcgttcgttggcggcgaacgccggtccggcccgaagccggttggcgtgcttgccgtcgttgggcgccctaatgtcggcaagtccacgctggtgaaccgtattctcggccgtcgcgctgctgtggtggaagacactcccggcgtgactcgagaccgtgtgagctacgatgccgaatgggccggcaccgatttcaagctggttgataccggtggctgggaagccgacgtcgaaggtatcgaatccgccatcgcatcccaggcgcagatcgccgttcagcttgcagacgctgtggtgcttgtggtggatggccaggttggtcttaccaacaccgacgagcgcattgtcaagatgctgcgcgcctccggcaagccggtcacgctggcggtgaacaaggttgatgatcgtgagagcgaatatttgaccgctgaattctggaagatgggcttgggggagccgtatggcatttccgccatgcacggtcgcggtattggcgaactgcttgacgctgccttggattcgttgaagaaggctgagaaaacatccggtttccttactccgtcccatttgcgccgtgtggcgttggtcggtcgaccgaacgtcggcaagtcgtctttgctgaatcagctggctcacgaggaacgtactgtggtcaatgatttggcaggtaccactcgcgatccagtcgatgaagtggtgacggttgatggggaggattggctgttcatcgacactgcaggcatcaagcgtcgcctgcataagctgtctggtgccgaatatttctcatccttgcgtacccaggccgcgattgagcgttcggaacttgcgctggtgctgtttgatgcttcccaaccgatttccgatcaggatttgaaggtgatgagccaagcagtggacgccggtcgatgcatcgttttggtgttcaacaagtgggatttgatggatgatttcgaccgtcagcgaatggaacgcttgtggaagacagaattcgaccgtgtaacgtgggctcagcgcgtgaatctgtcggctaaaaccggatggcatacgaaccgtctggccagagccatgcgtggagcgctggaatcatgggacaagcgtattccgaccggtaagctcaatgcgttcttgggtaaaatccaagccgcccatccgcatccactgcgtggaggcaagcagccgcgtatcttgttcgcgacgcaggcttcgacgcgtccaccgcgtttcgtgattttcgctaccggcttccttgagcatggttaccgccgatacatcgaacgttgcctgcgcgaggaattcggttttgaaggttccccgattcagatttcggtgaatattcgagagaagaagaaacgcaagtaagtttctatggatggtggccgcacaccattccttgggtgtgcggccaccatccatatttgctagatcagtgcacgccaatcatgcgtgactcattgtcacatgcttaaaacagcggctgttcctcagtatcccgttgacgtagatatccgctgatcgcacgccgcgcgagcgaactcaaggatatgccttcctcggacgcgcgctcccgtgccatcttgccgatggcataggggagtttgattttccattcgtctccgagctgttctcgaccgtcggtgttcttcggtcttcgtccagggcggacggtgtccgtggtctcattcagatcgtcgcattcaagcgccttgcgcgtcagttcggtaagggtgatgccatcatgcttcgcccgctccctggccgctacgccaagttcccgggacagacgtatcttccactcatcctcaagctcggatgagtcaaacacgtgggcaaagccgtcaacgtcgtcaaactgtggctgggcgtccatcgacttcaagacaatcaccccttacctgcatgcgtaagactgacatcctaaaaagaaaacccgaaatcgcatgaattcgggtttttctggtcggaccagcgggatttgaacccgcgaccccttgacccccagtcaagtgcgctaccaaactgcgctatggtccgaacgatgcaaaaagcaccgaacatgaaacatagcacaacctgctctatttttcaaattcatcgtgtcgcacgattcgcgaaacatgataaaagagttcttgggatgtcatttttgtcaagaattttccctttttgccaccaaaagcccccgtcatgggaattttgtcgtagtattgcctaggtacgatgagaacaggacgcccgcacgaaagggaaagacattgactgaggacgcatttgaacattccgccgcaaagatgcgggacaacgggatgaccgatatggccattgcgcaattcaaacgactgtacgaggtttggcgcagtgaggaagcaagcacatggatccgtgaggatgatgttgagcctctggtgggagtgcctagcttccatgatgtctacgagaccatcaaccatgacaaagccgtcgatgcttttgccaaaaccgcgttcctcaaacttaatggtggcctcggcacgtccatgggcttggattgcgccaagtccttgctgccagtgcgtcgccataaggcacgtcagatgcgcttcatcgacatcatcatcggtcaggtgctgactgcacgcactcgtctgggtgtggaactgccattgacgttgatgaactccttccgcacgtcgaatgacaccatgaaggtgctgcgtgccaacaaaaagttccatcaagaggacattcctctggaaatcgtgcagcatcaggaaccgaaaatcggtgcggaaaccggtcttcctgtcagcttcccggcaaatccggaacttgaatggtgcccgccaggccatggcgacctgttctccaccatttgggaatccggcctattggacgtcctcgaggagaagggcttcaaatacctgttcatctcgaattccgacaatctcggcgcacgtccttcgcgcacgctggcgcagcacttcgaaaataccggtgcgccattcatgatcgaggtcgcaaaacgtactccagctgatcgcaagggcgggcatatcgtgcgggacaaggcgaccggccgcttgatgttgcgtgagatgagccaggtgcatccggacgataaggatgatgcgcagaacatcgaaaagcatccgtattttaacacgaacagcatctgggtgcgtatcgacgctctgaaggccaagctgtccgcatatgatggcgtgcttcctcttccggtgattcgcaataacaagaccgtcgatccgaccgatccgacgagcgagccggtcatccagctggaaacagccatgggagcggcggtgacgttgttcgacggggctacctgcgtatgcgttgaccgtatgcgtttcctgccggtgaaaaccaccgacgatttgtttatcatgcgatccgatcgattccatctgacggaccagtacgagatggaagatggcaattacgtcttcccggatgttcacttggatgcgcggtattacaagaacatccatgatttcgatacgagattcccttatggcgttccgtcgcttgccgcggccaattccgtcgacatcgatggtgactggaccttcggcagggacgtgatactgttcggtgacgcgcggctgaccgacacaagtgagccgagttatgttccgaatggcgaatacgttggcccgcaaggtgttgagcctgatgattgggtctgattcgaggggtagcctcaacacgaaaaactgtattttttcgtaaaatagacacaatctgaacgaaaaccctctatcatagagaggtgtgtgcagagcctgaaccggctaggcacttaagatgaaacgttaacgagacgtgaggactaatggcagagggcagtaacggaaggcgtcgtttctccgacaaatggggcaagcacgaacttgatgtattggctgtgctttcctcagctttcccgcaatggctcacttcccgtcagattgcccagcgtgtgaaggcgtatgccgattcctatggggagctggctgatcaggcggcgaaggcggcttttgccaagcaattccagcgtgaccgtgccaagcttgcggccatgggcatcgccatcgaatcgaggcagcctgagtattcatctaagtcggaaggccaggatttcgcatcctatcgtctgcagcttggagatgagcctcgcgttcgtctgctgttcggcgacgaggatttgccgattcttgccgcggccaactatctggcccgttccatgtcgatttcctcagctcccgcacatgagacgcagcatacgtcccgtaccgcgcctcgcgtccctcagactccgactccagggcttggtcttgattccatcgctccgggtctgggaacgcaatccattcccgacgaattggtcaaggtcgttgaccagcgtcgtttcgcggcgactgtagatgttgacggcgagcatttgaacgtcgcctacaccgattccgatgatctggccatgttcgtgctttctcatccgggtgcttccatcgtcagtcctcaggaggctgtcgacgcgttcaaccgccgtttgaatgccgccacgcagttcgtgcctgccgacgaatccacaggaggcgatagctccactgtcacagccatggaaatcaaccgcaacagcgctgacgacgatgcagaggagtgcaaggggcgtccgaagaagaattccgcattccagacgggtagtgaagtcgaccgtcgtctgcgtctgatgctgttcctttcggcgcacctcggcgaagaatattcgcttgaggaacttgcggaacgtttcattggcaaaccgaagtccgatgacgagctgaagaagttcgtcaatgtcattcataaagacatcaacacgctgactacggtttccgacgatggtgagatggcaggaagccagttctttgacatcgactggtcgttgcttgacgctgaaggcattgtttccgccacgaattcgcttgggctggaacgcttggcaggtatctcccagcagtatttgagcatgcttaccgcatcggtgagctatcttgcgcattcgtcgttgctgccggacaagttgcgtgaacaggctgaatcgttgtacagccgtcttcgtcaacatgttgagccgggggacatgccttggctgagtctgaccggttatgagatggaaccgcgtaatttctccattgtgaagagcgcgatctccaagagcttgctgcttgacatggaatatacggatggcgccggaaggacccagcgtaagcttgtcgcgccagataagatcttcgtcgatgagggagtcttctacgttgccgtatggactgacgtcgctgccgctgcaccggctgacaaagctaagtacgtgaagaaagacaccacgatcaacaaggccacaggaaagcctcgcatctggcaggtgcttcgcatttcccgcattgaaaaggccgaactggttgaacctaccgcgaaaatcgacattcccgacgttcccgcatccgaattgcgcaaatggagcttcgataatggaactccagctgtgttcgtcaccaatcaggatgatctgtcatttattgacgggctgtcgggagcaacagtcgaaaagtgcggagagggcgagaaggtgcatctgatcgtctcgtccgattcctggtatgtcgcattctgtatttcccacgcacggcatatcactgccgtagctcccgaaacgttgcgtaccatgattgtcgcccgtgcccagcatgagctgagcattggcgatcgtgagaatgaaggctgacgggggagagactatgccttggtggatttggctgttgctcgctctgttcatgcttgcaatggttgtttccggagtcgtctacgcatgtttacacggctatcgagcattcaaggacgtggcgaagctgggtgaacggacggcaaaacgaatcgaggcgatgggcaaaccattgccccaaaacaacgagaatgaagcgcctttctttaccagacctttaaaggatgctgcagatcgttatgcggatgcccatgccggagtcattgagaggcatgaagcgaagcgaagccgtcatgctcaacagtgggcacaatggcgtcattgtaacgattgacccaaccatattaaggaatcatgacccatcatcgtcgccgtaataacggtattgacccgtcgaaaatcaatgagaccgtggagttgtctcccgcgcaacggtatgccgcattcaaacaaacgcaggccaagcagcgcacggttgcggccgaattcgcaagatccatgccattcgagcttgacgaattccagatgcaagccaacgatgcgttggaggctggcgataatgtgctcgtggcagctcctacgggagcaggcaagactgtcgcagccgatttcgccatctatctggcgcagacacggaatgtcaaagccttttataccacgccgatcaaagcgctgagcaaccagaaataccatgatctggtcgaccagtatggaacggataaggtcggattgctgaccggagacacgtccatcaactctgaggcggatattgtggtcatgaccacggaagtgttgcgcaatatgctgtatgagcattccgtgacgcttgaagcgcttcgttatgtgatccttgacgaagtgcactatcttgctgaccgtttccgagggccggtctgggaagaagtcattatccacttgccgaaaaacgtgaacatcataggtctttccgcgacggtttccaatgtcgaggatttttccgaatggatcgaatctgttcgtggcaaaaccacgttggtcatgtcggaacagcgtccggtaccgttggagcagcacgtgctcgtacaggcagatgaccataccgaaccagaactcatcgacctatatcggcgtgacgccaatggcgaacagacggtcaaactcaatgcgcagctgataaacagacttgatcagcttgatcgtcaggcggaacggcgcaagggcgagcgacgtcctgataagcgtagggccaaaggtaaaggtggacgatgggacgatcgcccgcataaggtcgaacgccatacgcctcgacgctgggcggttgtggacgagttgaattttcttgacatgctgccgggaatctacttcattttttcaagaaacggttgcgatcaagcggttgaccaatgcatcaacgcaggcttggaactcaccaccagcgacgaagtgcaacaaatcagacggatcgtcgatgagatggtcgaaggccagttgagccaagaagacttgaaagcgctgcatttctcgcaatttcgtttcgccctggaagaagggttcgctccgcatcatgcgggaatggtcgcattgttccgccagattgtcgaacgcttgtttgaagaaggcttggttaaaatggtcttcgccacggaaacgctggctttgggcattaacatgcccgcacggtgtgtggtggttgaaaagcttgagaaattcgacggcaccgggcatgttgggttgactcccggcgagtttacccagttgaccggtcgtgcgggacgacgtggcatcgacaccatcggacatgccgttgtggtggaccaccatggttttgttcccgccactgcggccgccttgtccagcaaacgagtgtatccgcttcactcaagcttcagaccgaccttcaatatggctgtcaatctattgaattccagcgactatgaaacagctcgcgttacgcttgaccactcctttgcgcaatgggaagccaacgagtcggcatggcagcttgaagcacagatggaaaccttatgcaaggctctggaaggatacgagcaggctttccagtgtgaattcggcgatttcaaaaaattcatgcgtttgcggatgcgtttgagtgatttggagaagaacgaacgtcgcaaactcaagcatgaggtgttccgtacgcagaaggaacgcagccaagcgtttatggatcttgacaaacgcatcaagaaactcagagaagaagaccgcgaccatccatgccgtaaatgccctgatgtgcagaagcacttgaaatggggacatcgttgggctcgtgagatgcgcgagttggaacgggtacagcatcgttacgattcgcgaaccggttccgtggcacgtcagtttgatcatatttgcgctgtgctttccaatctcggctatcttcagccggtacgggaatccgcgggccatggtgattatcagctcacggaacgtggccagctgttgcggcatttgtacagcgagcttgatctagtattggcgcaggcgattgacgatggcgcatttgacgggttgaacgcctgtgaattggccagcgtcgtcgcatcgttggtgttcgaagcccgcaggggaggcgggggagagccgcgtcgttaccctggaggcattcaagggaacgtcgccgtgtgcgcagcgcagcttaagggcgtccatgcgtcgattgccatgttatgtgaggatcacatgcttgaggagcctcgtcaactcgattttggcatcaccgatatcgtctacgattgggctcaaggtgaaagcctgtcgcaggtgctgtacggcaccgatctgacgggcggcgatttcgtgcgtaacggcaaacggcttgccgacgtgcttcagcagatagccgtggctggaccgtatcttgcggatcgtgccgaaacgttggcgccagtcgcaaaacaggcgtacgatcgcatcaatcgtggcatcgtcgcatactccggcgtcgactaaaatcgaacatcaagcagacgaataaggaataaaagacacgtccgaactgttctgtagcttagacagagcagacaatccaaggaggcaaaggcaatatggcagaacgcagcctgcgaggcatgagcatcggcgcaaagtcgttggaatctgatgacaatgtggatttcgcggcgcgaaacgacgtcgcatatgtgtgcccaaagggacaccgcacgattctgccgttcgctgaaggcgcggaggttccggaggaatgggagtgccggtgcggcatgaccgcgcatcgtgaaggcgacgaggatcgtgaggccgacgagatttccaagccgacccgtacacactgggacatgctattggaacgccgtactgaagacgagctgaagacgttgcttgaaaagcgtctgcagatgcatcgcgacggctggtttccagactacgagtaaccagtagttgaacgacacttgaactgcatgcccggtcagtaagaccgggcataattgttatctgaacagttcacattgcatcgagcatttaacaaggagtgcattaatctcatgtccgagaagaccaagcaacccaagaaagtcgttctgcttgaccttgacggcacattgaccaagtctgatccgggcatcattggttgtgtggtgaaggtatttgaggaactggggtatccagtgcctgatgatgaggagttgcagcgattcattggtcctgcaattgtcgagtcgttgcagcgcaataatattccggacgacttactcgatgagggcattgccatctaccgcaggtattatgcgcaggaagcggtgttcgatgatccgaataatccgggtcaaaaggttccgggccgtttgaacaataccatttatgacggtatcccagaacagttggccaaactgcgtgctgacggatactacttggcgatcgcaagctgcaagccgcagtatcagtgcattccgatttgcgagcatttccatttggacaccatggtcaacggcatttacggtgccagcgaagataattcgcgtctcgacaaagatcaggttattcaatgggcgttcgaccacattgggtttgacgaagccgctggcgataaggcgctcatggtcggtgaccgttggaccgatgctgacggagccaaagcgtgcggtctggattgcttgggatgcggctggggttatgccgagcctggcgagctgaaagaacatggcgcgtataaggtgatcgattcggttagtgagcttgcgcaaaccatcgaagactatttcgcctgatagataacggctgatgcacgagcggatcatcttgtgcataaagacaaagaaacccctgggtatgcatgccagcgatgacatttgcatacctggggttttgagagatcgcgcacatctcaaataccccctgcacctgctcccacttttgtccgataatgtacgttatgtcagaaaagctacagcagttttcgactgacgctcttttctgtacataacatcggtgggttatgccagcacgtccctttcgggactttgctcgacataacccaccggcatgatggatggtgcgtcctcgcttcgctggacgtttttccacacggctgcgttttcgcttcgatggatgtctttttggctagtccttaatggcttggctgagttttctttccatttcgcttttcatgccgtttcgggcctgcagatacataaacaccagttccgtggcgatgagcataaccatcagtgctgccgacggccaaccaacctgttcgtagaaatgctgaaatttcaaggaaaagctgggtttgaacatcgtatatatcggatacggcagagctccgatgatcagcgatgtgaaatgcaatccgacaattgaccagcgtaccggatatacgtcactcttggtttttgagaagatatttcctcgaattgcagtaatcgaacaaatgttcaacgatatgaccgctgcgacaatccacagcaatgccggcagaatatcaaacatgtattgctcccctgttgtatgtctgtctgtacatatctatctcatatcaacgactcgtacatccgtcttagtccgcatcaaccatacggcatgcattctggtatgttacagtgacgcggcggcgcgtgtctgatgttgcgcctcgaagttctttctcatgcgcattgcagtgatatcgtcaacaggtcggtttccacccatcatggaaggcatggtggtcagatcgacgtattcctcgtgggcaagagtctctctgatctgcttccataaagatcccaccgatacgccgaataccgcccgaccgctttgcaacaacgccaccatttgctcactatccgtacattcgtgcacttgctgaccgtcgcacataatcgtgatattctcaagttgttccgcggtacgctgcgtcagaaaactgatggcagtcgtcacattttgcagattgatgcccgcgtcaagcagtcttttcgacacagcaaggatcaccacgtccttgaacgagtacagcctgcgcgaaccggatccatgcgacggcgtgatggaaggttccacgatttgtctgcgagcccaatagtcaagttgacgataagtgatgcctgctacttttgaagccaccgtacctttgtagccgcgcgtcaccggctgagtgccggtcgcggggaataactccccctgcaccgcagtcgacacatgcagacgcaaccgcgttgttggctctgcttcgttcatcacgctctcctacgacatctacaataacgcccatgagcattcgtgcgaagctcatgggcgcgaagctgttgtacacagtctatcccgcataacgtggatcaaccggcaatgacggctttattgtcgaaataaaccagacggaacttgccaagaataatctcatcgccattcttgagctcctgctgatcaacacgctggcggttcacataggtgccgttcaagctgcccgcatcaataacggaatacctgccgtcagacctgcggaacaccgcatgggcgcgggaaaccgtggaatcatccaaaagaatgtccgctcttggatcacggccgacggtaatctcatcctcgtcaagaagataccgcgaccccgacaccgctcccctagtcgagatcagcaatgccgtgccatcggcaagacgcatgatggtttcaaggtcctctttcgtcagaggacggtctccggtggaagtcaccggtacggttattgcaggaaggccaatgatggtcgtttcacctgcgcttggaatcggatcagtcatagtcgccattctagtcattacccttgcaaatagccggtattgagaccggcatggtcacgaatcatacaccgtaaagtgggtcttatccctcagtcttgtcgataattgacacgaactggtcgtttggcaacatgtcatcatagctgcgccaacggcgttccagctcacgattcgcctcgtcatgctgctgtttgccgagcctggcataagccttcaactcgttcggccccatgtctttgaccggctgattgagattcaatgcttcgtcactcacaagctgccattgtagccgtacaccttgaaagaacacggaaaaagcccggatagtgtgtattccggatttaaaactgtattcgaagttatattcgcggggattgatttcagcgctgctcgtcgatcatttcccgcaatgccttgttgcagacggctcttcttgaattaggagcatcgccggagtgaatggcctcggccaccgcgtcgctctgctgcgtcatcttatagtcttctccctgcgtggactcgatctgggatttatccgcacccatgtatttcactgcataggagttggttgcagctccaatcaagttgcccgcgacaggcggacccgcggttccgcagcgcgcccagatttccctgtgagacaactcatgccttacaacagcatcaaaataggccgtacaagatcctcatccttcaggaactggttctcataattctggaattcgtcgatgcctgcctgaacgagatcatcaggttcatcggtgctggaagacatttgataccatccaatatcaaccgattctttgtagtcagtcaaaatcaccatatactggtgaacataatcaccgccctcctctgttgcaggaacgttggccttgtcgaaaatcgttccatcatggatggtatccgaaccatttgtcgtaggtggtcagaacgagattctcgtactcctgatacaacggacgatcctgcacgtaatagatttcgcctgtggccggcagtcccagcttacctctgagatcctgctcgcctttttgattgatgttgcgttgcctggaagtataggcgctatgaatcgatatggcgcccaaacccaacaccacgcgccacccgtttccgacatgccgcacgaaacggcggaaacccaacgaaaccaacaaaaaaggcggcacgacgtgccgcccgatggtgggtgatataggaatcgaacctatgaccccttccgtgtgaaggaagtgcgctacagaagtgaccggcaactgggccgtgtacgccatgtacaaggacgctccgaccgacgactccaagaaggatgacagcaagccggccgacaccaccaagaagaatgacaccaagggcaacaccaagaagaccgttgcccagaagatcaagaaggccgttctcggcaacaccggcgctaccgttggtggcgttgcggtgttcgccgtgatcgccctgctcggcttcgccggcatcaccgtgctccgcaagcgcgcctgagtccaactcagtcaaggtggcattcgcctgaaagcgattaatttggctccgtgcaacgacttcccctggagtacttgcgcggagccaaattgccgtatttaatggcacgttatggcttcattgaacacaccctgcaataaggtcgccgacatagctaagggtgtataagataagacttggctggctgccggcgagggctatacctcaaacgcagttgataggtgaggaagagccttcgaaaacacttcttcaccctgatgcgctgccctagccagcgaccaaccatccacccctgggaatcgtacgatttccaggggtttcctgtattcagcggaaaaccgccgaacctcagcataccgtagagccaattcccgcgaatatgctcacagccccctcagaatttcctgtcagcccaacagtccttaagacagtaggcaaatcggaatcatcaaggttgttcaacacgcccacgcaaattcgcactacgcatacttatcattttaggggggggggtgacaactgaggtcatttgcggtatattaccgatgttttacatatgaataaacagttttcgccgtaccatcaggcaggcattgacgtcaccaagccacccccccctatatacaaccctctccataaaacacgcacgacatgcgcgcggacgtgaattccgtggtttggggtacactagacatattcgaacaaacgttcgtattttggggaattctggggaattccccactatatacagtgaggaaactcacgacacaccactacctgtagtgtgtatgctagatagtggcttgcgtaagcgagcataaccgaagaacgtggccgacacggctttcgcaaacgacggaagccatttttgcatagggaggaaatcgaatgaccgtgaccgtcttcaccaatccgagcaacccgcaatgcgaagccaccgaacaagagctcgcaaagctgggcgtgcgttacgacaccgttgatctgacgaagaacccgtccaccttcgaacagatcaaaaacgctggcttcaagcagattccggtcgtcatctcaccgaactcctcatggagtggacataggccggatctcatccgccagctcgcgcaaagcttcgccgcctaagcgcgtagaagtcgcagggcaccgagtccacaaaggcagtgcgggcacaggtcacatgcagccgtgcacggcgcaaccaatagcggacgcaccatacacgttcttccacaaagcttcgccatctagcccataaagcagtcatccataaaacagtcagacgctacatgcggctggccgtggacgggtcgagcgtcatggtctggaaccgattggccatgaagtcgtcgtcgaaatacgtggcgaagaattgcgaaacgggcgaatcctgcgcaatacccgccatacgcgaataccaggaatccagcgccatcaacgtcatcacgccgtcaacgaaaatcagcgcgaaacacaccgccgtcaacgtatagcgaatcttccacggaatacgctgaatcatcgcaagcaaatgcggcagaatcagcttcacccacaccaagccgagtattccccagaaaaacatgtatttgccggatgtgcgcccatcaatcgacagccattgacccgtgtaatcccacgcgcgaataccgaacgcaacctccatgaaccagctggtgaaatattcgaacgcgccgccaatcaccgcgctggcgcagaagatcagcatccaattcgaccgccacaagtggttgagcaataccgtcaggatcaccgcgccaaagccgtagatcggcgagaacggcccccacaaaaatccggcgcgatcctgccattcgccgaacagcacatagtggtatagcgtctccactaccagaccgaacacgcatccgaccacaaacagccaaaacaggttgaagaaatcaagcgaaatatagcccttgccggtcagatcacggccggccatacccttcgaaacagccgtctcatactcgctgcgcgcatccaaacgacgaagcgcgaactgcaaacgtcgctcctcgcgcagcgacggatcagccgtgatatgcaacgcaaccaatacaagcagctgcacggtcggactgatcagattcacgcccaaaccctgcaacgacaacgacaataggccttccgcaagcgtgagcggaatcatcagatacgtccattgcgcgatatgccgacgcttgttgagaatcagcagcatgccgaaaatcgcaaggcatgcggtggagaccagcagcactgcagcatgaataaccgacagaatagtggtgagattcagcgcgccaaacgccagtttgccggaaagcgcggcgtggactgcatacaggcaggaaatcacgatgatcggcaacgtcaccacgccttcgatcaacatgacgatgccgtaaatacgtgcaatcagcggcagcctgcggtcagcaggattgccgtcatcttccgccgattgcgattgcgcaatgatgccggcctcttcgattgctgcgatttcggtttcgtcggcgatggcttcgctcacatcttcaatcttgctcatgcttgttcgtccttccctgcacaacgctaccaaaacccgatcgcagtgcgctacacgagatgattgtttgcgcgcaacgcgcacaacctgcgatttctgcctgcgcaagtcacatgtcatcccgcaatcacaagatgtgcagacagcagactcgacttgcgcagacacagaaggcaagttgcgcggtctccaacagcaagattcacagtcctgccgcggtttgtcgtgtttatttcagtcatggacggagcgcatttacgcctgtgcccaaatttgtccgagagcgggtattacgatacggaaggcgtagcgctacgaataacgtatcgctacgcgcgaacacggtcgaacatccattggactggggagacaatgcgcaacgtactgcagattctgcgtcgtgacctcaaacgactcgtcaccgtacctgccgcctgggtcatcatgatcggtataaccatcattccgccgctgtacgcatggttcaacatctacggattctggaatccgtatggcaatacccaagacatcaaagttgccgtggccaacgtcgacaaaggcaccgacaacgccctgctcggcaaaatgaacctcggcgaccagatcgaagacacgctgaaagacaacgaccagcttggctgggaattcatgggcaaggccgaagcgatggaagcggtacagtccggcgactgctatgcggcgatcatcatcccctccgatttcagcgaggatctcgccaacgtcgtgaccgacagcaagaaccggccgacgctggaatactatgtcaacgaaaaatcaagcccgatctccccgaaaatcaccgaccaaggcgcgaccaccgttgatcgtaccgtcaacaacaccttcgtctccaccgtcagcgaagtactcactaaagccgtgaactccgcgaatgacaccatcaacggcaaaaccaactccttcgtcaacgaaaccacagcagaactcgacaaaacccagaagaacgtaagcctcatccgctccaccatcgaagatcttgacgcacagctcgccaacgtgccgcaacaaacgcaatccgcccgtcaggcaatgaacgacgtgcagctggccgcagcaagtgcgggcaagggactggcgaacaccgccaccgccatcggcaccgcacaaaacggcctcaataccttcacgtccaacgccaacaccgctttggagaacggttccggcctgatttcgcaggccgccagcgacaccaccaccagcatcaacaaggtgaccacggccgtctcgtccgcaagcggcaccgcacagcaggccgtcagcaacatgcaaagcgtgaccgacagcaacgcccggctcatcgagaagctcaagaacgtcagcgacaacgcgcagtaccaagacatcatcaagaagctcgaagacaccaacaacacggccgctggcacgctcaacgacctcaaaacgttgagcgagaacacacaatccacgtccgacagcgtgtccaaactcgccaccgacttcaacaccagcacgcaaaattcgctgaaaagcatgggagatgcccgcaacacgttgaattccggtgcgctcccccagctcaactccggtctgagctcgctcgccatgaccgccggcacactgtccggcaccgtaaccagccagaccaccgtggtcaaccagacctccgccgtgctcgaccaactcgaccaggtggcgaacgacacccgcaccacgctgcagaacaccgacaagcagctcgagcaggtggagaacaagctcatcaccgtcagcaccgacctgaaagcgctcggcagcgttgacatgctgaaaagcctgaccggcgacagctccctcaacacggagaaaatcgcttcgttcatgcagtcccccacggtgatcgacacgaaaaacgtgtatccgatgaactcctacggttccggcatggctccgctcatgaccaacctggccctgtgggtgggcgcgttcgccttcgtggtgatcttcaaggtggaggtcgacgatgaaggcctcgaagacctcgacttgaccacttccgaaaaatatttcgcccgctacatgctgctcggcatcatgggcgccatccaaggcgcgatcaccaccatcggcaacctcatcatcggcgtgcagacggtgaacgcgccgctgtacatacttaccggcgtcatcacgtcgctggtatatctgagcatcaccttcgcgctgtcgacctcgttcatgcatattggcaagggactgtgcgtcgcgctgatcatcgtgcagattccgggcgcttccggcctgtatccgattgagatgatgccgaaattcttccgcatggtctacccgttcgtgccattcagttattcgattgacgcgttccgtgagacgattgccgacttctacgacgggcattggctcaagtcgattggcgcgctactgatgttcgccgtggtcgcgttcttcatcggacttgcgattcgcccgctgctggtcaatctcaaccgcctgttcgcccgtcagatcaaggaaagcgacatgatcatcggcgaggaggtacagcttccggaacgcggctacaacgtgtcccaggccattcaagtgctcgccgataagggcggctaccgtgaggcgatcgaggaacgtgcgagccgcttcgccgaactgtatccgaagctcaagcgtggcgcgctggttgccggtttcattgtgccggtgattctggtgctgatcttctccttcaccaacggcgagaagatcgtggtgcttgccacctggatcatctgggtgctgctcatcatcggattcctgatggtcatcgaatatatgcgtttcagcctgcaacgccaggtggaactcggcagcctcagcgacgaagcgattcgcgaacaactggtggaacgccaagctgcaaggctgcgccgcaagaagcgtgcgcaacaaatcaggcgagacaagctgatgcgcaaggcacaacgaagaaaacacgaaaccaaacaggcgatcgccaacgtcgcagacaccagccaagccgatgccgacggcatcgcaacactggtacaggccatgaacgcgaccggcaacaccggcacagcgagcaacaccaatcccaacggtaacagcgaaaggagcaacgcatgaaaaacatctggaaactgttcgtcggcgacgttcgacgcctgaccagcaacatcgtctccatcatcatcgtcatcggactggtggtaattcctggcctgttctcctggttcaacgtgagcgcaagctgggatccattcgccaacaccggcaatctgaaattcgccgtcgccaacgacgatgaaggctacaagtccgatctcattcccgtgaagatcagcatcggcgatcaggtggtcaacaccttgcgcgccaacgaccagatggactggaccttcaccaccaaaaaagaggccatcgacggcaccaaatccggcaaatactatgcagcagtggtgattccgaaggatttcagcacccgcatgatgacattcttcaccgcggacggcgaccatgccacactcacctactacaacaacgagaagaagaacgcactcgctccgaagatcaccggccagggagccgacaccgtggcagcacagatcaacgaaatgttctccgcaacgttgacgagcaccgcgctcaacatcgcctcgcagctggccgatgagcttgacaaaccgaaatcacaggccacgctcaccaacttcagcaacaatatgaacaacttcgcgaacacgctgaacgacacgtcatccgcgttgaccacgttcagctcgctgacgttgagcgcgcagaacctgctcgacagctccaacagcctgctttccaacgtgagcggcagcgcgaagaacgccgtcaacgagctcaaacagtcgaagaacggcatcaacgatctgaccggagccgtcaaaaccagcacgaatgcgctcagcaccgcgttgagcagctcgtcgaacagcttcggcgctgtctccaccgatattgacagcgtattcaacaatgcgggcacccaagccggcaatacggccaccgccctgcgcaatcaggctgcgaacgtatccaagcaggcgcaaggctatcagaacatctacgatgccctcgacgagctcagcaacaacaatctggtgccggaagtcgcgaaaatcgccatcaatcatctcaaaaccaacgtgggcgcgaccattacgcaactcaacgatctagcgaactcactcaacaccagcgccgacaatatcgacgcgaaagtgagcgacaccacagccgaccgcgagcgcgtgagccagcttgcccagcaggcgaaggcctccatcgacggcatcaaaaccgatttcgacagccagctcaagccgcagctcaacgacatttccgattcgatcagcagcacggccaccgcactgagcagcacggccaccgatctgaagggcgcgctgggagatctcaacagcaccaccaagtcggccgacaagcagctgaccaatattcgcacggtgttggattccaccgccgaaagcctgaacaaagcgggcaccgcgctggcctcgttcaacggcacgctttccgacgcgctgaacagcggcaatatggacaccttcaaagacgtgctcggcaacaacaccgattcgctggcggcggctcttgcagctcccgtccaggtgaagcgcacggctgtgttccctgtggagaatttcggctcgcaattggctccgttctacacgattctgccgttgttcgtgggatcgctgcttatggccgtaacactcaagaccacggtgtcgcgcaagaatcgtgaggagctcgacaatccgaaaccgcatcagctgttcctcggccattatggcgtgttcgccgtgatcgcactgttgcagagcacgttctcgctgggcggcggcctgctgttcctgcacattcaggcggtgcacccgtggctgttcatgttgaccggctgggtggcctccctcgtattctcgttcttcacctacacgatggtggcgagcttcggcaacgtgggcaaggccattggcgtgctgacgctggtgttgcagatttccggcgcgaacggcgcgtatccgcttgccgtgctgccgaagatcatcggcgatatcagcccgttcctgccggccacgcatgcgattacggcattgcgtgcggccattgccggtatttacaacaatgattattggcatgcgatcggttcgctgttgctgttcctgattccgctgctgctgattggcttgctgctgcgtattccgctggtcaaattcaataagtggtatgtggcaaaggtggaaagcaccaaggtggtcgcatgattaccggagtgcatgaggtggtttccggagccgtttccgatgtggtttccgacgcggtcagtgacgtacatgcggctgttcgcaaggcgcagagccggcgcgagcagcttcgtgagcagaccgatcataagatcatgaaggccacgcttgcgattgtgatttccgatggtgtcggtgcggtgaccattgaagaggtcgcccgtcgttccggtgttgcgaaaaccacgatttaccgtcgctataagaatgcggacgatctgttgcgccgcgtgcagttggaagttgcgggattgccggatttcagcgatgtcgagttgtcgaaaaacggtctgctgacgatactgcaacgcattcagggctgttttttcgacagtgagcttggtttgaaagccgtcggtgtggtgctttcttccgataatccttcgttgaatgcgattgcggatcaggtgctcgttcccgcggaaaagcgtttttctgagtttgtcgatcgcggcatgaaggccggaatgttccgtaatggattggatccgcaattcctgttcagcacgatactcggctccatgctcgcctgtaaggcgttgcatggcgacgcgagtattccttggcctgagaacatgacggctgttctgtggcccgttatggccgcctgaaaggcattgcagagcagagttgcacgtagtagtatctgaaactcatgggcgtccccgctacggcctttaatcactctttgagtgaggctgtagctgaggcgctcattgtacgtttgcagacttttcgccgctactggacctactggatcgacgcttcctgacgggccacgtccaacgccttgttgaacgcttccgacgtccagctggcaccggccaccttgtctaccttgaggtctttgagcggtttgccgtccaccacgccgttgatggcttcggcgaacgcattctggtgctttttggagatggacgtgaacggatgcccgataacctccacattggtgacggtctgatctttgaccgtcacatgcacgtcgatggtgtcttcgcccaccggcccgtactggccgttgatcgagtaggtaccgtcggcgtagttgccggtgtcttgcttgtcggatgtagtgccgttcggatcgtcggcatggtttttgtcgtccgaatccgcagaatcgccggagtcggtggcgctaccgctgttcttcgaattttcttcctgcgattgcacgctttcgccggaatttccggcatattcatcgtccatcggtgtcgccgtgggttcgccgcatgccgacagcagcgcaaggcttgccgcagacagtgcgatcactttgatcgcattcgatgattcgttgatcatgttcgctccgtacgattcgtcagtgctatggcttggattgttcggctgatttcagcttattcctcaccgccggttttcgcggctttggtcggatcggcgaagctgatggccgtctcgccattctgtgcgccttccgtagtggaaccggtgtatgccggcttgccacccgcctgctcatagaccttccgtgcggcctcatcattccacttctcaccgacgagcacgccatggttgagcatgatctcgcgctgggcacaggatgcgacgagcgcatcatgggtcacaacgatgatggtagtgccctgctcgtgcagctgacggaacaggtcaagcacgattttctcgttcttctcatccaaattgccggtcggttcgtccgcaagaatcagtttcggacagttgatgagcgcacgtgcgatgcacacacgctgctgttcgccgccggaaagctgtccgggcagatggtgggcacgctccttcagaccgacgcgctccaatgcttccaacgcctgctgctcgttgactacggaatggtagtactgtgccaccatcacgttttccacagccgtcagatgcggtaccagatagaacttctggaacaccaatccgatcatgttcttacgcacgtcggcaagctgcttggcgttcaaatcctccaacttgcggccttccagcatgacggaaccctttgaaggcgtgtccatgcagccaatcatgttcatcagcgtggttttgccggaacccgacgaaccgacaatcgcaagccattcaccttgcggaacggtcaaagtcaaatcgtcgacggcacgcaaatcgccgtaaatcttggaaatatgatccaattcaagcaacgtattcaacgtatgttcggaactcatgattattcctccctcaaaacgatggcggggtcgatacgggttgcgcggcgaaccggcgggatggatgcgatgatggcgatgagcacgctcaacagcagcgaagcgacgcccaatagccagttgaagccaatggcacgttcgaatacggatacgcacagcacgcgggccagcaggtagccgatggcagtgccgatcaggccgccaatcagtccgtagatggcggattccacatagaattcgatgccgatggcgcgcgaggatgcgcctaacgccttgcgcaagccgatttcgttgcgtcgctgagacacgatggaactgatggtggtgcccacgcccacaaacgtcagcacgagcacgaccagcgacacgatccagaacagggtttgcagcatggcgatgatacgagtgtcggatgaggtgattttggtgacggtctgcgctttcacgccggttgacggattcgcattgatcgatttgacgacatcgttgagttcgctgcctaccgcattgacggaatattcgatcacgtccgcgccacgcttggaaccggccagtttggccacgtcagcgttgaccgcgtagacgatttcgtcttcgctgccgcccgtatcgacgatgcctccgacacggaattcagtgccggtgttttccataatgtcggacgaaacgcggccgttttctttggcttgcgcttcggtttggctaagagcgccggaatcctgcgcatcgtcggatgcgcggtagccgatggttacggtcgaaccgatggagacaccgagcgcgtctgccacgtcacggccgagcatcacgttgcctttgctgggccaatcgccagtcacgttccaatgatggttgagcgccttcacgtctttggttgtgatgccagccagcgtgtatggcgcagaattgatgcgcacgctttcataccggtaagcggcggaacgggcgctgtacgagcctttcaccatctggttcaacgctttgacggtatcggtgtcgatgccgtgggacttttcggctgattcggacggcgtgacgataagattcgcgccatacgcacgcatttcctcgttcatctgctgtggaacggcaatacacgtcgccgcaaggcagaacagcgtggcagcgcccaccatggaggcgatcacggccataacggcccgcgaacgacggcggaacaccgcgccccacagcatggtgaagaacatcttgcgattagtcatctcatgccccttacggactgtcttgaactcacctaccatgcaacacctccgcagacgaacagcacagtgtgccgttcgtgaccgaggccgcagccgcggccgagtttacggaacccaagttgacatcagcggccatgcaagacctccgcaggtttgagtcccagaatcgaacggatcgacgagaacgaggcgatcagcacggtaagcgtcagcagcacaaacaccagcacaaacaccatcggacgcatcgtaatgccggaaccgaataccacatgtcccacaatctgcgcaacaccggaacccaacagcgcaccgacaatcgcaccaaccaacgaaatcacagccgtctcagcgagcatcaggcgagaaaccgcaccatcggtggcaccaatcgccttcagcaacgccaattctgaaccgcgctcaccaatcgaggcggccatcagattcgccactgcaatagcggccgcaaccagcgaaagcacggtcatcagcaccatcaccgcctgcgttttctgcagcacatcgccctgtaatgcggccacctgacgcacctgcttggctacggaaccgggaatgacctcttcgatctgataggcgatggacgaagggtacgcggtgcaataccatgtttcccactcatcttgcgtgagcgcattcggattcttcgacgccttacgcgccaaatcattgtctggcgtggtcagagccttgacttcgatcttgtcgatggaatcaggcagattcgcaagcacctgcgcggtggatgacggaatgtacatcgcattgttgtcgctatcgccggaatcgtaaatgccggtgatggtgatccgctgcttgttgcggctgccgtcggcggtggttttgtagagggttacggtatctcccttggtcacgccgagtttggatgcgagcgtggtgccgatcaggccttgcgcgctatcgtctttcggccaggagccgtcaagcttccaccacgaacgcatgccgttcatgcccgccaccgtggattcaccggaatccatatgcagggtcttggcgaaccatgtgcccacgatcggcacgccggaagccttgcaggagctggaatccaccgattcggacgcgcagttcacgtcagcatggatattaagttcgggggcaaaattcgtgatgttgaacgcccagaagatggttttgatcttcggtgcgtccgattccttcagaaatgtggtcggatcggattcggaagtgccggaagcgttgctattcgcgtcaccccccgtgttgtacaggtcgttgacgacggcatcggccttgggctgcacggtgatgttggaaccgtacgtcgacagttccgcgttcagcttgtctccaacgtcgaacaccacacccagcatggccacgctgaccgtggccgacaggcacacggtgaccgcgatcagcagtctgcgtttgaactgcctgctgaacgagcggaaaatcattcgaaaaaagaacatgactacctctttccgctcactggaaatgcgtcgacaatgcgtcgagcgtcgaagtttgaattacgattttgccggattcaacctgataatcgaacggcacaggattgcagccgcccttgaatccgatagtggcgaggttgatggcgacatcgcacttcttgcagatgatcttgccatccttctcgtaatagcccgcgtcaccgcagttatcgcatgcgtcaagaccgacaccgtacgctccaccattctttttgatgatgatgaaacgcattaccgtgccatctttcgccttgtattggaagcgatgcaggtgaccgtcgttgatctgactgaatttgatggtggccacgccgtcgctcagcgaataatcctcaggcggagacagcgtaatgaccttcttcgtttgcgccacaccatacgtgagcgcgaacgtgatgccgatcatcgcaacaagactccatgcgccggccgccttcgcacggcgacggaacgcgatatgcgatcgcacaatggcctcgtttgcgccttccggcttgattttgaagcccatcacaatgctggcgaccaccggaatgatgaacaccaacaccatggcaatgaccatatgacgctgatgattgatgcaccacaccaacgccaggaacgcttccgtagggaaatgaacgatgcgcttggactgcagaatctgcgcaagatcagtgaaatgcgagacaaacagcagcgcaatcagcagcagcacggccgtggtgaacgaccaacgaatcgcagtggaacgcatcgtacggaaaatcaacgctgcaacaatcgcagtggccgcacccaatgcgaaaccaagcgcacgaagcagcatatccgaagtgaagatcggatctcctggctccacgaaaatcgtcaaacgcaaaataacatcaggcaacgcacggaaggtggtggaggcaatcgcaagagcgccaatcgcattcgcaatatcgagcaacgcgcgatgatcatgccaattcgtagtgatgcgacgtgcgaacagcacaacaacgaacactgcgatatcgaaaatcacacaacaccacaacgtggggtaattgacgaacgtacgctgattgatcatcgcggatgcacgcaacgcggcgaacacaatggcacccgcgaatccaataatgaagcccgcaagacgccagtacgcgctcaacggcttgtcacgcccctcaccgaccgtgagcatcacgttcagcgccataatcagcaaagccggtgccagcgttccctgcaacaccgtgacgtactgcgtcagcatctcacacctttcgttatatatccctgtcaaagcctagtgaattcggcacgcaaaaggaacccccttaccaagattcccccaaaagcgcgttatctcccaaaagcgtatcccctcaaacgcaagagagcggttgcttggatggttgttcgaccgtaggctcggccaaacggccttgagtgcgtcgaacgactatccaggcaaccgcgaacgccgtacccatattcgcgctacttgcatacgtttcgcgatacgtgaacggcgttaaccacgagttgaatctcaacatgaattcaggcttacatccaaaccgtttcgcttggcatgtgccggaactcacgtttcagatcaccactcctgcggggtgtagttccactccgggaaagtgacctcgagcggttcggtccagaagcggcccttaacgccggtctccggatcaacatgcagcatccaacccttcttctccggagattcgatcttcagcacgagcttgtaggagccagcctcgtcgagcttgacgttggcgccgtagtgcgggccgtcggaagcgttcatctgcatgaaggtaccggaaccaacggtctcgttgttcgcgttgttgatgatctcgtagttcacggtgaggtccggcacgaagtcgcccttgccatagccgagctcggtgcccttcttgttggcgtggatgtcggcttcgaggtggaagctcgcgtcggcggccttcaggcccatgccggacggttccatgtcgatcggctggaagtacacggcgttgacggtcagagcgtcaacatcctgatcggagtgcttctcgtcgacctgaatctcttcgaagccggcgccgttgctgtcatcagcgctggaatcgctggatttgtcggtggtgtccgaagtggaggtgtcggacttggcatcggatgcggaatcgttggagttgccgcatgcggacagggagaaggccatggagccggccagcaggatgccgagcagggcggcgatcttcttattcttcattgtgttctcttccttttctttggttccttgaggaacgttggaaacttatggaaatctctaaatctttacttgtgattattgattggcgcttacttagcctgttccgcctgcgcggccaacttcatcctgtgtttcttgatgaaaccgaccacgaacagcacaaccaccgcgatcgcggcaatcacctgcgccgtaatcgtttcgacgtacggatacaagccgatccaatcgttagttggcacgctgctcaagtaggtgccttcaataagatcaccctcgatgagcgcatggatgccgccacccgcgaaaatgacaaccaatgcggccatcacaatcgaagtgacgaggaagaacgggccgatcggaatcttcaccgaagtgaatcgcagaatcaggaagataacgatcagcaccgcggcggcggccagaccgccaacccacatgccgtgcgcatcctggctcatggagtagatggactcgtagaagatcaccgtttcggcgccctcacggaatacggcgaggaagctcagcatggcaagcgaggcgatcatgcccaagcccaggccctggccggattcgaccttgctttgcgcgccggccacagccgcttcggtcttgttcctgatgtagttgttccacgcttccacggagctcttgttgagcatccagttactggtccacagcagcatgagagtggcgatcagcgcgcacacgccttcggaaatctcctgaaccgggccggaaccgccgaacaggaacgtgaagagtacggcgaccaaaccggaaccggccagacctgcgaccacgccaagatagatccacttggcgaaacgcttgttgccggacttcaccaggtaggcgatcaccgcagccaccaccagcagcgcttcgaggccctcacggatcagaatgaggaacgcctggccggcggagctggtgacgagcttggtgaagccgttgacattgccggacgcgccaccgtccagggtggccgcgtcttccacgagccagcttttcaaatcgtcgacatgctgcttgatttccttgtcggaaccgccgtcgcgcatgatcttacgagtcatcttgaactggtattcgacctgcgaaacacgatcgccggaaatcacgttcatcacgttcttttcgaagccgagcttctcgtagtactggtagtaggcgttgttgaccagcgtggcaccttcgtcgcccttgccggcagcggcagcctcgtatgcctggtcgagaatgacggtcatttcgctggcaacctcactccacgtgcggtcgcctttgcctttggatgaattcttcttggccgcgtcgagcttcttgcgctcttccgcggtttgcgcggcacgctgcttcgcatattccttaggattggcgaggtcggcgttcgcgtcaagcgtttgcgcggttgcgttgatttcggcggtcagcgcgtcgattttggctgcgatggcgtcgccttggtcctgctggtaggcaagaccttcaagatcggtgaattgctgcagcagttccttctgcttgtcggcactgatggtgtcgttgacgactttcgagaagttggatgcgtcgtaaccgatccaatgcgcggtctggaaatcggtgccggcctgaccgtaattgccgtcattgtagtctttttcggcagtcgcaagctggtcttcgatgttcttcgcagcggcagtccaggaatcaaaattcgtttgaccgtcatcggcggcaattgccggctgcggaactgcggtagtcgcgaaaagcgtggtcaacgcgatcatcaatgccgcaatgaacgcgacaaggcgaccggacacacttgtagcccgctgcgtatcgcaggatgacataagaccgcttcctctctcagccgttcacaatccgattcacgagtgcgccacctttgccatacacacagtgcgcaccgacttcacaagataaaacgaaaaaaatcgaaagaacagtcttgattttttggcagttttgttgtagaaacctttaaaatggcggaattccgccattcttcttttctgtaatccgcgcgagtcgtctcacatagtgattttttgaggcgctttcgccgttcctctccatgcatattcgtgcgattggaagattcgggaattgggggatttgggatggagctggactttctgacctcacgattccgccctggtgacctcacgattccgaaaaagcaacgaaaaacaaaatcgtgaggccagcgggcgcatggacggaatcaggattcgagcacgtcaagcaccttgcgttcgttgtagaacgcgaacaccacaccgccgatgccgcacaataccgcggcgcaaacagccgcaatgcgatagccggcgcccgacgccatgccaatcgtgctcacgccggtaaacagcagcatcgccaccgactgacccatcttcatcgcaaacgtgcgagccgcatagaacatgccctgacgatcctgaccggtcgttttcgagctcgcgtcggcaatattcgcaacaatcgcctgcggaagaatgccgaacgcggccatcggaatcgcgccgacaatcgagagaatcaagccctgcgccatcggcggaatcgcagcgagcagaccggagccaagcgcgcccgcaaacgcgaacgcacatgtgaaaatcacgaaagcgaccagcagaatccgcttcttgccaacacgattcgccaatacattcaccggcatgtagaacagcaccgacactgcggtcatgagcacgaaatagatggtggtcgtggtctcgggaagtttgagcaggcttgtcacgaagaacggcaaaccagtctggaatgtagtgatcgcaacccaatagaccacgtcggagcagacgaacttgcggaattcgccgtcgccgaacgtctgcttcaacgattcgatggtcgattcggacgtgggctgcgagttgacgtaatcgcgttccttgatggtgagcggcggaaccagcatgcacacgaatgcgatggccgccatgatggtgaacgtcaaacgaatggcgttcacacgccccaagcccggcacgaaaccagcccaaatcaccggtgccacgtatgcaatggcggtgccggccacccacgtgaacgaaatggcggtggagatggtgagctgctgtttggaatcgtgaccaagctcggcgatcagcgcgttgtagggcgtgcagtagaacgtgagcgcaatgtagtagccgatcaccgtggcgaacaggaacgcgccgttgatccagctcgtatcgttgattggactccaaaacaccagcacggtgacgagggcgagcggaagggccgcaaatttgaggaacggcatgcgacgaccggattttgatgtgcaacggtcggaaagacttgccacggccggatccacgaatgcgtcgaagaagcgggcgaacgcggtgatgccgccgactacggtcaccacgccgagtacggcaagaccttgcggtacgaacacggtttgcccttgcgagatggtttcgctgtcaggctggtagaagtagacgagccaattcgaaataatgccggaaagtagcgcccagccgaattggccgacggcgaaagcccagactttgggcatcggcaggctcttcaccgtttttgttgtgcgcgtggctgcacttgcattctcgacgttccccatatcaacctccatgttgacgccctgccggcaactgtaccatgcgccccatcgcgaaagtcccatttcccccagcagctggaggaaatgggcgggtagcatcggaggcatggattctttgacgcaacgcatgccgtttgtcacggcgttttatagggcgctcggcaccggtatggtgatttccgtggattcgccgatcgacgacaaggtgcgttccgcaatggaatcgctcattgaggattacgaacacgtgctgtctcgattccgcaataattcgctgatcgcaacgattggcaagaccgagcatggcggaagtttcgattttccggattggtgcgcgccgctgttcgacctgtatgatgcgctattttccgccacttccggtgcgattgatccatgcgtcggcgaggatttgatccgacttggatacgatgcgtcgatgagtttcacggttacgcaggatgcacccgaacatttgggggcattgcgtggacgcgccacatgggggcaggatgtggagcgtcacggaacaacactggtcacgcgcggcccggtgcagttggatttcggcgcatgcggcaaaggctatcttgtcgatttgcttgggcgcatgttgcggtcgacacagtttgtgattgatgcggggggtgatttgctgattcatgcggaacagcctatttccatcgcacttgaggatccggaagattcatctcgtgcgattggagttgcacacatcgtaaatggtgcattgtgcgcgagcgcacccagccgacgccactggaacgtagccgtcaacgagcgcacccaaatcgccattcatcatctgctcaatgccatcgacggactgccagcacagcagaccgaagccagctgggcatacattccctgcaatccgcagcatttcaacaagttgcaccatactgccgataagtcggcaaacgcaactcccgacattgcgcgcgactaccccgccgccgtcgcggacggcctggccacagccttgttcgtttccgacgcaacgcaattgcagcgcacgttcgatttcgcatacgcaacattgaacgaatcccgtcaaatcgcagccagccgcaacttcccggccgaacttttcctgcgatccgcataacagccgaataacagccgaaataaacaaagaccgcacgcctttggggagcgtgcggctccgtgaaccagtcgaccccgtgaatcagtcggtgagggcgaactggctgttgtagatgtcggcgtagaagccgcccttggcgagcagctcctcatgcgtaccgctttccacgatgtcgccatggttcatgaccaaaatcatgtccgcatcgcggatggtggacagacggtgcgcgatcacgaacgacgtacggtccacggtcagcgcgtccatggccttctgaatcagctcttccgtacgcgtatcgaccgaagaggtggcctcgtcgagaatcagaatcggcgcatcctcaaccatggctcgcgcaatggtgagcaactgcttctgaccctgcgaaagcgtggccttgtcgtcaagcactgtgtcatagccattcggcagcgacatgatgtagtggtgcagccccacggccttgcatgcgtcctcgatctgcttgtcggtgacgcccggcttcgaatacgcgatgttttcacgcactgttccacggaacacccacgtatcctgcaataccatggagaactggtcatgcacgttccagcgtggcacggacttcgtatccacaccatcaatcgcaatcgaaccgcccgaaatttcatagaaacgcatcagcagattcaccatcgtggtcttgccggcaccggtcggaccaacaatcgcaaccttctgaccggacttcaccgaagcggagaaatcgttgataatcgtcttgctcggatcgtaaccgaacttcacatgactgaactcaacgtcaccgcgcaccggtttgccgttcacgccgagcagcgcctgcttgtcggattcgtcggccatctccggctcttcaaggaagctgaacacgcgctcggaagcggccgcgcaacgctgcaggttctggaatgcctgcgcgaactgggaaagcggctgggtgaacagtcgaatgtacatcatgaacgcaacgatcacaccaaactcgatcttgccatccatcgcaagcacagcgccaaccacgcacacaaccacgtagccgaaattgccgacgaaattcatcaacggcatcatcaggccggaaaggaactggctcttccatcccgaatcgtacaaatcgccgttgtacttttcgaacgcgcgaatcgaatcagcctcgccgcaatacgccttgaccacggtgtggccggcgtacatctcttcgacgtgaccgttgacatcgcccaatgcgatctgctgacgggagaagtacttctgcgaaaccttcatgattgcgcccatgatgagcaggccgaccaggctagaagcgatggcgcacaccgtcataatcacattgttgtagaacatcatgatgagcgcgcccacgaacagcgtgaccgacgtgatcagcgagccgaccgactggccgagcgtctggccgatggcgtccacatcgttggtgatgcggctgagcacatcgccgtagctgaccttgtcgaaatacctgagcggcagcttgttgatcttcacgctgatggcttcgcgcagctcctgtgcggtgcgctgcgtgacgttcgccatcatccagctttgcacgtagcacagcaccgcgtaccccacatacagcgccaccagcagccatgcgatgtgcgtgaccgcgtccatgtcgatcgcaccgagcaccggcttgccattgactagcgcaggcaggcctttggcgatctcgttggtcatgtccttgagcttgtccggaccgacgatctggcataccgtgccgatcgcgcccaatacgagcgccacaatgatggcgggaatgtagtggcggcagaaatgcaccagtttcttcatcacaccaccgaaatcctgcggtttttcaacggctccgcggccgcgtcccataggtcctcctggcatatcagcgaccctcgctttcgttcaattcgctttcgacggacggcttgccggtttcaatcggtttgccggtttcgcccggcagcttgctttcgcccgacttgccgccgttcaattcgtcttcgctcagctgagactgcgcaatctgacggtacacatcgcagttttccagcagttcgctatgcgtgccttggccgaccaccttgccgtcgtcgagcaccacgatgcggtcggcgtccataatggtgccgatgcgctgcgcgacaatcagtttggtagaatctttcgcttccttggcgagcgcatcgcgtacggcacggtcggttttgaaatcaagtgcggaaaaggaatcgtcgaaaatcaggatttccggatgacgatagacggcacgtgcaatcgacagacgctgtttctgcccgcccgacacgttcgatccaccctgcgaaatcgcggaatcgtactgcttttccttggttgcgatgaattcggtcgcctgtgcaacttcacatgcgttgcgcacgtcggcgcgctgttccgaagtgagtgtgcgatgctcgttttgcgttgcgatcagctctttttcgcgctttctgccggccgcggtcgaggtatcggccatgtcgacgatgccggcatcggtggtgtcgagcggattgtcgccatagctgacattggatgcgatcgtgcctttgaacaggaaggattgttgcggcacatatccgattttgtctcgtaatgccttgagcgtgtagtcgcgcacgttcacgccgtcgacgagcacctcgccttgcgtcgcgtcatagaaacgcggcacgaggttgatgagcgaggatttgccggagccggtggagccgatgaacgcgaccgtttcgcccttcttggcagtgaagttgatgccttcgagcatggcttcacgcgaatccgggtaggtgaaggaaacattgcggaattcgatttcgccctgcttgcctgcttcgccagcatcgctgcgggtgccgtcggtgatcagcggttcggtgtcgagcacttcgagcacgcgctgtgcggacacgtccgctcgcggccacagcacgaacaccatgctcatcagcaggaagctcatgatcacctgcacggagtagctggagaacaccaccatgttggagaaggtggtgagcttgtcggccgcgtcggccgcgtcgatcaggtaggcgccgatccagtacacggcaagcataagaccgttcatgatggtgttcatcaacggcatcatgaaggccatggcacggttggtgaacagctgggtgtcggtgagttccttgttggccttggtgaacttggcttcctggtaatcctcggcattgtaggcgcgcaccacgcgcaggccggtgaggttctcgcgcgccacaaggttgatgttatcggtcagtcgctgcatggacttgaacttcggcatgacgagaaccatgaggatcgtgatggagaccagcagcaccactaccgcgatgccggtggcgagcgtccattcgagaccgtctcccgcaatcttgcagacggcccaaaccgccataatcggcgatttgacaatcatcatcaatcccatggtgatgaacatctgaatctgcgtaatatcgttcgtggaacgcgtaatcagcgaggctgtggagaatcggctcatttcagccggtccgaacgattctaccttgcggaattccatggaacgcagacgctggctgaacgatgcgccgatgcgtgccgcgaaatagccggtgatgatggcgcatgctgccgatccaagcgaaataagcagcattttgccgccggcgatccaaatatcgtgcatttcactgccgggggtttccacgagggtggtgatgtcggacatgtagtccggcagggtcaggtcaagccagatctgcccgacgatgctgaccagtgcaatgagcatctggcctatctccgctttggagaggtatcgcataatgcggaacatgcttggattccttctcttgtgttgcgtttgaagtttttgcgattgatggattggttggatcaactacatgagttgatcgaattgcgattaatgatttacataagtcctattgaattgtcttacgatatttaattacttacagtgtaagacaatctcatatttctgtgtatttgctgagagcgattcttctcagctcggtcgcgcgcggccaacatataccattcgcgacacactcaaggccgtttggccaagcttacagtcgcgagcggcgcatgccggtcgcacgcttacgtggtaggcagtccctacgcaggatcttcagattcggcttttgcgaaggcttgctttacttcttcggcggtgggacggggctggccagggatgcagatggtcacgtatgtggcaaattcctcggtaagatccacgaattcgcgcgtgcgacgctcccccatctgcgaaaagacccagcagacggcgtcgcgcatatcctcgcgctgctgcttggccttcgcccgcccctgctcggtaagattcacatgcacaatgcgtcggtcgttgggatcgacctcacgctcaatcagaccctttttttccagcgcagccagcagtgtggagatcctgcccgacgtgaccttcaacgcggtagccaactgcgagggcgtttgcgcgcccttgaactcaagctcgcgaataatgaatggctcgcccttggaatcacgcgacatcgcctgctgcatctgagacttcttaccccagaccactttcatcagcttgtcaaacgactcccgctcgaagcccacgcttcacctcgccttattcgatgcccatcagttatgtctcgataatatcttttactgtaaacatttttcgatcgcaacgtgcaagtacaggaaaacgcccaaaaaaggaaacgataatcagcaaggaagcatcgcaagctcttcttgagtgagctgaagttgcgttgcagcgaaggaatcgttgatttcctgcggattgcgagcgctgggaatggtgaacagacgttcgtaacgggtcaattcccacgccagcaccacacgctggtaggagcaaccacgttgcgcggcaaccgtgcggaacggatcgtacgcgctctgatcgaacgtatcgaggaatccgccgagcggcgaccaacagacgaaagcgagccccaattcggcgcaatgctccatcgtatgttccggatcgggatgcgacggcgagaactggttttgcacggagaccaagccgctgccgataatgccgcgcgcaagatcgatctgctcgttattcacacgggagatgcccgcatatttgatcacgccttcgtcgagcagctgcttcaacgcgccgcattggtcttcgtaaggcaccgcgggatcggggccatgcgaatacaacaggtcgagcgtatcgacgcccaagtgcaacgcggactccttggcgtcacgaatcatggtttcggggagcgaatccgccatccacccgtattgactgcccgccgcctgcaaatgctggcgttcctcgccaggccgacggctgcatccctcagaatcccgcccctgagtgtccgattctggtgaatcggacatctgtaccccaaatccggcaccctgtttgtccgattctccagaatcggacacaggagcaacaaaagcggggacctccatggtgcgtcgatagccagttttcgtggcgaccagcactgcatctcgggggccattccacgaagcgagcgcatcacgcaccaacttttcgccgtagccaaggtcttccgcagtgccggtgccgggcttgctcggcagataatatgaccaagccgtgtccaaatagcggacacccgcgtccaaaccggcatgaatcgtacgaatcgcggtatcgcgatccggacgcccctcaatcgccaaagccatcgttcccatacccagccgaggaatcgtaaatcctgccaactcaccgttcatcatcatcttccccttccttccaagaacatagccgattcgtacacgttcatctcaagactaacccaacgtgaaccggcgcaagcttgtcgggcgcgtgcgcgaagatgaaggcacaaccgaacgggagccgaaaggctgagagggagctcatagagcttcgaccgaggacttgatgcgggtaatgccgccgtaaggagacgggttgttcacgccgcaaggcgtatctcatcttccgttcgcgataaccgaatatcgcgtgattagggtcacggaggggcgcaccacctcatagggtacggttccttcggcgacccttttttcgtaccagcattgagtgtccgattctgcagaaacggacgcacaagcggctcgaacaagcgcctacgtgttgacgaaacaagacgcgaacccttgcaaacactggaaagcgtcggcgtgtcgaaaacacgggaaaaacgggctgcggacgccatcgcgtagcgaaagaccgtcggaaaaaccctgaaacacctcaccgcaaaccaacatccgggcgtgtcgcaaccacactatccgtttacggcccatcccccaagccaacccatccgagaaaacctcccagctgaaagctgaaataggagaaacagaagaaagcagataaacgaaaccgcaccgccgatcgttgtcctgaacacattcagatcccaactgatcgaaagtgcggttttgcatatgcgcgtgcaagcgacggcagaacaaggcagcgcagccaaaaatcgattaatcggtgcaaccgaaacggtagagggcccaaccctggccgtattgcgaataatcggcaaccttcaccaacgtgccgccatccacatacgtatcaatcaattcctcattgtggaaggaatcgtactgggcgcgatacgggaatgactgcagactctgcgcctggtcgcccatcgtaaggaagtattccggagcgtcggtcagcggacataccgtgccgagcacctgctgcgcatcgccggaagcaaacgcggtctccactttgccgaacggagcggatggcacatcggtgcgcgcattgatgatcggatacaacatgttcgcgttgaacagcgtctccgcatacatcgaaccgttcaacggatcggaaatgatggtggcctgggtgcccgtacgttccgtgaccttgcgcagcacagcgatcttttgctcggtgagctgctcgttggggtcgctttggttcagactggaatgcgcgatgatcgtgtcgcgagccgcggaacgcgatgggcatacgatctgcgcggaaaccgcaagtatcgcaatcacaaggaatacggcgattaggacgatccaattggaagcgaaagaagcgttcttcacggaagaaacagcagacgcagaagaaagggaaggaacggaagaagcactattcttcgtggaaaaggaagatgcagaaggagcgaaagaagcggatgcggcgcacgcggaaacgcattcggcaagagcgttgattccaatgacaagcagcggcagcgtgaccagcggaagcatggtcataatacggttttcatcgcgataccacggagcgctgatgatattcggcaacgcgccgaccagcgtgaccgtgcacacatacaccagcgcgaccagcaggaatgcggccgtcaacgcaatcacgtcacgcaggcgatcgttgcgacgaagtcgagatgattcggacgacgcggacgcggcatcagtggcgttggagtgcgacgcaggtggcggataggaaacggaaaccggggaatcagcggcggaaaccgcaatatcagaagtcgaagcatcaacatcgacatcagcagaagccacgggaaccacagtggaagcagccgacgaaaacgaatccgaagcacgcgcagccgcgcggcgggaagcgcaaacgaaagcggccgcagttcccgcaatcagcaacagtgcgaacagaatcgcaggaaaaccgtcaagcccatccgtgagacagaacgaaatcgactcccacaaattcttggacggctgatggctatggaaccaggaatcgggattcgcccagcggtccgatttgaacgacgtcagcatcaacgccacaaacgccaccgcaccgacgcacatggcaatgaacgcgccaagaatcagcttccacggcaagcgcagcacaatgaacggcaccaaaatcagagcatacgtgaatgcgatacgcgggtgcgcaacgaggcaaaccacgcctgcgacagcagcgatcgcaagccattttgctatatgctcgcgcgcggcgatcgcatcgaacaagcgcaatgtggcggcgatgaggaacggcagcagcgacgtggcgaaaccgaatgcgatcagcggaccggcattcagcagtccgtacgggtggcacaccgagctgacggcaagcacgggcacgaacagtccaatcagattctgcagaacgaaagtagcgtcgaaagtgacgttatattgccgattcacagctgacgatacctgctgatttgaaacattcgacgattcagatacggacgacgattcaggcgtagacgatgcttgagaaatacgtgaaattggattggaaattggattaccgcgattccaacgttgcaggaaatacctgcataataccagcattccggcagggaaaatcacgcccgaagcaatgatccacgtgatattgaatgccgcgtagatcgaacattgcacgccgaacagcgccgcgatcttaatcacaaggtaagcacagatgtgaaacaacggcggataaaacgaatcatgcggccacaaatgcagagccgcccccaatccctcgtcaagcagacggtgaatgaaatagtaatgcgcgggggcatcgctgctgacgatcggcgtattccacaccgtggaggggaaccacgcaatcaccaggcatagtgcggacgcgacgccgataatcgacgtaagccacggcaataacgcgtgacgcgatgcaggacgcagcatcgcgtggcaccgctgcaggccatgtttctgcccggacggaccgcccttggctgaatcattcctggctggaccattcgtagccgaaccatccttggccgagccattctgccgagcctgagtctgcacataagcctgcacatgagttcgcgcacgagcctgagccgagccacaatcgcccgacacggaaccggtattcgtaatctgttcggaagtcatcgattccatcgtagcgagtgccgcaaccatgctcaacgcttattctctggaatcacttttcaggaatcattcagacttcatgcaggggtataacagtgttgcgcaagaaaacaatcacgttggaagcccaagatgattgcacgggacgcatcatgcgctacgggcctgccttgctgcggagcgcgcgtcccggccaacgctgacgtcggcatgcgccggcgcgctataacagagaactggagaagtaccgcatgttcgttctcaagaacgcatgggcggcgcttggtcgcgtcaaatggcgcaccgcgctgatcgccctactcgcactactggtgtctttctcggctgccgtggacttggcagtgattcgagccgacgacaccgccaataatgaaacataccagtcgcaaaaagccacggcggtgattcggccgaacgcgcaaacacaagccaagcgcgacggtgccgattccagctataccgacaagtacttgacgtgggaaaagtacagcacgtatgcaacggccgcacagagcaacaacgtgaccttcaattacacgttggcaacatcggtgccggtgcgcgaaagcaagtcgttgcaggcgatcgccgcgaaaaacgacaccagcgaagacaagaccggcggcaacctgaccctgcaggcgttctacacgttggacgccgcgaaaatcaacgactacggctactacaaggtagtcaaaggcaagcatctgagctataagacgcagagcgacggcgtactcatttcgcaggcgctggccgataagaacaatctcaaggtcggagacaaggtgacggtcggcaatccgtcgaaggcttccgacacatacacgttcaccgtgcgcggcatttacgaatacgacagcgacgtgcctgagggcaacggttccgacgcgaaatacgcaaaggacaatcgtgagaacgtgatctacacgacgtatatcaacttcgccaagaacgggcttgacacgacggaggccacgggatgggccattccgaatctgaatatcatcttctcgctggcgaatccttccacctacaacacgttcgtgcgcttggtgaagaaggccaagttggacacgaagacgtacgagatcacctcgccgtcgcttaccgcttacaagaagtcgatcgagccgcttgattccgccgcttcggcagcgcgcatcatgctgattgccgtgacgattgtcggtggcatcgctttgctggcattgattgcatgtgctgcgattggcggccgccgcgatgagatcggcatggcgatgatcacaggtgtgaccaagggccgtttgggatggcagttcatgctggaaacgttcatgatgacggttccgggttggattgtcggtttggttgcgggcgcgctgttggcgaagccgatcggcaccgcatgggccggcgggcaggctgtgtcgatgacgtccgcttcggtgtggaacgtgatctggtacggcttgggcgcatgcctggtgcttggcatcgtggcattcgcgcgcgtggcctgcttcaacctgaaccaactgtttgaggaacgctcggaggtgaaggcatgagcgacaacatgaatgataagaacgagaacctcgacgagaccgtggtcgacgagactgccgagaccgcatcaaacgagaccgtcgatgatgttgcgactgacgatattgcagctgacgcatcttccgctgattccattgaatccatcgattttgcggtggtatacgacgatgacaatgcagatatcgaaattgccgcaactgacggcgcggaaatttccgacgatgtaaacgatggcgatactgcagtagctgccgacggcgatgctgtggtatctgcagataatgcagataccactgaagttgcagatgacgctgcaactgctgctgatactgcggatggttcggatgtggtcgccaacaatgcgaatcaggtgagggaaacgcttgccttgcgttcttccgacgaaccgaccgtgctggaatcacatgaaatggtgaaagccgattccgcaaccagcgtctcctcacagctcgaccgcgaaatcaagcatcatcgcaagaaggatgcgtttttcttcaaagcgaatccgacgttcgcactcgatcatgtgaccgtgatcaatcgcaagaccggccgcaatattctcgacgacctatcgctgtcgttccatgcgggcgccacgcatgcggtgctcgtggacgcggaggatcgcgaacagcatcaggcgttgctggccaccatggtcggcatggtacgcacggaccgcggcaacgtgatgcacaaaagcaccaacctgagcgacgtcgaaccggtcgaaatgttgggacaccgcatcggattcattccgcaacgtttcgctttccgccccgacctcgacgcggaaagcaatgtactgtacgccatggatgcgtcgaaccgcaacttcctcaagccgaagcctgtgatcgcccgcgaactgctcaagcgcgtgggcttcgacgaagtgacgtccggcctggcagtcggcgaagtaagcgaactgaaccagcgccgcgtggccatcgctcgtgcgctgagctgcgaggctgaagtgatcatcgccgacgagccgaccgctggattggatgccgacgatgcggccgtggtgttggatctgttgaagaagttcaagcgcgatgccgatcgcaggcgcgccatcatcgtggtgaccaccaatccggagatcgccgatgcgatggagcacagcgtggaactcgactagccgcctagtgcaacgggcgcacgaacatagactctttcgtgcgcccataggtaagccctttggaattctggttttagccaaattccaaagggcttgcgtgttctggaaacggtctgccctactcgacgatacgcatgtggtactgctcggcgagcggcgtgacgtcaagcacgccgtatcgttcgagcagccgcagccattcgcgcctgttactttcgccgaaacgggccgccttgcgcgcataggcttcggccgtcaggaacttcggcggaatcgacttgctgttgtacttgtcggccaccatcaccacttcctgctcaagattcatgggcacatagtcagccggaggcaatggcaatccttgcgattccaccgcttctttggtgagtcccacaccggtgtggttgcgcgcgaactgcgcgatagactcgtcaacaccctcattcaacaaatattcgtagcctttaagcccatgccgcacgtaattcggaccgtcgaatttcagcggtccaccgtcggaaccgtcttgcttgagcagaaaatacgtgccgatatcatgcagcagaccaccgatcaccaccagatgctcgtcgatcagcctcggcggaacggtcccacccgtaagcccgtccgatgatggaatggaggggatgcgaagcataccgaacgattcgcttccattgccatcttgcgtaagcctaaggccgaaatcgcccgctttttcaggggcatcgtccggtagtgtgcagcggcgggtgaacagtgcattctgcctgcgtgccatgcgacgtgcgatgtcggcgacgactacgcaatgtccgtgaatcaaatcgtatgcggcttgcgattgcgcgatttttcgatgcagttcgtcaacttgggcgagtgtaggaatatatccggttgtcataccgcctatcttaggcgctgtatgacgattgccgcatgctgaatccggtcgaaaaaaaaaactggaaatccccgatgaaagtttcagccgaaaaattccgaaatacggatttcagattacggatttcagatggaacgcacacggaatgcgccggtacggttggaagcaacgatcatctgattgttttccaaacgagtccagccatcttcggcacactgatcgaaaccggagctggccacaaccacgcccttcggctggcctgcagcctgatccgcttcggattcaccgagcgtacgatagcgcatcacacgatagtcatgcgcctggtcgccacggccgtactggtcatagatttccacaatgcgcttggacgtgacctcacgaccggccgcgcacagagcgatgaattggtcttggctctggatcatgcagttgtagctggacttcggatagcttttgcgcagttcgcgcaccgcctgcgcgaccgcctcgtcgagtgcgaaaccaaaaccgatgtactgcaggatcactgcgaagaaaatggcggaatcggaacggccgccagtggactgcacgatgttgggatcgaccgggaacgcgcggttggtgatgatgttgcgaccctgatcgtcggaaatatcgccattgtggatgaagctcaatccgttggcgtagaacggctgctggttttcgagaatcagcggcaggttcgagctggccaaacgcaggtgccacaggcctccacgagccggagtgttcgcaagctcgtcgaaaatcggatcatgtcgggctgcgatcgtgttcttgtagacggcggtgccggtttccggggtgggagcgccaccgtcacgcaggtacggcgactcgctcggcacggtgaccagcgcggagccccagccatcgttgtggatttcgctcagattccggaaatcgcgtacggcctgcatgccgagcacgccattgagactggtgttgcttccggctgccgcgaatccaagtaatctgcacatggttgattactctacagggcttgtaatgcaacgcgcgcatatggctatcgacattgcttatagcgtgcgaaaaacagcgtgattccaacgattcttcgagataagaccatgcaaaaacctacaaaatgccctacgaaaacgggctgcgcgacgatggcagatacgatcgccatcatcacgcagcccgtttcacggcttgtttcacacacgctttagccgcggaggacgctgagtcgcgaggaacagcggctgtatctcaatcagcggattgtaaggcgcaaggccgaaccatttgaccggagatcccgcaaaatgacgaatcgcatacttgacttccaaagaaatcgcgccacgctgcgacaccttcgactcaggcataagcgccttgtgtatcagcacatatcgaatcggaccgatattcggatcagcatcaagcttcggatagcggctttcctgcctcggcagatcccccgacttcgacaaatcgttcatgatctgatgaatgtaagctggaatcgactgagaaaccttgaaaccaagccgaatgcgaacacggaacatataatccgtaccgaaattctcaaccgaatactcgcgggtgaacggctcatcggcagtctcgacggaaaccgcccaccaagcgcgggcacgttttggatggtcggcgaaaatcgagaagaagatatcggtatcgatacgcttcgtttccggatccgacgtgaggtagacgatattgtcggcaaaatacggaatcgtatcgtcatcatgcaaccgcttcagcaccggtaggcattcggcgggctgcatatggcgacgctgcgcacgttccagcttcgtgccttcgttccacgtatacataaccagcagaatcgcgaaggtaagcagcatcgtgaaccaaccaccatgcaggaacttcgccatggaagcgaagaagaacatgaattggatcgcaaggaacagcacggtgaatacgaccgctccgatacgacgccccgaatgccagatgtagacggcaagcagaatggtggtagtgatcatggtgatggtcaacgccagaccatacgccgcggaaatatgctcggaatcacggaatagcgccaaaaccaacagcgtggaaacgcaaagcaccgcattgaccacaggaatgtacagctggccgcgggtacgggccgggtaacggacctgaagatgcggcatccagttcagatgggtggcttcagacaccatcgtgaacgcgccggtgatcaacgcctgcgatgcgataacgcccgcgaccacggaaagcacgacggccacgtaacgcacgctgggcgtcatcatttcgaagaacgggttcaaaccgtgcgtgcggatgtaagccgaatcatcccaatgattgagcatccatgcgccttggccgaaataacagagcacaagcgcgattttgatgaacggccacgtgaaatagatgttgccacggccaacatgacccatgtcggaataaagcgcttcggcaccggtggttgacaggaacaccgtacccatgatggcaagcccggcggcattatggctgctgaacaggaatctgacaccgtacacggggttgagcgccgcgaacacgctccaatactgactgaggttcgccaagccgacaaccgccaggaacgagaaccagacaagcacgaccgaaccgaacgccttgccgatacgctcggtgccacgcgactgcacagagaacagcatcagaatgatggccgcggtgatcatcagggtcagctgcttgttttcagtgaaaagtttttcaaaagctggtagcgtctccaagccttccactgccgagctgatggacacagccggggtgagtacggaatcggcgaggaacgcggcgccgccgagcatggcaggaatcgcaagccatgcaccgtactttcgaaccaacgagtacagcgcgaaaatgccgccttcgcccttgttgtcgatacgcatggcaatcagcacgtatttgacggtggtgataagcgtgattgaccagaacaccaacgaaagcacgccgagcacggcttcgcggtcggcatgcgcaagtccgccctgcccgttgaggaacgtctgcatggtgtacagcggcgaggtgccgatatcgccatataccacgcccaacgccacgatcgccatggcgggcgtgattctgtttggaccggattgcagacggctccaccaacgaccgacgggacccttgctggccacctggtcaagtttggcggcctcctgctgtttctcctcgtgctgcttgatcagcacctgtcgctcttccttagtcagcaccttgtgcgaaaccttcggcgcctgcgtgtatgtggctgcgtgaaacagcggctcatcctcgtttggctcgttagccataacgctacctccaagtggcgggccttccaacccactccccaaaataaacgcaaaaaggcacgttaggagccttacgaagtcttgtcaaatcttcacattgtttcttgcgattcttgatctcgcacgaagtaaacttcctgtgggtttttttcttattttacctcttgtctttctcttactctctcttattttcggataaatcgtttccgtcctgtcgattttcggaatttgttcagattccgtacacttcgcgcgtggtctttcgcgttgcctgcgcgacttccgtcagcggtttatcgagataattcgccaacgactgcagggtgtaggggatcatgtatggcgcgttggtgcggccccgatacggcatcggacttaggtagggggcatctgtttcgaccatgacatggctcaatccgacaatgcgcgccgactcgcgaataccatcgttgcccttatagctggatgtgcccgaaaggctgagataccaaccgttttcacgtgcgatctcacccatttcggcatcaccggaatagctgtggaacacggtccgttcgggagcgccgtccgccagtagcgtttcgatgacttccttatgtgaatcgcgatcatggatctgcatgggcaggttcagttctttcgcgagcgcgatgtgcgcgcggaaggcttctcgctgcagttctttggcggcttctccggtgcggaagaggtccatgcccgtctcgccgatggccacaacctggttggggtaggcggtggcgaggcggtgcacttcggccatggcgtcttcgaagctggtgtcgtgccatggcttgtatttgagcggcaacccgtctgggcccggcaccccgcggtgaccgtggagcacggattcgttggggtgtatggcgatggccgcatgcacggtttgggggtgttcgcgtgccatgtcgatggccgtcatgaggttcggcagttcgcatccgcagtcgatgacgccttcgactccgacttgttgcgcttggttcagcagttcgtcgacgctgtatacggggacttccggctgtcctttttcttgcgcttcgtggctcatggccagcgagaacggcacgacggacgccacatgcgtgtggttgtcgatgacgtgcgcgttctcgggaagtggttgcggtgctggcgcccagctgcggtcacgatggtgtttgctcatgcctccagcctacgctcgatggcagtcttgcttcggaagccgcgttattcattgatggcagtgggattaaccaacgcacctccatatgttttgcggcgtagcgctgaaacgctttccgcgattagtcatggagggtgagggtggtgaaggaccaggagggggcggtgtaggcgccgctggttaggtcgattgcggtttcaaccggaacggttggcgaagccttgccgatttcaccggcgtacgggtcggttccggcgagcacggtggcggttgccgaagcgcgggattccgcggaaacaccaagctcttcaagcacttggttcagatcaatctcggcttcagcgtcgagcgcgttgacgatacgcacgtaggtgacgccttcagcatcattgcgagccacggtgacggtacggcggggctcttccggcttctcaacaccctgtgcaacaagctctccatcgatatacagcttcatgctttcgccgcgatcggccacttcgatgcgcacctgccacacggttccggggaacacttcgtccatggaccattcggtgccgtcaagattgtaggcggtaccgtcgcgcaccaccttgatttcgaaagcacgaccgaaggaggtgatgttgtggttcttgccgttgatgtcgccgtggaccagctgcaagccccaacgaccctgatagtaggtgatggtggcgttgatggtgtaggcgtcagagtcaatgttgaggctcgtgttcatcggaccattgcctgcgtaatggcagtcctcaagatcgacatggcggccatcagcggtgtcaacgctgaagttggtgatgtcggcgtgagcggcaccttccaagcgcaggccaacggttggtggcagttcgcgacgtagcgtggtcttgccttccaccgcgaccggccatgcggtatcggacgtggtggtggcatacatctgctgcacccagtagctgtacggcaggtaggtacgttcgttgtcgaagtagatcagatcaggattccagctgtgatgcccgttcttggcaaacagcggcgcatacgaagacatgaccacggcatcgccgttcaattccatgcgacccatgaacgccgcttcggaaagaccgttgatcagctgcgtgttccacgaaccatactcgcccaagtacaccttcgggccctcacgatccgtggtgtcgtagtggtcgagattgtggaaccaccagctggaggactgataggaatgctcgtcaacgatgggaacgccggcttcacgcgcatactgccaaccagcctcgtagtcgggaccgctcggagccggaccgaccgtgccaaccacaacaatatccgggtaggtggccttgaccgcgtcgaagatctgctggaagcggttcctgaacacgtcatcgatgagatcttcgttgccgatgcccaaatattcaaggttgaacggttccggatgacccatggcggcacgcttggcaccccattcggtggtcgcggcatcgccattgcagaattcgaccaaatgcagcacttcatcgatgtatgccggcatgtctttctgcgcgatcggcaccgggccctgactggtgttctggcagctcacggcggcgggcagcaccggcagcggcttcgcgccaatggtttcgcacaggcacaagtattcgtagtagccgatacggaacgactggtggtagccccacaggttgaaattgtgcggccgatgctcaacatcaccgatggtgcgatcccagtggtacatgttatccatgccaagaccgtgggtgatgcagccgcccgggaagcgcatgaagcgcggctgcaggtcggcgagcgccttgaccaaatcgggacggaaatgcttgagcccgttgtaggtggtgcgtggttcgagggtaacgaaatcaagatcgacggtaccttccgtggtgaaggtgagtcgcaaagcgccttcatgtacaacgatggcattgctttcaccggaaaccgtcagcgaaacctcttgcttacgccaatcgttggaatcgacggtgatatcttgttctgcaatcgcatttccatcgtcgtcaatcagagcgacggtgacgggaagtgcggaagcttcgcaattgctggaaatacgcatccatgcggagaaatcgtaggtttcgccggcacggaagaccatgccgtcccagccgatattttcaagcgaagccggcgcctgttcgacttcgacggacgcatagtgcgggttttcttcggctaccggattgtcggtgagcacgtcgaaggctgcgaaggagccggcgggcacgattttgcgccagaagctgtagttgctccagtcggaggagtcggcgcgattgtattcgaatgcgccgttctgtacgaggtcggcgttgagtccgccgtcgccggagtagctgatgtcttcgtagaagatgccccacaggtcggtgctgatgttgcgcacgcccgccttgttgagggttgcgatgagtttgtcggtcatggtgtgtccttgaatggtgttggttgtttgttgggttgaatggtgttgcggtacgtgcgattggttgcgattcgacgtctgtctggcaccgtttcgccaccggtcgaccgccggccgcgctcggggaagcgccgctcatcgggaatctggcgaccgtacgcatcgatgcacagcggggtgccgtcggagtagccgtgcgcatgggcgttgggggtcgaaccaacccgcatcgatgactagggtgtctcagccggcgtccttgaggtggtcggccatgaagcgcgcgttggccaggacctcccgatcggtgacggtggtgccgtaggaatcccagctgttccagcccattggcggtcgccatgcttttagcagatcctcggtagtcgccattgccttctccttgtacaacgttagaaaagcgtgccgtttacagtatctgacgtcatccttgacttacttgttcgacttcatcatcttggaaaacttcagatatgtaccgttacatattttatagcatatttcagaaatcacaatcatgataggatatcggtgattctttgaaatttcaacgattaccagaaaatcatcatatataatatcgttacagaaaaacttggctgtaaggagcggtgcatggcaaacggcaaaccgacattgcgcgacgtggcggcggaagccggcgtctcccccatgaccgcatcgaatgcgctgcacggcaaagccggcgtcaaggaatcgacgcgggccaaagtgctggcagcagcgaaaaaactcgactatcgcatcaatctgacagccagcatgctcaaatcaggtcgcagcaacattattcacatcatcgtcaacgaattcgattcgccgttctattcgaagctgacgcaaacattgagccgcgagatcacctcacgcggactcacgccgttcatcgagcaaacccagtattcgccggacgcggccgaacatgcgctgaccagcaatccgttctcagggcagctcttcgacggcgagattctgcacgccaccggattgggcacgaatctaccgctcgccaaactcaacggcgggcgccctctcgtactgctcgacgcatgcgaggaaacgccaaccgtggatgccgtgaattttcccaacgaggagggcgaacgcgctgcgatgcagtatctgatcgcccagggatgccggaatattgcgattgtcgggcatacgttcgtgccgcgcgccgagttggcgcatgcgcagaacgcatttgcattgcgacttcgaggagcgtgcgcggcgttgctggacgcaggattgccatatgacgaaaccatggtgttcgaaggcggtcgctccgacgaaggcattaccgccgggcacgcgatcgccgaacggatcatggcggcgcgaaggacggactgcggagccggcgcgggtgctggagaccgcgaaacaggcacggccggaaccgccgatttcaacgatgcaagcggcaagattacgggcagatcgatcgaaacgaccgacaagattccagcaatcgcgttcgacggagtgtgctgcgccaatgatttcgccgcattcggcgtgattcgcggcctcgccgactatggcatccatgtgccgcaagacgtgaaggtgatcggattcgacggcgtgacttccggaacctacgccaccccttcgctgagcaccatccaagtggatctcgaccagcttgccaaattcgcggtcgatatgattgtcgaacggatcgaacgcggcgaagtgaatgataattccagcaatgccggaaattccaatgatgcaggcacggtgctgccgccgagccgcgcaaccatcggatatcagttggtcgaacgtgaatccacgaccgcgatcatatagctatcgtgcgttccgcgcccgattgcagcggaacgcacgatagccggaaatacggcatttcagcgattggtcggctcagccccgatcagtcgcggcggcgaatggcaaagatgcgggcggagggttgcttggaggtggcggcgttcagacgaaccgtttccggatccatgcgttcgatagtccacggtttggcattgggtgcatggtccggttcggcaggattcgggaacacctgttcgatggtttgatccgcatccaacggcatgttcacggacggtgtgccgccgcgacgccacacgatgatgtagtcgggcttatcttccggctgaggttgctgatcgttctgctcggcagcctgctcattccaagcggattcgccgtacacatacgcgtcacacatatccgtttcgacatgacgcaagccgacggcaagccaatcgccgtcgaagtcgggaagtccggacggccagaacggcaccatatgctgctggtcggcaagtacacaacgatgtaaggcgatagcgtcgcgaacgagtgaaagacgcggctccgtcatgcgatcgatgaaaccagacagatacagcctgccgagcacacccgtagcaagcgtgaacacagcagtctcatcatccatctcttgctgagcgtaaccccaattaccctgctgttccggcagaatcgtcatacctgcaccagccgcaatcgcagcataaatcagaggatcgcactggtcggaagtggactgcaaatccaagcgggacaactgcgcgtaatcggcgcgcatggcaccggaaccgcagttttcgatcatcacatccggatgacggcgacgcagatcgtcaagccaatccacatatgcgcggcaatgctcgagcaggccatcgccaacggactcggcattcaaatcagtgccgacgccgggaatggtgttgtagtcgaacttgaagaacaccgcaccgaaatcgtcaatcaaacgatcaacagtacgcgtaacatgctctcgcgcttcgggagaacggaaatcaagcagataacgacccgaatcgcacacgcgaacaccatgacgctggaagaacgcggaatccggcaacatgctcgcaagcggcgatttcacgccgatcacttcaggttcgagccacagtcccaagcccatgccatgagcacgaatcgtgtcggcaagaccgcgcagaccggcgtcgccgaaacggttggtggaggcctgccattcgccgaccatgtcccaccagccgccgtcggtgctgtcgtaccagccggcgtcaatgcagaaaacatccgcgccaacgcttgccgcaccttcaatcagcggcagttccttctcaatacgagggtcaccgaacagcgtattcatgtaatcgttgtagatcacaagaccctgcgtatgctcgaactgatcgacgcgccccaactcacgagccttggcaatgcgcagcgcacgacgctgcaacgtcatttcggcaacagcctgctgccaatcgcctgcggcaatggcaaacgacacaggaacggactcgaaatcattgccttcaccaagattggtgaaccaaccatgatccttatattccggaccgaacgcagtgacgtgcagaccgggatcgtcctcgccgacttcccactcccacggaccgttatgctcgatctgccacattacggaaaaatcgcgggcgcggcgtaccgaaccttccacctgcagaatgccggccggctcatgctctcccgagctccatgtagaagtcgagctcatggcaaaacgcgaactagactgaccaggattgattttctggttgcggttacgcacctgagtgtcacgcagcggacgaacacgccaatcgttttccacagcccaagcggcatcgccccagaaaatattcgaacgatgcaccttgccgcagttgacgcgcatcggaacggtcagattcaacgatgacaccgcttcaatcggcagttgcctggcggactgcagacgcgtgtaggtgcgcactgcggaaagattcgggaacgcctcgaatacggaagtgaccaccaagcctgcattggaatcggcggaaaccgcctcggacgcggaattcgcggcggaatcggctgcgtcacgttcgcttgccgtcggctcgaattcacgacctttcggttcaagatcggcatacggcgcgaactgcgtgatctccaaacggaacggatcggcggaacctggttcaggttcggaagcaagcgcggaaacgaatcgcaattggctgccggcaactgtggcaatcagcgtcagtcggttgtcttgcgaaccggtattggcggcacacacctcaacaatcggacgcggatccttttcaaccactggctttccatcgtcagacaagcgaccatcgatcggaaccatgttgcgccctacaacgttgcagaggcgaacgggggaatcggcggcaatgtcaaacagcatggagaccacaccattgccccattcaaggcgcccatcctgccgaggaacaaggggagtcatattgccgttctccattgccatctccttcgaattccgaatgccgcctatccgttgacgtgcatcgtttgacgtaccctcactagcttaagcggaaaacggggcaaccgcgatgtgcgtgtctacgcacattcagcaaatattcagcaactgaaatgaccgttcgaagaccagcaaatacctactcgaattgcagatattccacgaattgaatcggcatatccttggattccgtgatattgctgaatccgagaataaccccttctttcggcagtcccttcatggaagtccatgttttcgaatgggacaagtcgaatccgacagcgtcgttcacatcggaaaccggattgcctttggcgtcgaccagcgcatccttgacctgctcaagatcggcggcactcatcacttccgcgggtttggtgatgtcgccgcgatcattgacttcggcgaaaatatcggtttcggcaacaatcatgttgatctgacctgccgaaacgcgagccgtcaacgatgcggaaccatcttgcgcggcattctcgctaatcgcaatggaggcatccgtccgcacgagacgctcgtcttcaataccttgcgtcttcacaaaatcagcgcccaacgcatcaatctgttcggaatattccgccatatcgacaccttcaagactcagctcggcctcgggacctttggtcacatacgagatgacgaaagcaagtaccaagccgaccactgcgataatgatcagcacatcggtcagaaagttctgcttgaagtacggccacttgtctttcggcggcagctcgcggaaggttttgaatttcgattgcttcgcatacacgttggtggatgcgagcgctgcgaccgcatcttgctgctcctgggtgagaactggcttctctactgccataccaaaccttcccgcgttgtttcatcgacgcattcacgcgtcatcttcatgcgcagcaacatgcgttgctttctcacttccctatcttccgcctcgtacctgataatttgcggctagccgccggccgaaaacgacaagcggctagcaggaaggctgatttcaagccaatcagtccaagccctaatcagcccatttagaccttgatcatggcgtattgggagtcgtagaggcgatagtaggcgccacgcttggcgagcagctcggcgtggttgccttgctccatgatctgcccatgatcgatgtagcagatcatgtccgcgttctcgatggtggacagtcggtgcgcgatgatgaagctcgtgcgtcccttcagcaggtggttcaatccggcctgaagtgcctcttcggtacgcgtatcgatattcgacgtggcctcgtcgagaatcagaatgcgcggatcggccagcagcacgcgggcgaatgcaatcagctgacgttgaccagcggaaagcgtggaaccgcgctcctccaccaccgtgtcgtatccgttcggcaaatccataatgaactcgtgcgcatgcaccgccttcgcggccgcttcgatctcagcatcggtcgcatccaacttgccgtaacggatgttctcacgcacattgccggagaaaatgaacgtatcctgcagcatgacgcccatctgccgacgcaacgattccaatgtgaccgaacgcacatcatgaccatcaattgtgaccgaaccttctgcaacgtcgtaaaaacgcgacagcagattgataatcgtggttttgccggcaccggtcggaccaaccaacgcaacggtgctgcctggctcaacatgcagatcgaccagattgagaatattgcgaccgtcaggctcgtaacggaaaactacatcgttgaaatcgacgcgtccttcaatttgcggcagttcagtcgcgtcaggagcgttacgaatctccggctgcacgtcaagcgtttcgaaaatacgctcaagatatgcggaacaagtgatcagctgattgtagaaattgccgatgctgatcaccggattccagaaattattcgcatagccaacgaacgcgatcagcacgccggtggaaacgttcaccgcgccgaagcccgtgacgcccacatagtagatgaacgcgatcgtcatgacggaaatggtttgaatgcccggccacatgaggaactggatatgcacggccttcatccacgaggtgcgcacgtcgtcttgctgcccttggaaggttttgaactgcgccgcctcctgggcgaaggtctgcgtggttttcacgccggcgatcgactcgtgaatgaacgcgttgagattgctctgcttgttcgacaacacctgatacgcgcggcgctggaaatgctgcaataccagcacccacgcgatcaggaacgggaagagcaccaggctgaacagcgcaagccgccaatcgaccacgaacatgaccaccagcgtgatcaggaaggtgaatacgtcggaaatcacattgatcaggccggaactcaacgtgtcggaaagcgtgttcacataattgaccacgcgaatcaggattttgccgtgcggacgcgaatcgaaatagctgaacggcagcgtctgaatatgcgtgaaaatatcgcggcgcatgtctttcaacatgagctgaccgacgcgagtaatttcgacggtacgataacgcaatccaaactcatacatcacaataagtacggccatcaaccccgttaattcaccaagtaaggtgagatttttcgacggaatcgcgctgtcaatcatgattttcgtcaaatatggcacgactaccgcaatgcagctcatcatgacgacgacggcaagaatgcgtatgattcgcgacatatacggctttacatagacgccgatgcgcagaatatcatgcaggttgatctgttcttccagctcttcatcttcgcggtatgtgttacgttttgccatgggttttcccccttttctgctttcccgcgcctacgcttcgaaaccttgcgaacgacccgcctgcaagccgagctgcctgtagtagatctcccaatatcggccgtgcgcggccaccagttcgtcatgcgtgccgcgctccacaatgcggccatgctcaagcacgaggatcagatcggaatctttcaccgatgaaatacggtgtgcgatggtgacgatggttttctgttcgtccagttcgcgcagatggcgctggatttccgcttccgtttccatgtcgacggcgctggtcgtatcgtccatgatgaggatcgacggattgtcggcgagcgcgcgtgcgaggctcaggcgctgtttttggccgccggaaaggccgacgccacgctctccgaccacggtatcgtagccttccggcatgctgcggatgaagccgtccgcgccggcgatggtggccatgcggcgaatgtactgttcgtcgtattcgcgttgttcgcccgcgccgaagctgatgttgccgccgatggtgtcggagaacaggaacgtgtcttgcgccacgacgcacacttgcgagcgcagtgtggcgagcggccagtctcgcgcgtcgacgccgtcgatgagcacatggccttcggtggggtcgtagaagcgggagatgaggttgacgagggtggatttgcccgcgccggtttcgccgagaatgccgagtttggcgcctgccggaacatggaaatccacatcttcgagcacgggggtgtccggttcgtcggggaaggcgaagctgacatgctggaagtcgatgctgcctgcgatgcgggttgtgttggttgttgcagcggttgcagccgctgtgctggcgtgattcgcgtcggcgctgtctcccggtttttccgtattttccggcttttccgtaatacgtgactgagcggtgagcagtttgcggattttgatgcaggatgcgttgaatcgctgccagtcgttgatcagccatccggattggcgtaccggcccgtcgatcatccacaggtaggagttgaacgccacgagattgccgagggtcatgcgcccggtgatgaccaggaatccgccgaatccaagcgtgatcagctgcagtgagaagccgagaccgtcgagccacggcatgtatttgcggctgttgtaggcctggtccatgttgcgttgcatgtaatcgtcgttgtgtttgtcgaatttttcggtttcatacggttcgcgcacgaacgctttgaccacgcggttgccttcgatgttttcttcgaccattgagttcatttcggcaagcgagttgcggatggcgaagaacagtggtcttgcgtgcgtggagagtccgcgcgtaaggatgaaaatgaacggcgtgacgcatgcgagcgcgagcgcgagccgccagtcgatggtgaacatcatggcgagcgcgccaatgaacatgaccacgcagtcaagcacctggtagctcacccagctcagcgcgtggcgtatggcatcggtgtcggaggtcatgcggctcatgatgtcgccggtacgcgtgtggttgaaataggtgaagtcgagttcgtgcagtttctcgtattcgtcgctgacgagacggaatacggagttctgcccgaagcgttccatccacatttggtagccgtagcgcgaggcgacgcgcacgatggtgaacacgatcatcatgatgcacagtcgcgtcagttcgtcgacttggccttgcacgatgacacggtccacgatgaggcctgacaatagcggaatgatgagcgccatggtgttgttgacgcagaacagcactatcgcgccggccactcgtggcaggtcgggtttgcagtatggcaggatccatttaaggttgcctgcttctgtattacgattcggatcgacgtacatacgtagcgttccttcggattgtttgctggttgtttgggttttcgtgggttggttttgcgtttttgcgttgcttttacggccattcgttgccgttacgattcacgtccgtcgtttgtcgagcgtcccgttgccgtctctctcggtcgaaacccctgttcggattcgcaaacgcgacttattctatgcgaaccgttttttgatgcaacgtgagtgatttcggcgtgtcgcaatcgcaataaaatcaacgcatgtaccgttacataaattcgctctggacgtaaaggaatatgggtgatcgcagtagcgctttctatatcgaaccggtacgatatatcgaggtgcggcattccgatgacggaacggccgcaatcgcatgaacatcatgaaaggacggcgtcgatgacgagcacacagaccattgaggaactcagcgcacaatgcgcggcaaaatatggcatcacccgtgagatgatcgaccatgcggaacgttggacggaaaccgacggcgatctcgaaggcctttccgaagagcgcgtccgcggcattctcgacatgcgtttcggcgcgatcgcggttgacaccccgcgttccgaactgtggcacacacctgacacaatcgacgtgatcgaagatattccatacctgcctgacggtggctacgatacggaagccgggcagtgcagagggcatttgctcgacctgtatctaccgcacgatgcggtgctgcgctgcgggcatacgctgccggtgtacatcgatatacacggcggcggtttcacttacggatataaggaattgaaccgcaacttcaacgtgcatctggccgaaacgggcttcgccgtattctcactgaactaccgaccggccccgcaaaccgatttgaggggtcagctggcggacgttcaggcggcattgcgttggatcaaggcgcatttgactgattatccggttaatccgaacgccgtgttcctcaccggcgattcggcaggcggcgcgttgaccatgctgacgttggcgattgaaaacaatgccgaagccgcggccgcattcggcgtggatgagccttcgggcattggtttcgccggtgccgctccggtgtgcggtgcctacagttccgcatcgttggaaaccatgggaagcgaactgaccgtaggctacgatccgaatcgccgcaccggactcgaacagatgctgggcgtcgaattcttcgacggcatcgaagccgccgacccgaagttcctcaccgccgaaggcctggcgttcaacgtcaacctgccgccactgttcatcgtgacctgcggcgacgatttcctcgaggccgacaatctggcgcttgctgccgcactggcccgcaagggagccgatttcgaactgttcgacccgaagccacgccgccacgaaacgctcggccacgtgttcgtgatcggcatgccatggcttgacgaaagcgtggaatgcttcgaacgcctgcgcaggttctcgtacgagcgctgctgaatcacgaatgcctgcacgcgaccacgcataatcaccagcatcacaaacggccgaccatgcattactcacgcatggtcggccgtttgtcttgcaactcttttcggcaaaatcgcgaaacataaatcgcgaatcgcacgaatcgcatgcatcgtgttcagaaaagaagaaagccggcggagagaagggccgccggctgagagagaagagagaagaagggttcagttatggggttcttcaggaacctcgccagccgccgtaactgctgacatgttctatataagcgcccgagtcttggaggaatgatacgtgttcctgccaattagctgagaaaaatgtatcagacatgtgagcggccatacacattcgtgaattccgtcgaatgatcgcaacattacttccgatttgcccaatcgcacgtccatatcactcacccactccgcaaaaatcatccatttcactggacgattctgaaaaaacgcaaaatcatccatttcaccggacgatatgtcgagctcaagatgctgccgtcgtctttctcggaataccgaaatgcattgcaaccgacagcaaatgacaatgcgctgttcgaccggtatctcacatatggaggtctcctctacgtcacacagctcaccttggataccatcgggctcggcgactaccaagacattcgacaccgcaacatcctcgactggctgctcgagtaggacacactctcccgactgcacaatttgcgtccacggatcacaaggtaagaaaaatagcgggaccaaatagttcctgcataacgtgcgccgtgttccacctatgatggatatatgaaacatttcgaatatgaaatctccggcatcgacggcagcgcagcgaaattcgtcggatattgccttgataacagcgaagaagtcgttcccgaccgtgtgcgtccgtctgtgcttgtgattccgggcggcggttacgaaatgacgtcggatcgtgaggcggagccgattgcgatgcaatttcttgcggccggtttcaacgcttttgtgctgcgatattcggtgaagccttccgtttttccagttgcgctgttggaagctgccgatgcgatgacgatgattcatgagcatgccgccgagtggcatgtcgatccggatgcgattgccgtgattggcttttccgcaggtggtcatcttgctgcgaatctcgccacctccaccagcgacgatgttcttgtcgctcatggttacgatccggatgcggtgcgtccgaatggtttgatgctcgcctatccggtgatcacgtctggcccgctcgcccatcgcggcagtttcgattcgctgcttggtgaacgccgcaacgattcacaagcacttgaatccgtgtcgatcgaacgtcatatcgacgccaaaacaccgccggttttcgcatggcataccgttcccgacgaaaccgtgccatacgaaaacacactgatgctgatcgacgcttgcaagaaagccggagtcagcatcgaagcgcacctattcccgcaaggcgggcatggactgtcgttgggcactgcggaaaccgcatggcagggcgtcaacggcattgaaccgagtatccagatctggccgcagctggctgtctcttggatgcgcagaacgttcgcacgataatcagcgcagcagacgccgtgacatctaaccccatctagtcacgtttcccgcctgcgcaacccgcaccctgcatctgcacaacccataaaatcgggttaaaaacccgggttgtgcagacgcagaacgcaagtcgcgcagacagaaaaatacccccgaaccgaccggaaagactggaaatcgcaagctcaggggtataaatgggccgattgctgtctgcacaactcttgaatcggcccgattttgcgggttgtgcagacagcaattcagcggggctgacggaagcgacgatcgccaatcggatcgaacggtgtatgcggctcgagctgataccagtacgcgacggaagcgacgtcgtcctgacgctcgaaattgccgccctcctcagtaccgatctgctgccattccacacgcaaatcatgttcgaaataaatcggatcgggaatgtgccagcgatacaatccgcgggtcaccggcgtattcacatcccaatacgcgctctcgcgatgcgaggcgagacgctgcgaatagaacgggaaaccgacgtacggcgcacagaacgtctgctcatgcatacgcccatgctcgtcgaaatcggcgaaactccacgcgccaccgaaataatcctcggcaccggtgctgcaccacgtgggatactggtcgtccccatcgatgtacatcttgacttcaccctcgccccaccagcggctttccaacgcggtgagcgccaaatacgtgccgatatacgcgccacgaccatgcacgccgtcgagcaccacatagtcgcgggccagttcggtgacgcgctcgcgacgccactgcgcatggaaacgcatggtgtctgccggaagcgcgtcatattcggtgtaatcgatctggtagaagaacgcgggaacgtcttcattatgatcgttgcgaagcacgatgcgcgcatgttcaaacggcatggagaagtagcagttgaaaccgcgattgggcacgaccaccaccggcatcgaattgactcggcaggcctgcgcgtggccgcagcagaagaagtcgccgaccgggcattgcacggacggggtctcctcgccatcccaatagaattccaggatcaggttgcgaagcacgttcggaccggtcggggaggttcggtcggtgacggtcatccaaatatggcggatcacgcccgggccatccacgtccatcagtgtgacgctctcccccgctttcacggtttgaatgcacggactgcccttgcgcgacgggccaagtgcactggctgcagtggccgcagcgcccttgccgcccgtgggattctcggcgttcacgcaacgtgtgcgccctggtgccgcaaccgccagcgagtccagcggactgcgcgcggcgaacgcacccgacgaatcgacctgcatatcgtgatataagctttgctgcatagcgctccaatcgttatgttgagtcatcggcgtcccttttcctgatactttacggcacccacgcccttgcctcgcggaagttcaatgcaaaaagcggctctcgaatgagaaagagatcattcaagagccactttcagggaatacggcacgcatgccgcttaaccaggaaattacttcagtaccgctttgccttccggagcatcgacgatgtcgccgaagccaagtcgtgcggtgaaggcgcggccgtcggagctggacacttcaatgccgccatcggtacgacgagcgttgaacaccaccgacgacccgccaatctccgaaaccaccgcttcagcggcatcgccctgatcgaggaacaccgacaccaacgcatccttgccatactcgtaatccggcttcttagcgcccggcttggtaaccagcacactgccatcgcgcacccacagcggcaacgtgtcgaagccgtgacgttcgcgacgccacagtccatgctcactggaaacctgctcgccagtgaaccagttggtccacgttcccgccggcagataatattcgacgtcaccggaataggtgaacaccggagccaccagcagatccggaccgaacatgtactggcggtccagcgtgcggcacgtcggatcatccgggaattccacgaacatcgaacgcatcaccggagtgccgttcaggtgaggctgcagaccagtctgatacacgtacggcatcagcgaaagcttcagcttggtgaacgtacgagccacatccacagcggtctggccaggcgcattcaccacaccgttcttctcatcctcctcatcgaacagccacggcacgcgatacaccgtagagccatgcatacgggaatgcgagccaagcagaccaaacgcaacccaacgcttgtacaccgccggatcaggatacgcaccctcgaagccgccgatatcatggctccagaaaccaaagccagagctggtgatcgacaagcccgcacgcaacgactgagccatgccattgaacgtggattcgcaatcgccaccccaatgcaccggctgctgctggccgccaaccgtcgccgaacgcgcatacaggcaggcattacccttgccgtacgtttcctcgatagcctcaaacacggcctggttgtacagctgcgtgtaccagttatgcatcgaaagcttcggagaaccgtcataccacaccacgtcgcgtggaatacgctcaccgaaatcagtcttgatggcatctacaccctggctcagcagcttcttaaccttgcccttgaaccattcgcgggcttccggattcgtgaagtccaccaatcccatgccagcctgccagaaatcagtctgccaaatctcaccattggccttcttgaccagatagcccttctccttgccttccttgaacatggaaccgcgctgaccaatatacgggttgatccaagcgcaaatatgcaatcccttgtcttcatgaagacgcttgagcgtggactcaatatcaccgaagaaacgcttatcccactcgaaatcagtccaatggaactcacgcatccaatagcagtcataatggaacgcgctcaacggaatatcacgttcagccatgccatcaatgaaggaattaatagtcttctcgtcatacttggtggtgaacgacgtggtcagccacaagccataactccacgcaggcacattcgccggacgcccaaccagcttagtataacgatcgagaatctgcttaggagtcggaccataaatcacacagaaatcaatggtttcacccggaacagagaactgcacggcctccgtattctcagaaccaacctcgaacgacacatgcccacgattattcaccagcacgccataaccgttggaagtcatgtagaacggaatatccttgtacccctgctccgaagcggtaccgccatcctcattccaaatatcgatggtctgaccgttcttcacgtacgcgccgaagcgctcgccgaagccgtacacgttttcgcccacgcccaagtgcagctggatgccggtgaacacgtcggattcgtcgtatgccgagccgtccatggtcacgccgaattcgccgaccggctgcgcggtgacgttggaaagcctgttcaggccgaaacgaccaagggatttgccgcttgcttcagtaagcacggtgccgtcttcgccgctgaacgtcagattccatggcgatcccttgaccacttttgcggtcagtcctccggtcgtcaacgaaacgctggcgccgttttcgcccacttcgccgtcgccattgccttccgccacggcgtgcacgtattcacgaccgcccggttcgtcggcgttgagcgggaatcccggatattccgtcgcaccctgccaatggccggcggtcacgcggatcacgccttccgcaggagtggtgatgtcgatgttgaacgtcggaagattcagcgtatcgtaacggccacgcaccacggaagtgggcgccagcacgttcaggctttcgttgtcttcgttgatgttgagctcgtatgcttctcgcgcgtacagagcgtcgacgccgtctcgaagcatccagtagccgttggtgaacttcatgttgtactcctcaatggttgaaagatgattacttgactgcacctgcggtaatgccgcgggacagggtgcgctggaagatcaagtagaagatgagcgtcggcacgatgctgatcagcgacgcagctgcggtagtggtcacgtccatcaggcgatcgccggtcagcgagctgactgcgatcgggatggtctgcgtcgaattgtcgatcaggaatgccattgggatcatgtattcgttccacgtccagatgaagaagaacaccagcatgacgctcagtgtcggtttggaaatcgggaagacgatcttacggaagatggtccaacggcttgcgccgtcgatggccgccgcttccaggatcgacttcggaaacgttccgtagacggaggaaagcaggtatgtgccgaacgcgctttggatcacggtgaagatgatgacgatcgcccacggagagttgtataggccgatgttcttgaacataatgtacagcgggtacagcatggcttcctgtgggagcatgttggcaagcatgatgagcagcacgatccaacggcggcccttgactcggccaatgcccaaggcgaatgcgttgaacatcgacaggatcacggcgagcaccgccaccaggccggacgtccagatgctgttccatagcttttccggatagttgacgcggttccagaacttcatcagaccgtcggtgctgaattcgctcggccatgacagtgggccggaggaattgtagtcggccgtggtcttgaaggcgttgagcagcagcacgatgaacgggaacagcatgaccaggccgcccacgatgagcagtgcgagaatcatccaatcgccgaccgtacggttcttcttgacgtgcacaggaatctttgcgcttgttgcagagctagttgcggaagtcatgatcgtttactcctcatcttccttcgcaaccttctcctgaaggttggtgaaaatcacggcgacgacaatgatcaccacagtcagtgccgtagcgatcgcagcgccatagccgacctgctgggactggaagaactgcacatacgagtagtacgacggcaccatggtgctggtacccggaccgcccttggtcagcatgtacaccggaccgaacaccttcagcgcggcgatggtgcaggtcagggccaccacgaagatttccggcttgatggccggcagagtgatggcgaggaagcgctgccaccagtttgcgccgtcaaggcttgccgcttcgtagagttccggatcgacgcgctgcagaccagacatgaagatgaccagcggatagcccacctgaatccagatcatgatgagcatcaggaagatcaatgccgtgtcgggtttgccaagccaatcatgttgcagagctcccaaaccgatgttttccaacagcgcgttcaatgcgccgttttccgggcggaaaatccagcccatcaccagcgaggcgaccgcgatcggcagcagctgcgggaagtagtagacggcacgcatggtggatgcgactttcggtccgaacttcttctgcaccacgtcgaacacgagcgacgaaagaatcagaccgagcagaatcggaatgacaaccatggcgatgatcatccaaatcgagttacggaaggaaacccagaatgtggtgtccttcatcagacgggcccagttggagagtccagcccatgtcggcggcttgatgccacggtagttggtgaagctcaggtagatgttccacaccgcagggatcacgataatccatagcagcattacgaaacctgggatcaggtagagccagaatcggcctgaaggattgcccgggattcgggacattcccttctcacgcgcggttgactgctgcccgcgcttattgttctttgcagatgctttcataatatgattcacttcccaatgtcggttgttgggtcgctgattgcacggtgtcgcaggcacattcgttgtgttgcgatagatgggcttcatcgcccggttgtgcgatttttgggtaggcttgcgcccgccctgcatggtttttggaaaacttgcgatcaaataggggtgccgccatcagcgaaacaacgacaccccattcgagttgtttctttaggaagagcttgctcttggatcgttaggactgcttgacgcccgcggcctcaacgcccttgtcgtagttgtccttcatctgattgagcacggtcttcacgtcggaagtgccgttgaccagctcctgcagcgaggagttgagctcatcgtagaaggtggaggtcggccaatccgggtagaagcccaacgcatccttctcgagcacactgttgaacgaggtgatgagttccttggtcttctcgtcggtgatctggtcaggatcggccgcgatcggcaggccaccggagttgcccatgaggttctgcacttcgtcgctcagggtgatgtcgatgaactttgccgcgaggtccttcttcttggagttttcaggaataacccagatgttgccagaggagcctacgaccttgtcggtttcagggaaggtggcgaaggtccagttggcgtcggtcatgtcgctttggaagcggccgaaccaccaggtgccggagaagaacatcgggtaggtgccgttcatgaatgcctggcctgcgtcttcagccttggtgccggtgcaatccttggaaatgtagcccttgtcgatccaatccttgatggtcttggtggcataagtggttgcctcgccctgccaatcgacatcgccgtcatacatttcgtatgccttgacgaaggaatcgtcggccttggacagtaccagctgccaccacaggtgctgcagcgggtattcggcaacgccttcggaaagcggggtcacgcctgcatcgacgaacttctgcatggcggattcgagttcgtcaagtgtggtcgggatttcgatgccgtacttgtcgaacatgtctgtgttgtaatacatcacgatgtcttcaccatagttcgtgatgccgtaccagtcgccggagcccatgatgccctgctcgttgtacttaccggtatcgcccagcgttccgttgacctttttgtcccacttgtacttgctgacgtaatcgttgagattggtcagcagcccctggcttgccagtaggcctgcggtggcgttgcccttgttgtattccataacgtccggagcttcgtcggagttgaggatctgagaggcgttctgacggatctgttcgaaggacttcttttcgaattcgaccttgacaccggtctcctcttcgaagatttccatcgccttggcccaagccttgccctgagcgccgttatcttcctcgtaatgccagatcttgatggaggttggattctcctcctgcgcggcgtctccgctggaaccgcagcctgccagtccgagtgtgccaaacatagtcgcgacagcaagtcctgcagcaaccagtttacgagttgacttcattgttttctccttttcttttcagcgccgttactgaaatgagtttcgaaacgattcgaaaggctcatgtagttaaaaatagctattgcaaacattgttatcaaatcatttcgattgatttcgacaatcgtttcgatatttattcaactcacttaactatgtgagcgttcacagaagaacatcccaaaaatcaaacctgcggaatattcgattttgtcatttttcgtctccgatacggctacgccttacgaggcaccatagtgccatgcgcatgatattcaccgagcaccaattcaacggcaccgacatcatgacggcgaccatcaagaatctccatcatcaaatccaccgcacgagaacagaccttctgcggattcatcggcatttcatcaaccgtctgcggaagctgctgcaatccttgagagcagcagcacagcaaagaaatatcctcaggcacacttaatccgcgctcatgcaatgcaaacagcagattattcacatgcgaagcgttattctgatcgaaaattgcagtaatgtcaggatatttcgcaaaagcggaatccaacagcagattcacatccgccatgccggaaccggtagacgtcatgaacacgacctctacacccaaatcagcgccgcgcttcactgcagcatcgcgaaaacgaacaagataattggagccatcctcatatgcgaaaccgctcgtgccaatgaccagcacatgctcatgtcccaacgcggcggccttctcgatcgcttcgcgtcccatgcgttcgaaatcaagatcaaccgaatacacagcctcggaattagccggatatccaacggaaaccaccggaacatcaagcatcttcgcgacttccgcacgggcatcattcatcaacacgtcaagcagcagaatcccatcaaccatgccgctctgagcgatacgagtcaactcacggtcaccatactcatgcatcagcagcaaaatatcgtagttgtaacgcctcgcacgcgttgccaacgcgaagaagaacgacgcatagttggaataatcggtatattcatgcaccggggaactcaacgcaagcaccctcgtcggctcgccgcgcaacgaacgcgcctgaagattaggctgatagccaagctcctgagccgctttcagcactttcttcttagtctcttcgccaatcgaacgcttaccgctcatcacatacgaaacggtgctgatggagactccggccttcgccgctacgtctttaatacctgccatgcaaacccttaaaccccataaacagcatcgcccggcaaaaccaaacatgaaatcgagccgaaacaggaaacagtctaatccctttgtcatacacaaaacaaccatgacataccgaaaatgacttgtcggcaagtcgctacaaccaacgcgcgagtacacgcgcaagcacgcgctacagcgggcgggactcgtagatcatttggcggtcgccgaagtagagggcgtcacgccaagaggccttcttgcgggccgcctcctgctgaggctccttgatcggcacgaagaaccaacggaccagaccaaccaccatgtcttgcacggaatgccagatgccgatatacgcggtcaacgcccagaacgtcacgatcgcattgaaaccggcgaacaccgcgttgccccaattgtgcgaaagcgtatcggcgtagaacaccatgcacgagtaaatgatgatcacccacggcatcgtcacatacaatgccggagaagcggtacgattattgactttcggcgtacgcgcgaacggaatcttcgtgttcgtcatgccctgctgaatcgacttgagcgtgccggaaagattcaccgtcaacagcacgatgttgaagccgtaaatacggaaaatatcggaacgtttatacccgttgcgtttcaaatcgctcgacatggtggagaaatacggcagcgacgcgagcaccacccacgggctcagcaaccgctggtcgaacggatatgccaagaggaacatcaggccgaaactcgaccatgcgatggacgccatatagttcacgcgcagcgcccactcacccagcttcacatcattgccctgctgatgccgcgcgtgcacaatacggaagaatttgccgatgatcagcagaccgccattcgcccaacgccgccgctgcaccaccaacgaaccgaaatcaggcggggtggcactatagctcaaccgctccggatagttgaccaaatgccagccgaaataacccaaatcgatactggattcggtgtcctcgatcaccgtgcgatcctgaatatacgttttcaccgtgcgcgtgccctcagtcgacaccacgcagatatcgtcgagcgcggccttgcggatcaccgcgttcgcacctacccagaacgtggcgtcatagtaggtcatgccctgatgcagcatgtgctgaatgtcggtggtggcggccgcgatgcgttcgattcgcgtcggcgcgccacgatacgaggaatacggggtttggatcacggccacgcgctcattgccgggctgttccatctggtacaccaagcgcaggcagtagtcgcgcaacagcatggaatcggcgtccaacgtcagcacgtattcggaattgcgcatcacgaaatcgggagattctccctcgcgcacgtcacgcagaatcaccccgtccgacgtttccacgcgcttgagcgagtgccccatcaatccgatgaacgaattcagattcatggctttgttgccttcacgggaggtcgacgcatacagcttgcgttcgaacgaccatccttttgcggtgaaaatgcgtaccaaacgttcgtacagttgcagaatgcgattcgcgtcgacatgctgctgcagggtgatcgattcgttcaacgcctgttccgtcaaacgcaggtcgcgtgcaagaccgcgcaatacctggtcgcagaagaaatcgtcggtatgatcttcgaccagccatgtgtcggccttatgctccaaccattgcgcggccgcacgatagtcttccgcacagcgtgcgaccacactacgccttgcgtccatctgatcggcgagcgccgcaacggtttcgtcgcgcgctttggtgaaacgttccgcaggtgccgccaattcggccaatactttcggcatgagttcgcggcttgctttgagaatcgctcgcgcttcgtcattgttaggatgcggaggatcgtcgattaggagtacgactgcaaggtcgggaaattcctgcaatgccgccgaccagatcgttttttcgacgactttcggctgttccacgtacgaaggaatcagcactgtgattcccttatcgtagttgtgtgcgaaatggtcgtcgagcatcgcccgaggcacgcgttcatgccggatgaaacggtatagcgccccttgccgtgtggtcaagtagacgagcgcgctgaaaatcagcgtggtcacaatcgtcatgtacagcacgccttcaaccacgaaacgtaacgtgagtgaaggattgttgacgaacaacgacagaatcatcgtgatcatgtagatcagccatgaaacaaccgtgcagatgatggcaacgtaaccacgcacaacgcgcgttggcgaaggcttggcatgcatgatcgcaagcggttgcgtggaggtttcagcaccccactggtgcctgcggtcatcgccgtcaaaatcccctatttttgccaccatatacccctttgccttatcagcgctgcctcacctgcataaaccatacatcactgttgaaatcgtcgtactagccacagactacactccctaactgtaagcgagatataagaaaaacagcgcacgagaggaaagcttaatcccccgtaaaatcccccgcatatgcactgaagcctagcgggacacagcctgctagacgccccaatgtccccatcagcattggtgacctgacgatttcgaaagggaatgatgaaacccctgtttccaggaagacgattttccttcctccgactgttcatagcgatactgtgcatcgcgctcgtcgcggccggcacatggtcgtggatcacgttcacgcgaacggcggctaagaaattgccggaaccctggttcggcggctatgtggacgtgaccgcgacaccctcatacgagtttgaatccaaagtgggcaacgtctaccggaatgtgtccctcggtttcgtcaccgccggcgacggctgccagcccagctggggcggctactacacgctcgacgaagcggcttccacgctcgatctcgacagccgtatcgcgcaaacctacaaaaccgatcgcacggtaaccgtcagcttcggcgggcagaacggcaccgaacttgccagcgcatgttccgacgtcgattcccttgccgacgcataccagcaggtgatcgaccgctatcacatcacctcgctcgacttcgacatcgaaaactcgaatctcgacgggtacagcgaaaccgcaacccggcgagcgcaagccgtggcaaaactcatcgccaacgaaaaagccaaaaacaaagggaaagacgataccagtcacgatctgatcatcagtttgacgcttccggccgacgcgaaaggtcttacaacgcaaggaatgcaaaccgtgaacgcgtttctggatgccggcgtgacgctatccaccgtaaatctcatgaccatggatttcaacgtggcgtccacgtcgatcacgcaatccatgctgatcaaaagttcgctgaacgcggcccacgcgcaatacaaaacgttgctgtacagtcgcggcaaactcttcagcgaccatcagatctgggagctgttgggagccaccgtgctcatcggccagaacgataccaaaaacgagtatttcacgctcgacaatgcgcgcgaaatcaacacgttcgcactggaaacaagcctgggccacttaagcatgtggtcgctgaaccgcgaccagcaatgcggcgaaaactatacgaacaccaacacgctcaaaacgttctgcagcggcatgaaacagacggacggcgaattcgccaccacattggggtcaggattccgaggcacgccgggcacgctcgtcgacttcgacaatgccagctggaattcctcgcagcaggcctaccccacgtgggagccagacgtactgtacaagcaaggcgacaaggtgatctggaacggcaatatctacgaatcgttgggcaacaacgaaaacgagcagccggacagcgccgaggaaggcacgaacgcaccgtggcgcatcatcggaccggtgctataaacgcttgccgcagcgagacgcgaccacagacacaatacaaggcaggaacacaaggcagtcgctacttttcagtaaaagtggcaggcaacaggggaacgaaatcaggcaatcatgacatcgaagcaatcaaagcatcaggcagccaccggcagccagccaaaagacggcatcagaaaaccagccagactcaccattctggccataatctgtgcgttgtgcattgcggccgcaatcgcattccatgcacaggaaggcgtgcagcaacttatggaagaccctgcgcgcatctgcatatggtcgctgtgctttctgccgtgcctgatctaccacaaaaagcgttcgtcgtatcgcgttgccgccgaacacaccgtgctgccaccgttgaccgtcatactgctggtaaccggctatttccccgacgtggccatgttcctgatcatcgttaccatcatcacgtcgatcatcaccgcacgcagtctgaaaatcggcattcttcgcgccggaaccacgcttgcgccaatcccactgatcaaaatattatttgcgaatacttctcacgtactgtcaattatcatcagccagaattccgtcaatgctgcgattaatccttatcaattccagcattggttgctgccattactgattatgactgttgcagtgccgattattcgattgatttgtgatattgtaacgttcttttttgtacaaattccgattcgtaaagccatgcgcgagtattcgctgtctcacattcttgccatggcttcggctgatttgatggcgattgtgtggattcctgaaattctggagttcgccaatattggctcggatactgccaccgtgctttccgtgttcatgctggcactgatcgcctactcgctgttgctgatgacggtcgatacgatgagccggctcacgcgatcccgaagtgcgttgaaatgcatagcgaatgtgagcgacgcgctgccgttgccgaatcaagtgccggaagagaccgtcgtaagacgcatcaatcgtggcctcacccgcatgcgctgtttcatcagcaatgcaaacaatcttgataaaagagggtattcctaccgctattccgcgcctatttccaccggctcgcgacagtattatctcgcgatggaacgcagtatttggaatcgtccgttcatgtcgaccgacgagacgatattgctcacctgcggcgaagtgcttaccgaatcgttacgcgtgaacaaggaagtgacgctgctacgcaccgaatcggaaacggacacgctgaccggcgcactcacgtatcgtgcgttcatcgggcatttgaagagtctgcagaccgagaatgtgcataatctggttgccgtggtgtatttcggcgtggagcacttgcgcaccgtcaacgaacattatggacgcaaaatcggcaatgccgtgctgcgatccgtgggcatgcgtttaagccagctgctgccgggaaacgccacgctttcgcgcgtgaacggcgcggaattcgccatgatcgtaaccgatgtgacgtcaaccagcgatgtggaggagttggccacacgcatgcgcaatcttgccgtcatgccggtatacaccgaagaaggcgaggtttccgtggacgtatcgagcagcatttcgttctcgaacgcgacagacggcttctccgtgctcctcgccgatgcgagcgcgcacatctacgagtcggagagctccaatctgcccgtagtcgacggcatgacgtccacgctcgccgcgcagaatggttcgggagactatttcaacgcttccgacgtgcttcgccatgcgatcgaagacaatacgatttccgtgctctaccagccgattttcgatgtgaatacgaaacgtatcacttcgctggatacgattgtgcgcgtgcatgacgcgaagggccgtacgctggcaccgtatttcgtaacggctgaagcgcatcgtctcaacatgagcgtgcagctgacgctcgacgtgctggaaacctgcgtgaaagacatgaccgcattccgcaaggtggcacccgaattggatattgtggacatttgcatgaatggttcggaattaggcgcgtccatcttccacgagcgcttggagcagttgactcatgagcagccacagctgcgtttcggcctgcagttgggatcgcatgccattcatgtggtgcatgatgaagttgatgatgaggttgccgctcttgccgctttgccgaacgtcgagttgggtttgaccaatgctggcaccacgtattcggaggttgccgcgttcgcgcatctgccattggatttcgcacgattcgacaagacggtggttcgcgatttccgtacgcctcgcgcaaagcagatcatgcagcgcacgctcgagatttcgcgcgataacgatgcgttccatgtggtgttcgatggcgtggagtccctggaccaggttgagttcatccgttccatcggaggcacgctcgccgagggcacgctgttgagcaacgccatgagcgccaacgagttcctcatgcgcctcgaaaccatgggcacttcattgcccgaagccgccccgaggcaagctgagtaaagaggagtctcgtttgtcgcacgattgcttcatctcgtgaaacgcttgaaggaaatatggcgagatgggagcatgtgtgctaaattaattagtaaacgtgtttagccaacgatggctttgaggaggattcacatggccactatcagagagatagcgaaacgggtaggtttctcccaagccactgtttccagggttttgaaggacgatcccactttttcggtgaaggattccacccgcgagaagattctaaacgccagtctggaaatgggatacaagaacgtaccgcaataccagcgtatcaccattccgcaggatgttgcgattctcgacaatgtcgtacccgacaagggcttgcaggacgcgtatttcgacgagctgcgcgaagtgctcgtcaagcatgccgaagagcagcgcatgaacgtgaccatgcacgaggacgtggattcgctgatcgccgatgccgataaatacgcgggatttatttcgatcggcccgtccccactaaatcacaagacgcttcaccgcttgcataagaagctcccccacggcgtattcatcgacatcaatcctgcgccggcattgttcgattcggtacagccggatttggaacaaaccatattggatgcgatcgacgcgcttatggggtcgggttgctctcggatcggcttcattggcggcttgggcaacattatgggcaagcatgaatatccggaagatattcgtacgttcgcattccgcaattgggcgttgcgcttgggattggatgcgcaaggattggtgtatgcggacggcccgttcactgtggaaaacggccgtttgcaggggcgtcagttggtgcaggatcatgcggacgatctgcccgacgcggtaatcgtcgcagccgatccgttggcggttggcgtgctgcaggcatttgccaccgaaaatgtgatggtgccgcgagatatcaaagtgatcagcatcaacaatcaggagatcgcaaaatacacgtctcccgcattgtcgtcgtacgacattagccaggacgagcttgcgaaagccgcggtgcttatgcttgccgaagcgctgaccgccgaccgcaaaatcagccagcatatgcgaatctccaccagtctcgtcgcacgcgacagcttcaccccgcaagactaaatataaaaacttgagatacggcaagggccggcatcctattgcggagccggccctgcaattgtgcttcagtaatctcgcttcagtaatctcgcttcagtaatctcgccttagcggagagggcgagcgtcacaccagacgtgggtgacggaccaagtggcgggatcgagcagaagcacgtcggcagcgtagccgggagcaagcagaccgagaggttgcttggtgaccgggttcgcgcggtcgaaaccgaatgctttggccggagtcaacgtggcggcctccaccgcgtcggcgggcgtgaatcccaattcgagcaccgcacgctgaacagccttttccaacgtcagcgtggaaccggcaatcgcaccattcgacacgagccgagcgtgaccatcgatcacatccacatccaacgcacccagcagataatgaccgtccgggcagtcggtagcagccatggcatcagtcacgaatgccgtgcgatgcggtgcgaaaccaaatcccaaacgcaccatcggattctgcacatgaaaaccatcattgatcaactcgatagtgacgcgtggatcctcaacagcagccggaattggaccaggctcgcgatgatgcaagccattcatcgcattgaacatgtgcgtcataatgcccgcgcccgcgtcgaaacccttgcgagcggtcgcataatcggcatcgcaatgtcctaccgcaggaaccactccggccgccgcgaagcgacgaatcgcatcaatgccgtgcggcaattcgggggcgatggtgatctgacgcagacagccgcctgccgcttgcaaaagccgatcaacatattcgggaaccggatccttcaaacattccggatcatgcgcacccttgcgagacagcgcaaggaacggtccttccagatgcgcgccgagaatgtcagggcgggcgctcatcatgccgtgcacggtttcgagattggcgcacatcacgtcaagcggattggtgatcaaactgagcacttggcgggtggtgccgtgcatcatgtgacctgcacgagccaaacgtatgccctgcacgccatcatcgaaggaactgccccacgaaccgtgcgcatgaatgtcaacataaccgggagtcatcatgcgacctgcagcgtcggttatggaaccggccgaaccggtcatggcattgccggaatcagccgaactgaccgaatcggaatcagtatcggcattcaaaccgacgcttgcgcaagccgcagcaaaatcagcgtcccgattcccagtcgcaataatcgcgctaccatcggaaaccagccaataatgttccgcaacacctcgcgcatcgactttgcgcgcattatgaatcgcaaacggacgggccgactgcgccaacgcaacgtccacctcattcgcaaaccgctcacgagactgttccatcttcataccttccaattcactcacagccattttcctcaattagcatccaattcttccattcagtggaagaattaccccgctgacaagcccatcagcaacccaatccttccagtcagtggagaaatcctcccgctaacagccacctcagagtcccaattcctccagtcagtggaggaatctggactgccaaatacccccgtactgcccaaaaccttccagcgagtggaggaatcctcccgctgggaggccgaaaaacgtccagaatgttccagcgagtggaagaatccggacgctagcggacaccgactgcggagcagcaatcagatgtgctgccaggcgggcttgtgggcgtaggcgtaacggtagtagtccttgtgacgcaggcggctcgcggcctcctcgtccacaatgatggtggcgtgcggatgcatttgcagcgcggacgccgggcagaacgcactcacaccgccctccaccgtttcggccacagcctcggccttgcccgaaccgaaggccagcatcaccaagtggcgggctttgagaatcgtgccgataccctgcgtgatgcaatgcgtaggcaccttgtcgatgtcgtcgtcaaagaatcgggcgttatcgatgcgcgtctgctcaaccaacgttttgacgcgcgtgccggaagcaagtgacgatcccggctcattgaagcccacatgcccatccgtgccaatgcccagaatctgcacatctatgccaccggcctcttcgattgccttatcgtaggcggggccggcagccgcaatgcgttcgccgtcgctcagcggcgccccgtcgagcacgtcaccaggcacgtgcaccaaatcagggttcagtccaagcggttccacaaccgtgcggtgaatggtggaatgatatgactgcgggtgatcaagcggcaatcccaaatattcgtccaatgcgaaaccacgcacctgcgatacgtcaatatgctcgctgtgcacaatgcgtgcgagcgactggtatgcggcgagcggactggatccggttgccagtcccagcaccgcattcggcttggttttgatgagatcggcgactgaacggccgtaaatatcgcctgcttcgcgctcgtttttcacgatgatgacttcggtcatgatgttcctttcattgacattggattgacgtttttcgttttgctgatttcttgaggatttgtttgatgatttatttgctgattcggcgaagctcgtcggctgctttccacacggtttcctgaatgcgatgcagttccgacggttggcttgtcgcgttccattccttcgcataggcctcgcaccagcattcgagctcgcgcgccagcgcacgataatcggaaggccgccaatcgccagcgtcatgcgcatcacgcacgtcatgtgcttcggcgagcgcgaatcccactcgattgagcagcagctgcccttccatggcgatgcgtacggcagcagtaatgcccggatttcccatatgtgccgcaatcggcgcgatgtcgaccatgcattgttgcaatgcacgattggcttgcggaattcgttcgattgtcgttgccatattgcgcatcatgcgattgcgtgcttcacgcacagtcattgcgtttccacagtcagataaatgatcaaccaagcgatcggccaggcagggaatggtttgcgcaacatcggtattgcagtttcccgtgccgtcatccaattcgagatattccacaagctcacgccaagtgaatacggcttgcgcggaagcgctacgaagcaatgcaacgaatcttgcgctgcaatcgccatattcgacgcgcgaaacacgctcaagcaaatcatcttcagcagtatctccggcaggattccacgcatattgcgcaccgaatatcatgccgggcacggccatgcgcggatcgttgacatgcccaaaatcgccccaatcggtgacgagcatgccttccgcaccgcagtcgaggccgtagcgtgcgatgcgtgcgatgttgttccacgcatcgtcgatgcgcgggagcagcgcattccacccccatacggccgggcatacgatttgtttggctccggcttgcgccacgagttggattttttcgtcggttgcttccggttcgtactgccagttcagcagggtgacattgttcggcagggtttcgaggatttccggcatttcgatggcgatgtctccccagaacatgggttcgcggccctgcttagacaggtgttcgcagagtttgcccacgtatgttgcgtacaacgctgcgacgcccacacgttgcgcttcctgcttcgacttgcctttgccgaggtcgaaggtttcgtcggcgcagatgttgaatcgcttcgaacggaaaagttgcagatacgagtcgaccagttgcgcagagaatgcgaaggctcgatcgtcggcgacgttgagcgtgtggtgcctcatgcgttcgatgaagctgaacggccggtctgcgtcttcggggaattcgccaagttcacgcagttcctgcgtgcgcatcgccacatattggtgtccgaatgtggagactgacggcacgagttcgatgccaaggttcgcgcagtattggtcgaattcgagtgtgtctgccggcgtgagcgggcttgatccgcgccatgtttcgctcataccgtcgaatgcgaacgtatgctcgatgtacagctgcaattggttgtatttgtagaggcagagtttgtcggcccactgtttgagccatgcgagcgttggcacgcggccgcgcgtcgcgtccaaataatatcccctgatttggcatgcgggggcatctgcaatctgcagttccggcagtacggcaccgttttgccgtatgagttgacgcagggtctgcacgccgttgcgcacaccctcgaaatcgcaaccggtaatcgtaatgccgtcagtgttgatagtcagcgtgtatgcgccggcggtaccgccatcctgcgaatcgaaatcccgcgaatccgcaatacgcaatctgatgaagcccgaccacatatcgcccgtcgcaatatcccaatcagtgcctgtcgcggaacgtatgtcggcaacaagctgatgcgcaagcaggaaatcgccatcgccaatcgcaatggattcgttcacgcgccccgcatagggcaacagcaccgtgccttcgccgaccgtcatgctgttcggttcgggaatgatcgcccatttgcgggtgttctcgcttgccatcgattcgcctttcgattgtcgattatcgatttcaattctcaattgtgattctcggattgccgggattgccggatctggatttccggaattgttgcgcttgttccagtctgtctgaagtatcacgcattcacgattgcggttgcgctcgttttgccgcgagcgccgcgccgattgcgccgattggttggtcaatggctgcgattctgatgttcgatgcgatgtcgagtgtggtcaggaatcggcatccttcggctctgcggctcagttcggcttggatgacttcgatgagtgcgtcaccggttttcgccatgcctccgccaatgatgatgcgttgcggatcgtaggcttgcgcgacgatttggatggtgtcgcccatggcgtgggccaccatggcgagcacgtcgttggcatgcccgtctccttgccgcgctttgcggatgagatcaggcatgggcgggtttgcggagggccaaagttttgccacggccccgccggatgccacggtttccaagcatccacgctgcccgcatgggcattcgaatccgttggggtcgatgggtaggtgcccgatttcgccgatggatccgctgtacccgtgttcggcttgcccgccgcgcacgagtcctgcggccagtcccgtaccaaagttgaggaatacgacggttgcgttgccgtcgacttgttccacgaattccgcggctccgaccgcagccgcgttcacatcgttttccacgtgcaccggagcgtgcatgatcgcgctgacgcgttcgccaagttccaacgtttcaatatcaagattgacgacgttgctcacttgcccggtcgcgcagttcacctgccctggaatgccaatgccgatgggcagcgcttcgttggacagtatgcgggcgacgcgcacgatgtcggttacgacattgctttcaccggagtgcgatggcatacggcagacgtcaatgacgcggtctgttgcgtcgagcagcacgccttcgattttcgttccgccgatgtcgatgccgacgcatccttgcgaacggccgttatggtgcagtcttgcgttcattgcatgtacctgcctgaaatagtggggcccggattacggttgttctgttgatccaactccatgcgtggcgtttgcatgccacgcatggagttggatggatgcccgtcaacccttgaccgcgcctgccgcaagaccggcctgccagtagcgctgcaagccgaggaagagcacgatcaccggcagtacgccgagcagtgcgcccatcatcagcgatccacgatcgttgaaggttgcgagcgataccatgccatacaggccgagcgtgaccggcttgagggtgtcggaggaaaccatcatcaacggcagcaggaagttgttccacgttcctacgaagaggaacaggaagatggtcaccatggctggggcgagcagtcggagcacgatggtgaagaagattctcgcttcaccggcgccgtcgatgcgggccgcttccagcagttcgttcggtacggaggtttgcgcgtacacgcgtccgaggaagaagccgaatggcgaaacgcagcacgggatgatgatcgccagcatggtgttggtcaggtgcagtgcgtggaagatggagtactgcggaatggtgagcagtgcgaccggcatcagcatgcatcccatgaccacgccgatggcgatggccttgccacggaagttgaattttgcggtggcatagcctgccatcaccgaaatgatggtgccgatcagtgcggaaaccccggagtagatcagggaattcagcacccaacgccagaattggccacgggtccaccccataagcttcgaatagttggttgcgatggcgtcgggaatctggtcaagtccgacggcgaaccacaatccgttgctgctggtcagctgcgatggtgttttggtggatgcgatgatggcccaatagattgggaagaggaagtagatcagcgctacgacgagcacgatcacggtaatggttttggtgatcggcgatgggcgcatggagcgcggcagatcgtgttcggccgcttcgcgttgcttttccatcatgcgttccgcttttctgcgggcgcgttcgtcttttcttgctgcgactgcgttgctcattgttcgttcgccttcctctcgaccagtgcgtagatcatggcgagaacgcctgcgatcagtgccatgacgatggcgaccgccgatgcgggtccgtcaccgcccggagtcagcgtgccttgggaagtgttcatggccatcatcattggcgtataggttttggagatgcccggatcggcggtctgcatgatctgcggttcgttgaatagctggatcgtgccgacgatggacagcaacatggacagcagcgccgcggaacgcacgttcggcagtttgatgcgcatggagatctgccatccacttgcgccatcaatgcgtgcggcttcgtacagttcgtgcggaatcgcctgcagtgcggccaagaaaatcagcatgttgtagccggtgaacgtccatgtggtgatgtttgccatggaagcgagcacaacgttcttgctgaagaaatcaacgtttattccgatggccgcaagacctttgacgatcggcgaaatctgaccgttatacaggtacacccaaatgatggatgcgaccacacctggaatggcgtacggcaggaagtagccgagacggaaacccgtgatgtgcttgaccacgaacgaatcgatgaccatcgccaaagccaacgcgatgatgatcatcagcggcacctgaatgagggtgtaaatcagcaccctgcccacaccggaccaaaaattgccggacgtaagcacgtactcgaaattctggaatcctacgaatttattcaccaattcgccgccgccgtacgcgccgccgccctcggtgacctgacggaagaagctggaatagatggcatagaaaatcgggatgatgaatacaatggcgaacagtatgccgaatggcgccatgaacgcccatcctgttcgattctcgcggcgttgcgcatcagtgcgctttggtttcgccgcttgcgttgttgcagtcatgatgtacctatctttcgcatcggatgccattcatcgttgatggcatctttcacagttcgaatcgccgtatccaaatcgtcatcacgggagaggagtgccggtttcagccgctccgtcgaatcagctagatcgattcatagggaatattcacaaggaatattttcataaggaacggtgtggagccgtgtgttgcgttggctccacaccgtcgttggaggggttatggaatcagagcgggtgatccctggttccatacgtcgatcacttcgctacggacaggccgtagttcttgagggtgtcgatggaggtctgctgacacgtccgccaccttgccggaaccgtcggctgccttgtcggcggcttcctgcatagctgcggagaccgcggagtagcccggcatgtagttgaatgcgaccatgttgtcgttggcagtagcgaattccttcatcacgtcttggccgccgtagaattcgttccaggattcaggggtcttcgcggtttcggtgctggcggccacaatcagaccttgggaggtcagatcctcaacctgagtgttgaaccagtcgaggaattccatggcttcggccttgtgctcacaacccttgagcactgcgacgccggaaccaccgtcagggccggtgctggtgccattgccgaaccagtcaccgatctgggtgacacgccagtcacccttgccggtgtctcctgcggagtccttgaatagcggagcctcccaagcggcgccgatgttgccgatcagcgtgccatcctgcagggatgcgtcgaacgacggcacccaacgcgggttggtcagcgtggccttgttgtcgatcagttcctggaaggtttcagcaaaagcctgcgaaccgctgccgttggtgttgaccacccaagcgtcattcttgacggtgtaccacgggtcggaagcatttgccaaacctgcgaagatgttgccggcctcatcggcttcgtaatccatgatgtacttgccggacgcggccgcggtctttgccgcttcgatcagctcatccttggttttgggaaccttgatgcccagctcatcgaaagccttctggttgtagaagtacacaagcgggccggtatcttgcggcaggccgtaggtcttgccatcaacctgcatcatggaatatgggccttcggcgaagtcgcttttgtacttcgcggcctcttcggtcacgtcttcgagcaagcccttggtgaacacctcaggcacttcggcgtagccgacctgtgcaagatccggagcattgccggccttgacgtcggtttccagcttcttgatcatatcttgtgcggcaccatcgaacttggtggccttgacctgaatgttcggatgatccttgttccacttggcaacaatgtctttgaccaaagtcatgccttcggaatccggaagacggtgcatgtacgtgaggttgacgacctccccggaatccccgccggtgctggccgtattggaaccgcatcctgcaagacccatgcacagagccgcgaaagaagctgcgcaaaccatcaaacgctgagtgtgggatcgcatatctctctccttcgtgagattattccggcacctccttgcaccggatagtcacagcatacctacgtaatccttttttgtcaagtttccttacatttaaatccggcacgcgattgctattccacaaaaaagctgaaattccgccatttagtgacaatcgtaaagcaatcgcaattcgaggaaaaatgccgtatactcttgtttagtaatctttattgccaataaaaattacataacgcacttgtatcgccacacactacaatatgtatcggctccacacaagaaagcgaggacatcgtgagcggtacccaagcaaaggcatcaccttccgacattcgaatcagcaatatcaccgccgcattcgagcagcttttccccgcaacgcaaatgtcgcgagccaatatcggcaaactcatcggactttcgcgcttcaccaccagcgaagtgaccggcgaaatggtcgacaatcgcattctgcgcgaactcggccccgacaatcgcgaagggcgcggtaaacgttcacaagtgctcgccatcgacaccgatttctggcgaatcgtctccgtcgacctgtcgaatccgatgctcgtcaaaggagcgctggcggatctttccggcagaatcgtggaccgcaccgagcttcccgtcgaccatggctgcagcgtcaatgacgtgatcgacctctgcaggcagctcatcagctcaacgccactgccgacccttggcatcggcatcgcggtgaccggcattgtggaacccaacggcgtggtgcgcaaatccgtgcacttggggtggagcgaactgccgctgaaagccgaagtggaaaacgccaccggagtgcccgtgatcgtagacaacgacaccaatgcggcacttgtggcggaacgattcttcggcgactgctctcccaattccatgctcatctccatcgggcggggcgtcggcgcggcattatgcctcaacgacgtcatcatcgaaggaagttccttcactgccggagaaatcgcacacgtggtggtcgacccgaacgggccaatctgcgaatgcggcaaacagggatgtctcgaatcattcgtttccggtgacaggctgcagcaacgcatctcgcaggatcctgccgcacgtacgcatattctcaccgaagcgggcgcgttgctcgggcgcgtcatggccataccggcaggattgttggatctgcgcgatatttcggtatatggtgcgccggaaatcgtcaatactcaattcatcgacgcgatggaaaacgaaatcagccgcaccgtgaccacggattatcaggaggcgccgcaaattcaccgttgcaggcaaggcgaggatctcaccctgcgcgggcaggccaccatcgtgatccgcacactggtgccgacgatccacgaacgcggctccctcatcggcgaagcatagctccggacgccttagcgcgacccaaaacctccagtcggtggaggaagctacccgctaacagacctgctaacgtccaaaaacctccagccaccggaagaatcgccccgtctgcaactctccgagcatccatatccctccagtcgctggaagaatccggaccgcaaaacacccccgtactgtccaaaaacctccagcgagcggaggaatcctcccgctgacaggccttttatcgtccagattgttccagtgagtggaggaacccggacgggatgagaggcgaggagacgaaaagacatgaaaggccgcctgcagcggatggagtgcttcaggcggccctggttgtcggaaaggagggggaagttcagttatcgggattcaggctggcccgccggagtcgcggttccagcagttccagcggtttcagccacggcaaccgcctcgacggcttccacggtctgagcgtcgtcggcttcgatctcaccgttggcgagcttcacttcgagctccttgacgatctcatcgtgcatcttctcagtgatcttcaccttgaacataaacacgatcaggctcaggatgatgagcacgagcggaatgtagaaggcgcagatcttgaagatgtggatgttggatgcggtcatgtcggctgcggtcgcattgccggtcatgccagcggccacggcgatgatgccgacgatgccgttggacatggcgccaccgatcttgtcgagcatcgggcggacggacagggtgacggcctcgttgcgcttgccgttcttgagctggccgtattcgatggagtcggtcagcgacaggatggcggtcatctgaatgagggtacccggcacgtagaaaagcaccagagccacgaacaccatgatgatgttgtcggagaagatgccgagcatcacatagccggcgatcatggagatcatgccaccgatgtacaggtaacggcgcggaatgcgcttgttcaggatcgggtacagcggagccataaccaagcctgcgaccagtgcgatcacgccggtgagggagtatgcggcctggttgtcgaggatgaacttgaacaggaagatcagcacgccggtggtggccacgttggcgatggcgtacagcaggtagctcaaggcaacgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctccctcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaccctaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccgccaggggcatccggaaaaccgcacgcacccaaaacggatgcgggtggcggtccgggaacccaaaagcatacccataccactgcccgcaggcccccaacggaacccgcgaagccaacgatctcttccacaccagcacgcccacgccaaaccggaaaccattcccggcgcatgggccacacgacggacgccggaccggcgtcctgaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaactttgcagaaagccaacatgtgactctcaaaaataagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccactcttccgatcatgtgtcccaagtagcgcgggcctcgtggaatcccgtgtgaatcggccccgaccgtggggtaagtctaagcatacctgtctgaccgatagcgtaccagtaccgtgagggaaaggtgaaaagcaccccgggaggggagtgaaagagttcctgaaaccgtgcgcctacaatccgtcggagcctccttgtggggtgacggcgtgcctatcgaaaaatgagtctgcgagtcagtggtgcgtggcgaggctaacccgtggtgggggagccgtagcgaaggcgagtctcaaaaggcgttttgagtcgcgcgccctggacccgaagcgggatgatctagccctgggcaggttgaagcgcgggtaagaccgcgtggaggaccgaacccacctgggttgaaaaccggggggatgacctggggctaggggtgaaaggccaatcaaattccgtgatagctggttctctccgaaatgcatttaggtgcagcgtcggttgattgcatcgcgggggtagagctactggatgcttgcgggcccgtatggggtaccaatagcagccaaactccgaataccgtggatgtgtattccggcagtgagtcggcgggggataagctccgtcgtcgagagggagacagcccagatcgtcgtctaaggtcccgaagcgtgtgctaagtgggaaaggatgtggagtcgcatagacagccaggaggttggctcagaagcagccatccttgaaagagtgcgtaacagctcactggtctagtggttccgcgccgacaatgtagcggggctcaagcacaccaccgaagacgcggcaacagtttttgctgttgggtaggagagcgtcccgcgtggggcgaagcggccggggaaccgtgccgtggaccgcgcgggagtgagaatgcagacatgagtagcgagagacgggtgaggatcccgtccgctggatgaccaagggttccggggccacgttcgtcgtccccgggtgagtcgggtcctaaggcgaggccgacaggcgtagtcgaatggatgaacgggtggatattcccgtaccggcggcgtaccgtaagagccgaacggatgagtactaacctccggtcgcgtggcgtcgttcccttcggggttcggggtccgcggtcgttgggagcgtagtcctggtaggctagcgcacaggggtgacacggaatgggagccggccgcggaggtggttttccgtggtcaagcacgcagcccgtcccataggcaaatccgtgggacgcatagggtgaggtgtgatgatgggcgtcctttggacgcgatatccggtggtccaggccgtcgagaaaagcctcggcgcgaggggcgtcgccgcccgtaccccaaaccgacactggtggtcaggtagagaataccaaggcgatcgagcgaatcctggtcaaggaactcggcaaatcactcccgtgccttcggtataagggagacccccgggcgtgaagaggcttgccctcggagcgttggggggtggcacagaccagggggtagcgactgtttaccaaaaacacaggtgcatgcgaaggcgcaagccgctgtatatgcactgacgcctgcccggtgccggaaggttaagaggatccgtcagccccttttggggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcgcggattgtgtagcataggcgggaggcttcgaagcatgggcgccagcccgtgtggagccgcaaggtgaaataccgctctgttctcgtttgacgtctaacctcgaacagtcatcctgttcagggacagtgcctggcgggtagtttaactggggcggttgcctcccaaagagtaacggaggcgctcaaaggtccgctcagcccggttggcaatcgggtttcgagtgtaatcgcacaagcgggcttgactgcgagaacgacggttcgggcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacggacctctggtatgccggttgtcgcgccagcggcatggccggttggctacgttcgggagggataaccgctgaaagcatctaagcgggaagcctgctccaagattaggattccttggcacttcggtgcctgtagcccgcatgttgaacacgtgttcgataggccggaggtggaagccccgcgaggggtggagccgaccggtactaacgggcgaacgcggcacactttccgacccgcttgttgggtcgggtctcgtcctgtggtggtttctttcgttggatggcaaggagcattgtttcttgtggtcacgatgacgataccggtgaagcgtttggttgttcgcgtccgttgtccggttcccggaccgccacgatcggaatcggtcgtgtggtatggttccggttctgccggccgatccttgtggttggccgttatattggttttgcggtggtcatggcccaggtgagacgcccggtccctttccgaacccggaagctaaggcctggcacggcgatggtactgcactcgagagggtgtgggagagtagccgttggcgtactcacgacgcacgatgtggcccgggcccttcggggcgaccatgaagatcgggtggtcctcggacggcttgatgtagccgtagtggatgttgaagccgtgagcgaaagcaacagctgcgcccggcttgatgttcggctcgatgtcattggcccagatggtgcgctggtactgatccggagccagaatcatgatgatatcggcctcagcagcagcttccgggacggacttgacttccagaccctgctccttggcgtgctcgacggacttggaggtcggacgcaggccaacgacgacgtccacaccggaatcgcgcaggttcagcgcatgagcgtgaccctgggaaccgtaaccgatgatggcaaccttcttaccttcgaggaccgagagatcgccgtcgttctcgtaccagatttgtgcagccattgtacttggcactcctttttatgtagtggggtgaacgcctcccggcgctcgggtttctaccattcgcagatgaattcgcgtgttcttgtgcatggattttgtcctgcaaactggggtctatcctactcccgtcccttcctaaataagcattgagtccacaaagtgggccaacgcctagccgtgcggctcccccgacaatcagtactgcgatcccgcatacgaaatatcccagtcataaaacaacacagcaacaaaaagaagccaccgcggtgagacggtggcttccaacacgtttcgcgcatattgcgctactacgttattcagcggcccttaacatgcagccgctacagcgaaatcactgaacctgggtacgagcgatcttgccgttgaaggactcggccatatcggcatcggcgtccgtctggttgttccaagagaacatggcgcgcagcttcggaccaacggtctccaggtgcgggtggctgtactcttcctgcagctccttgaacttcggagcgccagcggcctgatcatccatgaactccttggcgaaggagccgtcctgaatgcgcttgagctggtactgcatgcgcttcttggtctcctcggtgatgacggtggaggtgtaatcgccgtactgagcggtgtcggagcagctccagcgagccttgttcagaccaccctcgttggccagatccaccagcatcttcagctcgtggaacacctcgaagtaggcgatctccggctggtagccagcctcggtcagcacatcgaagcccatatcgcacaggtggttgatgccacccatgagcacgtcctgctcaccgaacagatcggtttcggtctcctcggtgaaggtggtcttgatggcgcctgcgcgcagagcgcccagagccttggcgtaagccaggcacagcggccaagtcttgccatccggatcctgctccacagccacaacgaccggaacgccacggccggcggcgtactcacgacgaacgatgtggcccgggcccttcggggcgaccatgaacaccggatgatcctcggacgttcatggtcgccccgaagggcccgggccacatcgtgcgtcgtgagtacgccaacggccgtggcgttccggtcgtcgtggccgtggagcaggatccgcgcggcgacgcttgggacatcaccctggcttacgccaaggctctgggcgctctgcgtgcaggcgccatcaagaccaccttcaccgaggagaccgaaaccgatctgttcggcgagcagaatgtgctcatgggcggcgtgaacaagcttgttgaaatgggcttcgaggtcctcaccgacgccggctaccagcctgaaatcgcctacttcgaggtctgccacgagttgaagatgctcgtcgacctcatgaacgagggcggtctgaacaaggctcgctggtcctgctccgacaccgcccagtacggcgactacaccaacacctgcatcgacgagcacgtgcgtgagcgcatgcagtaccacctgcagcgcatccaggacggctccttcgccaaggagttcatcgaggaccaggacgctggcgctccgaagttcaaggctctgcaggaagagtacggcaacgtccgcatcgagaccgtcggtccgaagctgcgcgccatgttctcctggaacaacggcaaggatgacgacgctgatatggccaccttcaccggcaagatcgcccgtggctgatgtggctcattcggctaatcgctgagtcttttacaagaccgctgcccttacgggtggcggtcttttttgtatgttctgtcgcatattgttctaggatagatatgtacggtttcttacggtttttctataggaagagatgtcatggtcactgcgactggtcccgcacctggttctgaaatgacaacgtcggctgaacctaccgaagaccgtagcacgtcaggagttctgcacgtcgccgcgattttcgcctcgcatatggtgttgcagcgtaacaagcccatcgccgtgttcggcgcgcttgatgccgattgcgccggacttgaggtttccgcggaaatccgcgatttcgatggttccgtgatcgtgcaggcgcatgcgtacgcctccaaagagatcaagaacggtttttcaccgtggcgcgtcatgctgccggcacagcccgaaggtggcccttacacgttgcgcgtcaccgcaggcaacgatttcatcgaatattatgacgtgcttatcggcgaagtatggctggccggcggtcaaagcaatatggaacttgaattgcgcaacagtgaagacgccgaggaagccctcgataactgtgccgatccgttactgcgcttctacaatgtgccgaaaaccggtgtgatcaatcgcaacgccgaacatgcggcaagctggcaggaatcatcgcctgaaaatagtggcgtaatgagtgcggtagcgtactattttgcgcgaaaactgcgtgatgaacttgattccgaccttccgatcggcattatcgactgttatatcgggggtacgtcgatcagttgctggacgagcgaagatgcactgaattccagcgaatccgggcgcggctatcttgcgcgctatgagcaggcgatcgcaggtaaaacgcaggaacagttcgatttggagtacggcgaatggcagtcgcgttctgatacgtggaatgcgtcgatcgcagccgcccgcgaagacgatcctgatgtgacgtgggatacgctgacccaacagtatggcgaatgcccgtggccgccgccgatgacgccgacctcgcagtggcgtccgtcaggcgcgttccatgccatgctggagcgcattgtgccttactccttggcgggattcctatggtatcagggcgaggaagacgagccgtattgcggatcctaccgtgagttgctgggcatgatgattggtgaatggcgtgcgctgtggagcgaaagcctgccgttcctgatcgtgcaattgccgcagtggattgacaagaaggtcgacgagggtgacggcgatccgatgctgtggccggtgttgcgcgaggcccagtgggatgccgcgcagtccatcgacaatgtgttcgccatctgcactatggattgcggcgaatacaacaacattcatccggttgataaacgtacaccgggcgagcgtctaggcaattgtgcgcttcgccaagtgtatggtatgagccgtattccggtgtatgggccgactgtgctgggtttccgctgcgacgaaggcggccgcgtacgcctgttcttccggtacgcgcacggcctgcatttcagcggtactacgcccgacagttttggtgacgagttcgccaagagcctgccttcgctggtgcgtctgccggaacgttccggtttcgagcttgccggtgccgatggtgtgttccatccggcctacgccgcgattttcgtggattgcgatattgacgatctggtcaacgcaaaggtcaacgtggtcgattacaacgccacggaattcggtattccgatcaacagccgcagtatcggcacgattacgttggccacgccggaagtgccagcgccggtgatgatgcgctacgcatggcgtagctggggtccggcaccgttgtttaatgacaataatctgcctgctcacccattcaagctggacctgaccgatcacaccgactctgatcacgctgaataatcacgttagatagttgcgttgaacggctgcgtcacatgattgtcgatagttgacgatgaatagcgtgcgattgctgtgcttatagtgtgcggcaatcgcacgctttatattgcgattgaagtcctgctgatcgcacgtcagtcaaatacgaatcaaataccagtcaaataaaaaatcgttggaaaatcaacgtttctgcgatttatgccaccaaaatcgcagaaacgaatcaaataaaatgcgctgcactgcgagcgcataggttattgccagaggtccgggccgaatgattccaggtatgcggtcagttcggcggccatctgttcgtcttccggaacgcgcggatggccatccgtgccgcaaccattgcgtgaatacaagaaatgttttacgtgaaactcgccctcagtgccgcggccgttgccgtggaagatggcgtggaacttaccgtcacagccaagagctacgtgcgcgacctgttctgcatggcagataaggtcgacgcgaaggcttcggtggccgagggcatggtctcgctgcttccgggcgaaagcgtcgtgctgcatatcgccactgccgatgccgcagcgcttgccgctccgggtgcgttcgcagccgccaacgtgctgcgttccgccaacgatccgaagcgcgaatggtgagcttccgcgagtacgccgtctactgaagcggtagaagagtggatagaggactactgaaatttcagttgacgtgttcggttgagtaaaaacataagttgaagcgccgccaaccttaagaaacgaaagtgttgtgaacgctgacttttcaagaggttggtcggcgcttttactgtacgatgtagatgaaccgtttaagttgcgatttaagttaagaagaaggacacggacatgcctattcaaaaaagcaaggtgacgatttttgacgttgccaaggcttcgggagtctctagtagcgccgtttcgtatgcgctcaacggcaagtctggtgtttccgatgtgactcgagacaaagtgttgaaggtcgcacacgaactgggatggaagccgaatggcgcggcacaggcgctggccaaggcgaagacgcagcgcgtgggtctagtgctgggttacgacccgaagctgctttccgtcgaatcctacatgatggaacttatttccggtcttggcgccgagctggaaaaatacgattattctctgctggtacgcatggccgtgggtgaggacgcgaagctttcgatcatcgatgattggattgctactggcaacgtcgacgccatgctgctcgtcaatgtcgagcttggagacccttgcgttgccttgcttgaggagcatgaggagatgccggtgcttgccattgccgatgcctccgtggtcggcaatctgccgagtctgtcaagcgccgacgccgatgccgtgcgccgagcggtgcgatacctgtatgatctcgggcatcgtcagatcgcccgcgtcggcggtcccgaatcgcttgcgcactcgtatattcgcgattccgcctttgcggacgtcgcttccgagctgggcatgcgttatcgttgcctgcacaccgactacacgccggaaaccggtcgcgaggccacgaagcgcctgctggcgttctctgagcatccgacggcgatcatctacgacaatgatgtgatggcgttggctggccttggcgtggcagcttcgcaaggcatcaaagtaccggaggaaatctccatcatgtcgtgggatgattccctcatgtgcaccgcggcgtatccgaacctgaccgccatgggccgtgacgtggtcgataccggtaagcaggccgccggattgctgctcaagctgatcggcggcgagcgtgtggggcatctgatggaagggccgtacgaattgcgtgcccgcgcttcgaccggtcccgctccggcagcggaataagatgcgatgatgagttaatgcgatgatgaattaaaaaattgcgattgcgcatttgctgcgccccgacaagggcaggatgaaagcgagcagcgagccgatcgcggcgatcgccgcaagggttacgccatacaggattgcgacggtgttgccggactgcttcgacaggtaccacaggtcgaacggcgcgagtccccagaacagcccgggaatcgcggattggaaatcaaaatctgaaatctgaaatcgtaatctgaaatcaaaaagcgcccgtgcccctcgcttgaggcatgggcgcattgttgccttacgacttcaggcgcgcttctgtgtgatctgataggcggcgaacagcacgaccagccaaatcacgccggcgaccactgcgatgcgatagcttgcggagaagcacatcagcaccacgaccagcagcatgaacgcgatcaccacatacggcgtcaccttggcgaacggcagcttgaacgcaagtttgtcaagtgcttcctggcccttcaatccctttaaatcattcggaccgtcgccggcggcgacaacgcgacggaacttaatttccgtaatcatgatcatgatccaattaatcgcagcggcaatcgtggcaatcgacatcaaataattgaacgcgaaatcaggccacacgaacaccaccaccacggcgatcgcaatgatgatggccgacgtgatcacacccccgaccggaacgccgcgcttgttcaggcggcccagatatgcgggcgcattgccctgcttcgccaacgaatacagcatgcgcgagttcgcgtacaggccggagttgtacacgctcatcacggcggtcaagcacacgaaattcagaatgccggcggccgcatgcacgcccaccgagtcgaaaatctgcacgaacgggctggaattgccgtcgatcgtgctccacggcaccacggccataatcacgccgagcgcgcagatgtagaacacgagaatacgccagataatgccgttcgtggccttcgggatggtggtgcgcggattttcggtttcgcccgcggtgatgccgatgagctcggtgccgccgaagctgaacatcaccacgaccagcgccatcagcaggccggtccacgtgccgtccgcattgcgagacatcaggccatgcggcaggaatccgccgtcaacggtaaaccagttggcgaacgacgcgcgaatgcccgaagcggtcggcacattcgcgatgatcacatacaaaccgccgaaaatcatggcaagcacggccacgatcttgatgatggcgaaccagaattcaaattcgccgaacttgttcacgcccataagattcagcgccgcgatggccaccaggaacaccgccgccgacacccacttcggaatgttcgggaaccagtaattcacgaacgagccaaccacggccaactccaccatggccacgagcacgtagttgaaccagtaattccagccggaaataaagccggctcgcttcgaccagtactgcgtggcgtaatagctgaacgcgcccgccttcggatcctcgaccgccatttcggacagggcgcgcacgatcaggaaaatcgccagaccgccgatcagataggcgagcagaatggccgggcccgccagctgaatcgactcgctggaaccatagaacaggccggtgccgatcgcgccgcccaatgcgatcaattgaatatgacgattcttcaaagacttgcgcagcgtcggcggaaccggcacatcgtcggtttcgcgcggtttcttcgcaacggttgcgtcgctcatgaatgcttcctcttcttgggtgcctcggcaatattcggcaaattcggcaaaagtttgcgatcttggcgatgttgcgttcggcagtagtggtaggtgacgcgcctatggtttttggcatggactcgtcttccccgattgtagctgtagcgcgtggattcggtttcatagtgttcaatagttcgatagttcaataaaatgaaggttttgggagcaatggttggtgctgcttgagcgctacgggctggaggtcgtcatggcattcatcaaagacatggtgcgtatgtggttgcatgcgtggaagcgattcatctccatcgcactgatctcgttgctgggcgtcgccgtgcttacgggcatttacgcgggttgccgagacgcttttcttgcgacggatcgttttttcgacacccaaggattgcacgacattcaggtgttgtcgacggccggattgaccgatgacgatattgccgagctccgtaagatttccggtgttgcgaaagtgcagggcgaacgttcgcaaaccgtgaccgtcgatttgaacggcaaaaaaaccgtgaccatgcaggagatcggcacgaacggcattgaccagccgtatctgcagagcggacgcatgccggagaagtccggtgagatcgcggtgacgcgcaaattcatcaaggattccggatataaaaagggcgaccatattacggtgacaccgcaggattcggcgtcttcttctgtgtccgattctgcagaattggacacgcaggatggcaaaagtgccgcacgggtgaccgattctggtgaatcggacaatcaggcaccgagcttccccaccgaactgactattgtgggcgtggtgcttgacccgcaggatctcaccaatccagacggctattcgggtacgaacgcgttccgttcctccgccaccagcgactacacgttctttgcgccgtccgacggtgtgaccggcagcatgtacacggccgtcaccattctcgtgaaaggcgccgccgacaaggactcgttcagtgacgtgtacgacgacaccgtcagcgaagtagctgaccgcatcgacggcacggtgcgaaccaatcgccagaaagcgcgtcatcaggaactactcgacgctggaaccaaacaaatcgacgaggcgaaagcgcaaaccgacaaacagttcgccgcagcgcaacagcagatcgacagcaatcgcagccagctcaatcagcaaatcgaccaaatcgtcaatatgcaggcgggcgcggctgcaggatccctcgacgaaacaacccgtgaaacactacgtgaaacggtaattgccgcaagcccgcaattagcggaagccaaagcgcaactcgaccaggcgcaatcgaaattggatcagcagaaaaaagacaccgaacggacactgcaatccaagcaaaacgagctggaagacagcattccgcaagtgcgttggtatgtgcaggaccggtcgcaaatcggcggattcagctcgctgaaatctgatctggaatccatccaatcgctgggcaacgcattcccgatcgtgttcttgctcgtggcggtgatgatgagtctgaccgccatggcgcgcatggtcgaagaggatcgcgggctgatcggcacatacatagggctcggctacgggcgtcttgcggtcgcctcacgatacctgttgttcgcgctgttcgcctgcctgatcggcggtggactcggcctgatcgcaggcttccttggcattccggcgttcctgctcgtcgtgttgcgaggcttgtatgtgatgccggacgtacgcttggcatacgactggctgtacggaacggccggagtcgcgctgttcgtggtcggcgtgcttgccgcaaccgtgtatgcgtgcgcgcaggaaatgcgacagaagccggccagtctcatgcgtccgaaagcgccgcgtgcaggatcgcgcattctactggagcgtatcaagccgttgtggaatcgcatgagctttctcggcaaagtcacggcacgcaacattttccgtttcaaatcgcgtctgatcatgacggtcggcggcgtggccggctgcaccgcgctgattgtgtgcggacttgcgatcaacgacaccgttgccgcattgggcgcgaaacagtatcaggacgtgtatcagtacgatttgatggtggtcgcgaacgatgatgacgctgatgcgatgcggcagaaagtcgcttcggatggtcgcgtcacgtcgagcatggacgtgcgcgttgaatcgggtgatttgaccggcgattcggggagcgaaagcattcagctggttgccgtgcccgacagtgaacgcagcgagttcggcaagatggtcacgttgcagccggtgcgctccagttgggtggatggtgcggccgatacggtaagtctgggcgatgacggcgtgatcgtatcgcagtccgcggcaagcgcgatgggcgtcaaagcgggcggtatggtaacgctgaccaacggtgacgatatgcaggccgaagcgcatgtcagcgcggtgatccgcagtgtgatcggatcggacgtgtatgtgagcgaaacctattatcgccagctgttcgatactgctgcatccggtacgtcttccgcatcttctgtgtccgattctggtgaatcggacaatcaaagtggcaaatccggtacctcgaatggcgcatcgtcaaacgaccggcaactggtgtggaacgccatgtacgcgaagctcaaaggatcgggcgaatcccaggccgcctacgcggaaaagctggaagacgatgacgcggtcatgaaagccgtgagctgcgcgcacatggcggaaagcttcaaattcgacctgatgggcgcggtggtcgcgctgatcgtggcgctcgcgggcgggctcgcgctcgtggtgttgttcacgctcgccaacaccaacgtatcagaacgtgaacgcgagatggccacgctcaaggtgctcggattcttcgacaaagaggttcaccactatgtgaaccgtgaaatgatggtgctcaccatgatgggcgtggtgctgggcttgcctctcggccgtttcgtcggcggattgctgacggctgcgttgaatatgcccgcactgtatttcgaagtggaatgcacgccgttgagttatgtgattgcggccggcgcgaccatggctttcgcgctgctcgtgcagttgttcgtgaatccggtgttggatcgtatcgacccgattagttcgctcaaatccgtcgaataggcgcatgtctgaatgtccgattctccagaatcggacaactagacgggtaaaagtgcgttacggttgtccgtttctccagaatcggacacttagagtgccggaaaggctcggattcgtgtttcagttcttcggataacggtagttgtgtggcagttgcgtggtgagctgcgggtccaggccgagttccttcaactgccggtcgatttcgcggcgcgcacgtttcacaagttcggctcgatattcatcgccatgtccggcattgctatgtgccgcatcgccatgtcccatcgttcccatcttctccagtgcgtccaatgtttccgccatacgcttgagccggtcctgatggtgcagcagcgcgcgcacctgcgcatgttcgtgcacgatcgtccgccaatcggatggtgtgtgtgcaatctcccgaaccgcggtgaccggatgtacgtcggccacctgatatgtgatcgagccaagcagcggcatcaggaacaccgtaatcgcgccggctgcgaccagtgttgacgcggtgtcgccttgcatggtgccgaccttcaccgccagtgacgtgacggcgacgatgatcggcagcgcggtcgtgcaatacagcgctacggtgacgcgatgatgcgatgacagcggattctcgcgtttgtcgagcgatagcgcaacatatacgggcaccgcgcgaatcagcatgagcattacgatgaacgcgacgagcagcgcgggtcggcctgccacggcgcgcacgttgatcgcggctcctgacaccacgaaaaacacaggaataaggaatccgtagccgacgccttccagcttcatttccagcgacttgctgccgtcggggatgatgtaacgcaggatgaagcctgcggcgaacgcgccgagcaccgcgtcaagttcgaacagtgcagaaatggtgacaaggaagatgagcaggaatgtggtcagtcgcatgagcgtttgcgatgacgtgttcgcgttttccgtaaggaaacggtacaggcgatggccggttttcagtgctttcgtgggtagcattgcgcacagtagacagatggtaaggaacgcgccgagcacgagcatggtctgccagccggttcgggtggatagcaggatggccatggcaaggattgggccgagttcgccccacgttccgtacgagatgatggcgtcgccgatgggggtgccttcgaggttgcgttccttgagaatcggcatgagtgtgccgagagcggtggtggtaagtgctattaccgtggcgatgccgttgatgccttgctttgcgaagaatggaagcagggtcacgacgagtccggcgagccccaaggtgatgatccatgtgacaaggccgactttgccttgatgtccggcgagtcgtttcgggtcgatttcatagccggcgagcaggaataggaacgccatgccgagctcgctcaagagtttcacggcgtcgttcacctcgattacgcccagtccgtacggaccgagtgcggctccggtgacgagcagcagcacagtttgtggaatgaaccttcctggaatcagctgcgccacaatcgggctgacggccgccaccgccatgatgatagtcaatgaaacgagctcttgcgtcatgtttctagcctagtgagtctgcatgacggtgttcaaggacgtgatgccccatgatgagccaaagggcactctggggcaaggttaagtttttgtaaattttatggggggggggggtaattctatgagcgttactatctgtgcaaaatggcggaactgttttgttttgaagatggaactccttcttttcattgggggaagggtgggctttattcgagggttttaacgagggtgccaatgggaaagctccgatacgattctgaaccaagctgtttaggcaatatagggggagggaagaatggttgatggaaaattcaccgcaaaggagcgcgcgtatttggccagccttcccgcagtggaaagcgtgagcgcgtcgcatatccggtatgccgacagtttccgcatcgaagtcatgtgcagatacaatgcgggcgaatcgccggccgccatcttccgcgaggcgggtctcgacccgaaactcatcggatacaaacgcattgagcggtgcattgcacgctggaaaaagcaggaggaacgagaccgccgcaacagcaagcgggtggaccgcgacgacctgcgcgtcattcggcatcatgatcttatgcgcgatgatgcgcaatcgtcggcaacggaatcgcaggatgcgctttcgaagctcgcccaagcgcaactcatcatcaaccaatgcgacgaattgatcgcgaaacaggcgttgcgcatcgacgaactggaacgtgtgctgcgaaagcttgtcgggtgacggcacggttgcgtgagatggaggaaacggcggaatggcatgacggtcgttggccgtcacccgaagaggctccgatgggtggtcgactttcgttggaaagtcgctttccgtcgttcgaagaggcgattgatgttgccgacgaaatgcgtcaacgacgtcacgctcgcggcaaaacgctggcgatgcgtgcgattgcggcgctgttgattgtcgctgcgatctgtattggcggttttccggcgatgttgcagtatcggtcggcgcgtgatctgtcgggaacgtcggtaagatccgcgcagacggttgcgggctggccgtatccgcaggcggatgacgcgttcgccgcggcccaggactataacaagcggcttgcggaatccggacagccgattttgggtgaggcgaaggatccgttcgctgatgtgcgtggaggatcgcgtgccagtgtgtccgattctggtgaatcggacaatgaagcgggtgaaagtggaccacagttgtccgattctggtgaatcggacaatcagagtggtgcgggtacaggcgcggacgccggttccgcaagcgccagttcggcggacgcggagtaccggagtctgttggattccggcggtggcgtgatgggtacgattcgcattccgaaaatttccgtgagactgccgatctaccatggcacctccgaatcggcgctcgcttcgggcgcgggccacctgtacggcagcagcctgccagtcggcggcaagagcacgcatgcggtgctcaccgggcatcgcggactggtcgaggcggccatgttcacgcggctcgatgaaatgcgtgtcggcgactacttctacatcgaagtgatgggtcgaacgctcggctatcaggtggaccgtatcacggtgatcgagccgaacgacacgtcgcagctgaaaatcgtgcctggtgaggatcgcgtgaccctgatgacctgcacgccatatggcgtcaacacgcaccgtctgctggtttcggccacacgttccgccattccagatgagattcccgccgaaaacgacgcggtgaaggatgcccgcgcgattggtgcgaccacaggtattgcgactctcgtagtgggcgtgttgttggtttggttgcgacgcaagccgtggcatattcgcaggcatgctgcttggtggccgaagcgcggctgattcggttacatttgcgtgaataatcgcgcttttcgcacgtttttccttttgtgatgtcgggtgattgcgccgtaggaaatgtgttgcagggattttgttgttgcgctgttgccaaaccccgactttcccgcacgtagggtgtgcgcgcgattgttgatttcctttagttttcagggttgaagcagtgtcggattgctccaggcgagtcagtggcgcgattcgatgagagacgtgaattaaggggatgcatatgagacatgcgcacaacgaggcaaagccgaggggaagctttgttcaacgcatggttgcggcgctcgctgcgattgccatgcttggcggcttgggttacgtcaccacgtcttccgccattgcggaagacgaccagaatccttccggtgacacttccaccttgcagcctgcgaatagtaaaagcattgccaaaatcgaaggtggagacggtgatcagtatgcgttgcatttgactgcgtccggcgatagttcgtcatccacggttacgaccgtggtgcctgccgatattgtgctggtgcttgacaagtccggcagtatgaaaaacagcaaccgtgacacgaatgcgaaaaacgctgccacggccttggcgagtaagcttctgacggccgcgaatgccgctcttccggctgagcagcaagtacagatggcggtggtgacgttcagcgacagggcgcgaacaacttcgcagttcacgacttcccctggcgctatcggcacggccgtcagtgcgtggccaaatggcggaaccaactgggaagacgccctgaaaacagcgaacgatctgtcgtcaggacgttccggtgtgcagaagcatatcgtcttcctgtctgacggcaatccgaccttcagaatcacatcctattccggatgcttcaagtggagtgggttcggtcagggatgggaaagccatcctgaatacgggacacaggcggagtgcgaggctaacaataagtggttggaccagtcctaccagtggaaaaccgacccggacggctcggacggaaacatccacggcgagggcgatgacgatagctacggctacaactatgcggccgctctgtcggaagccaacaaacgcgggaacgcagccctgtatgtggtgaaggtttcggccgacgccaataagatgagcgacctagccaaagaagcgaacgccgtcaccggcaaggaatacgacggaacgtccgcggacaatctgacgaaggcattcgaacagatctacaacaccatcaccacaaccgcgaaaatcagagcgtattccatcaccgacaccctgtctcaatgggttgatccggtcgatttcgccgatgtggcaaacggcaccgatatcacgcaatatgtgacggtaaccaacaatggcacaaccgtaagcggatatacagccgtctacaacgtcgacgacaacggcaatcgcacgattaccgtgacattcaacaataggaacggcatgatcgtcgacaaaaacgaaaccatcgacgtttccttcaaggtaaaaccaagcgacgccgcatatgcggattacgcaagcaagcagcaatacccggacacgggagaagccaataccggcaatgaatccgcaggaaagcaaggatacttctccaatgccggagcgcatctgaactactgcgtggtcacgtccgttaacgaccaggaatcggaatgcacccaacagacgctcgactatgccaaaccggtcgtgcaagtcagacttggccaaatcaccatcaacaaggtgtggtccgacggtgcgagcaagcatgcgagcgacgcggtgacggtccaattgcagcgcacgaagaccggggaagcggccgcacaggctgaaaaagtaggcgatccaatcacgttgaacgcgtcgaataattggacggccacgatcggcagattgcagcccggatacacctacagcgtggctgaaacgtcggaagacagccgctacgcggtctcctaccagtatggcaatgctgcgagcaacgcgaccggcgtggacctcaccaaagccatggtctggcagagtgacggcaacggcggcaacatgacggccacattgaccaacacgttgaagagcgcgacgctatccaatgtgatcaccgtgcagaaaatcctagaggggcgcgactggaaggcaggcgattcgttcgatttcgaactgaccgcagacggcgacgcgccgctgccggccgattgcgcgcaacaggcgcaacagtcgtgcaaggtgacggtcgcctatgatgctgattccccggatagccagcattccgcaacgttcggtgacatcacctacaacgctggaaaagccgactacacgtacaccattacggaaggcaacggcaatatcgcagccctgcactattcgggcgcgaaataccagattgtggtcgccgttaccgaaacgaacggcgcatggacggcttcggtgaaatccgtgacgaaactgctcgacgacaacggcaagaacgtttccgaatcgcagaaaatcggcgatccgatcgcattcaccaatacgtatgtggcggtgtcggcgttgccgttgacgggcggaaccacggatcgtcaatggctgctggttggcggctcgatcggcggactcgcagtactgctggttggcgcggctggcgtctggaacagcaggaagcgtctcgtctgagacggttcctcgggctggactgccctaccaaccttcgcagggcagtccagccgtgcatcacaaattttgtggatccagagcatgttgggcttcggatcccgttagcagaaacaaacacaacatcaacaacacaaggagaggggattctcatgaagatgaggaaacttttcgccggtatcgccgccgctgcgacgttgctgggcggcatggccctgggcgcaaccagcgcacaggccgacggcagcggcactgtcgtcaagagtgatgtgaatttcacattcactgctcaggacgccaagcagctgaccaatcgtaagctggacgcctacaagatcgctgactacgtgcagtacggcactggtagcaatgcaacgtacggtgtgcagactgccggcacggtgacggataactccggcatcaaggctgcgctcgaagctgctgttgcaggcactaataagacggttccgaccgatggcggcgatctgatggcttgggcgctcgccgaaggcgtgctgtctgtggacaattctgcagatggtgcatggaataatagcgcttcccgtaagtttgtggaatcgctgaagaccacgactgacaagcttggtaccgcagaagaggttgatttgggtgctgccgctaatggcacttccgctactgtgacgctccctgcaggcctgtacctgtttgtggacgcggattactcggttggcaccaatggagctgccactccgtctatcgcaatcctcgttggctccggtaacgttaaggatggcgtgctgaatccgctcactgaggcaactgtggccattaagaaccagaccactgccgtgaccaagaaggtgaatggagaggacgtcatcaccgcttccgttggccagaaagtgacatacaccattacgagcaaggtgccgcagaacacgcagtactacagcgattacggctacacctacacggataccccgtctgctggccagactgtggatttcgattcccttaaggtgacggtcggcgataagagcctgaacaagggtacggattacaccgtggcccaaaacaagaatggcaccttcaccgtcaccatcagttccatccagaagcagaccgcaggtgcactcattactgtgacctatgctgccaaggttactgaagcgggagcctctggcagcaaggccgtgactaacgcggtcgtgctctccgacaatggtgctgaagctactgacagcactaccatcaccaatagcgggttctcctttaccaagaccgacgctcaaggcaatccgctggccggtgctacgttcacgatccgcgttccgggtgtggatggttcgttcaccgccacctctgacaagaccggcacagtgaccttcaagggtcttgcagatggcacctacgaagtcaacgaaaccacggttccgaatggcttccagcagagcctcaaggccaagttcaatgtcatcattgagaatggtgaggtcaagttcaagggtacggatgtgtggggcctggctccgaaggagtcttccgataaataccaggtcaagaacgtgaagaacgtcacccagctgccgctcaccggtgctgcgggcacgaccctcttcaccgtggtggcgctactcgtggcaggtgccggcgttgccgtcgcgctcaagtcgcgccagcgcatgcgctgatacgcgctcaatcgctgaaacaataagcgcataagcagccataagcgggcattcgcggaaaccatccgtggatgcccgcttttcatgtcttttcgtgcctttccatactttttaggggtgaaggttttgcacggggcaatacgggatcgaaacgggtgaaatccggtaccaaacggcgaaatccggcatgaaaaaggtatccgcaagtggcagttaggtggcaaaacagtcgttaaaaagcaatcatgcaggggttgcaggtgggggtatctcacgacaatggcaccctacaatcgcaagcacatccatgaaaacagtggaaaggcgggtgccatggcacgaggtgggggagcattcagcgacgaggaaatccaactattgcgcggactgccagcggtcgccaacgtaacgcgcaatcgcatcacctacgccgattcgttcaagcaagtgtgcaccatccgctacttgacaggcgaatcgccaaccaaaatcttccgggaagcgggacttccgccggatctcatcggatacaagcgcatcgaacggtgtgtggatcgttggaaaacgtcggccatcaaatccgtgactggcagcggcaacatgagcgacagcgagatcatcgcgcaactcgtcaaccggtatgagcatgcgttcgtgatgaggcgcaacctcgatagcatcaccaacaggacgatggaacatattcccgtcaaagcgcaaggcgacgacggcatcgacgtgggaaccgcgagcatcatcatcaaacagcaggcgcgccgtatcgacgaactggagcgcgcgaacgccgaactgcgcgggcaaatcgccgccaccgcctgacccagaccatcgttatgccgcgtaagtgtctgattctgcagaatcggacacttacacaggcaaaaacgggtctcagttgtccgtttctggtgaatcggacaagtaatgcggcgaaagtgcgttgcggatgtccgtttctccagaatcggacaactggagtactgaaagtgtgctgtggatgtccgtttttgcagaatcagacaagcgaggcgcgatttgtgtcggacagttgggcgtatctcacttatatggcagatttgctcatgcgtcatgagccatttcgcttatatatggcagtcagcctgcggaaatacgcccaaaacgtaccccctaagtggtgttttgccgtgagcaagtgccatatataagcgagaaagtagcggtcaacctcgtgaatctgccatatataggcgagatagggcggcaggggggtatggcgaggcgaaaatacgggaataaggtggtcggatgggcacggttgaccacaaacgggatgcgccagtgccgcaaaatctgcgtacgtgcccaaaaacaaagcttcggcgggcgcaatgtgcggttcgcggggtagggtagtgaacattatgacttccgagaacaccaattccgcgggctcaagcgccgcgcacatcaaatccgtcgaaagcctcgaccaaagcaacgaaatggagcgaggcctgaaaaaccgccacgtccagttcatcgccatcggaggcaccataggcaccggcctgttcctaggctccggcaagtcgatcgcactgaccggcccgagcatcattttcgtgtacatcggcgttggcctgattatgttcctgctgatgcgtgccatcggcgaaatgatgtacagcgatcctagccagcacacgttcatcaacttcatcacgcgctatctcggccgcgggtggggcaagttcgccggctggacgtattggatcgtgctcattctgaccggcatgaccgaaatcaccgccgtaagcacatatttcgtaacgttcttcggcacattcggcatagacctgaactcgtggaagtggttgatcgaactgtgcttcctcgtagcgctcaccggcatcaatctgattgcggtgaaagtgttcggcgaggcggaattctggttctccatgatcaagatcacgctgatcgtcggtctgatcgtcaccgccatcgtgatgctgatcatcggcttcagctaccccgccacgcacatcgaaggcgtggacggcacggtgtcgggtgccacggtgagccttacgaatatcaccgacggcttccagctcgcgccgaacggttggatgaacttcttcatgagcttccaaatggtgtttttcgcctaccagctcatcgaattcgtgggtgtcacggtgtcggaaacgcagaatccgcgcgaggtgctgccgaaggcggtgaacgagctgatcatgcgtattctgatcttctacgtgggcgcgctgatcgcgatcatggctattgtgccctggcgtaactttcacgagaattccgatggctcgttcggttcgccgttcatcatggtgttcaaatatgcgggtcttgattgggccgccgccctggtgttcttcgtggtgattacggctgccgcgtcggcgttgaattcgctgatttattcggccggtcgtcacttgtatcagcttgcttcggattccgagtcgcctgcgatggcgcgtttggctgaggtttccgaccacaaggtgcctgcgaaggcgatcgtcgcttcgggttgcatgattctgttctccccgatcatcaacgcgattccgggtatttccggcgcgttcgtgctattcgcttcggccgccagcgctgtggtgattttcatttacgtgctgacgatgctcgcccaccacaggtatcgtcagagcagcgattttctaccggacggtttcgtcatgcccgcttggcaggtgtttgattggattgcgatcacgttctttgtgctcgtgtatgtcacgttgttcctgtcgacggacacgattggttctgcgattgccggtctgatttggctggttgcgtttggcggatattgcctgctacacgaacgattccagaatcgcgatcttaaggaagccttgcagcagtaacgtttgcaggtaacgcaggatacaagtaaggggcgtttgccgaacgtgagtgcatcacgtacgttcggcaaacgcccctttcagcatggtctttgcgcgaatccccattacgggatccagtgcaaatcagccgatgtagtcggcctcgttcgtcgggctggacggcacggcatgatcttccgtaaccttgcccaagccagacaaatacgcttcacgacccgcttcgatcgccttcttgaacgcgcgtgccatcagcggaatattgccggcggaagcgatggccgtgtatgccatcaccgcgtccgcgcccatttccatggcttccgcagcctggctcggacggccaataccagcgtcgatgatcaccggaacattggagttcttgatgatcacttcaatgaaatcgcgtgcacgcagacccttattcgagccgatcatcgcgcccagcggcattacgcaagccgcacccgcgtcttcaagacgcttcgccgcaatcggatcggggaacatgtacggcatgaccacgaagccttcttttgccagctgtttcgtggctttgatggtttcctcattgtcgggcagcagatacttcgcctcatgttcgatctccaccttcacaaagtccgtctggcacacttcgcgggcgagacgtgcaatacgcaccgcttcctcggcattgcgtgcgccggacgtgttcggcagcatggtgatgcctttcggaatgtaatcgagcagattgttttcggtggtacggcagcgacgcaacgccatggtgacgatctgcgtgcccgcgttctcaatggtcgccttgatgaggttcagatcgtagcggccggaaccgagaatgaagcggctcgtgaacttgtgtccgccgaggatcaacggatcggcgtcgccggtggcgatttcgtcatacgcgtgcgcatccggttccggcagcagtgcggtgttcgtggtggtgccgaccagctcgtcgagcgtggcgttcggtgccgccgcgaagtctttttccgcggtggtgatcgtgttttcggtgctcatggttaatccttactatgcgattagtgttgtgtcattcgttgcgatttgcgatttgcgattgcaattgcgtttgtgtttgcgtttcgctgtcaggcgtcttcttcgccgagaatcaagcgagtgatcatattggcttcatggcaggcgaccacacccacgcgcggtgccatcagaccagcgcccggcaccggagcggtttcgccgtcgccgcagaagtagaaattcttcgaaacgcgacgagtattcaccaaattggaactgcggaatcccgccattccagaagcgctcaccagcttcttgttcggcagattctcaagcacggcattcaccagcatcgtcttgttttccggcacgtcgaacgcttcgcaaataatatcctcattgtcgaacagcgtcggcacgttctcgtcggtcactttcacggtatcaatggtgatatcgataaaaggattgatctgacgcaagttactgcgcaatgcttccgtcttgtactgcccaagatccttcaaaaaatactgctgacgattcagattcgtcatatccacgcgatcaaaatcaatcaaatgcaggtgaccgacgccaatgcgggtcaacgccaccgcaatggtcgatccgaggccgccgcagccgcaaatggccacgtgcgccgcgtcgagcttgtcttgcgtggctgcggtatggcggtcgagcagggccgcgcggatttcttcgcggctgacgagcgtggtcgggtcgggctggttgtcgaaagcgtgctggcgggcgtcgatctgcgcctgcgatgcggatggttcaaaagtcatggttgttctcgtattctcgtattctcgtattctcgttttccgttcgtgcgttgtttttgccgggttggttgtgttttgtatgttcttgcgattgttacgcgtgcattgtgccggtcgtaatcgcaagaaattttgaaagtggttcagccgccctgcacgaacgtgacgatttccaacgtatcggtgcccttgagctgcgtctgcgcacgctgggtgcgaggcacgatctcaccattgagctcgacagccacgcggtcggcgcgcaggcccttgctttcgatcagttcggccacggtgatcggtgtggcgacgttctcttccttaccgttgatgatcattgcggttcccttctgtgtctgtcgtgacacatgcttcctgcactccaaatgtccgtttctggtgaatcggacatccggaggttcattgttggtctttaaatgtccgattctgcagaatcggacacgcacggcatctatttcagtccacggatgtccgatgcttagagcagctgactacggatcagcaggtcgcaggttcgaatcctgtctcgcgcacatgaacctccctcgcgaaatgcgggggaggctttcgttttcttacgggtctatggtctcgtcgaatttattaaaagctcctatgttgtataccatttcgtattgggcatagacgctatgcgtttacaaagaacgccaagacctttcggtatactggagggcgttttcatgcatgttttctcatgcgtcgtttaccatgtggctgaacgatatcggccgcaagacaaggagcataatgaccgcatcgaagaggggaacctgggcaactattcggcgtatcgccgcttccgatcgcatatcgggtttgattatgctcggtttcgcactcgccggtctgctgctcgcgaacctgccattcacggcacatacgttcgaagagctggagaacttccgcatcgccattccacacaccaatatcgacatgggactgggccactgggtgcaggatggtttgctgacggtgttcttcctgaccgttggactggaattgaagcaggaacttactaccggctcgctgtcgaatcccaaggcggctgcggtgccgatgctgtgcgcggtcggtggcatgatggccccgccggtgctattcctattaacgctgttcctattctctggtttcggttccaatccgctggtcatcgcttccggaacgagtttcacatttggcgagatgtcccacggttgggcggttcctacagctacggatatcgcgttctcgctggctgtgcttgccttgttcgccaaggcgttgccaggctccattcgcgcgttcctgatgacattggctacggtggacgatctgcttgccatcattttgatcgcggtgttcttctcttcggtgaacgcatggtactggttcgtcggcatcgccgtgtgcgcggtcgtatggtatttcctcgtgcgtatgcgcaaagtgccatggtttgccgtggccatcgtcggtattctggcttgggtgatgatgtttgaagctggtgtgcatcccactctggctggcgtgttggtaggtctgcttactcccgcgcatgaatgctacggcgaaaagactccacgcgccgaacgctatgcggacaaactgcaaccgttttccgcgttgctggccttgccgattttcgcgctgttcgccacaggcgtgcattttgaatcgttgactttggcgctgttcgtttcgccagtcgttgtcgccgtcatggtggcgttggtggtcggcaagcctttaggcatcatgatcacggcctggctttccacgcatgtggctggattgaagatggccaaggggctgcgtgtgcgtgacatgttccccgcagcctgcgcttgcggcattggtttcaccgtgtcgttcctgatctcctcgctcgcatataaggatgccgaattgtctgcggaggcacgctttggcgtgcttgttggctccatggtcgcagcggtgatttctggtattttgttgagccgtcaatccaagaagttcgaactgaccgctgccgcatcgtcgaaacataagcatcatactgccgacgaggacgctgctggggaagtggaatctgtgcttgaagatggcaccgttgtggtcagccagatgatcaacacacatccaaaggtcaaataacgacgttccggctatggcattccgcgccatatgccagacacgcaaaaagccgacgcttatcacatatcgtgagcgtcggcttttgttgtgtaaggaaacggcagatcggtggaaacagccatactagcgtttgaccgctacgagcagacctgtaccggtcggagtgagcgcggtgatgaaacgttcatcggattccacggtttccagtagggtacgcatggcaatggatttggcgtcgcggttggcgggattcaatacgccacctgcggaagtcgcagcgtcgaaagcgagcacgtccgtgaatacgatcacaccatgcttcttcagcaggcggggagcctgttcaaaagaggcagcataattttcggcgtcgccagcaacaacgatcaaatcgtatgtttcggcgttcaaacgcggcagaaacacgttgacaggagcattcaccgcacgaagcgtggtctgcgtctcgtcggaaagacgattgaacaacgtgcgaatcagcgcaatgccttgggaagaggaatcgaccgcggtaagctgccccttgttatccaaaccattgacaagctgcaacgtttccactacggaaccggtaccgacggcaatcactgacgacgcatccaccatatgcaccagcatgcgcaacaactccgcctgtgccgcggaaccctgcggaatgcccgcttcttcggcgtgggtacgaatggcgttcagattggttgactggcgtgagaacgcatgatcttcaacgtattcccaagacttggcgagattggtgtacgacgttctatccatgggttcagcgttccttgacttgggcgatcagttgccaaatttcctcgccgacgtcgatgccacgtggacattcgcgggtgcaggcgcgaaccgactgacatgctgcgataccgtccgcggaatcaatggcatccatacgagcattcgcctgaccatctcgcgaatcattgatgaagcgagacgcggtaatcaacgccgctggaccgatgaacgcctcgcctccagcgtacactgggcagcttccttcgcaagtgccgcaagcaatgcaattggtgagcagctcatatttggcaagctgctgaggattctgcagatattcgaaagcgttgatttttccgtctttggtggtggctaattcgttattggcctgcaaatacggcttaagcttcctgatttgatcgagcatctgatcgatatcagcaatcagatcacgctgcacggggaaacccggcaggggagcgagctcgatcacgccaagatcgcctgaagaaacggaaacggcgtcatctgcaagtgacgcatctgcgtctccggtatggcggaatccctcattgtccactaatacggtattcggctgcttggcccaatccttgatggaagcggtgcacagcagcgtcggcgtgccattgatggacactgcatcggagccacacatgccatgaccgcaggaatagcggaacgccaaagtcggatcgacggttcgcttgattttcaacaggcaatcaagcaccgtgtcttccgggcgcacatgcaacgtgtaatcctgcacccactgcttgccgcggggacggcggcgcgccgacgcgccggaatctccgaacggagagcttttcttggcgaacggggagcccccgcgttcgcggtcgcgggcacgttcagggcgcggggtgaacctattgacccgcaacgtcaccgtgttcatgccgttttctgtaccgctcatctactcgcctttccaataaaaaccgacaacaagtctgccatacaccgtgcccagagggctcagtactcacgggcttttggcggcatgttcacaatatgcaccggctgccaggagatctgtccagaagcattcaccatggaatgcgcgaggaactgctcatcatcacgttccgggaagtcgagacgtttcaatgagccgcgggactcatgacgagcgccagatgccgcaagcatggtcgaaccaagcccaagcagatgtcgcacctcccaaatggcggtgatctcctgattgaacgtggcggaatcggaatgcgcatgcaaaacctgggcgcgggcttccagatcgctacgcaatacggattgcgcctgctcgatgctgttcgcatcgcagcgcacggcgaccgctttttccataacggatcccaaatcggccataagttggtatggattatctgaagcgtgctcgtcgtcttcaggaagctgcgtcaggagatctttcaattcagaggaacgcgcatcggcggcctgctgcacatcgtctgttccatcttcggcatcttcatcggcttcggccatcggattattcaccggagcggcggcgatacgttccgcaagcgccttgccggaacgagtgccgaacaggcaggcatccagcagggagttgccgccaagacggttcgcgccgtgcacggatacacacgagcattcgcctgctgcgaacaggccgtcaacgatggcgcgttcgccgtcaatccaacggtacacttcgccgttggtggtgatcggaatgccgcccatggtgtagtgtgcggtcggtttgaccggcacataatccttggtcgggtcaagattggcgtacttttcgattgtttccaccacctggggcagcacttcatgcatatggtcggcatcaatgccggtcatatcgagccacacgcaatccttcgggccatctggatccttcggatccgccacgccacgtccggcgtcgatttcagcggtgatggagcggctgaccacgtctcgcgcggccagatcggcgtgcccgggagcatacttttccatgaaggcttcaccatcggcattacggagcacgccaccttccgcgcgggccgcttccgacagcagaatgccggtatgtgccaaaccggtcggatggaattgcacgaattcactgtcttccagctgcagtccggcatgtagtgcgagcgccatgccgtcgccggtcagatcccacgaattggatgtggtgtggaacaggcggcctgcacctccggtggccagaagcacgttgtgcgcatgaatggcgtgcacttgacccttatgggtgtcgaacgctaccacgccttcggctttggtgccatcctcggagaccaccagatcggtcacataccattcttctgcgaattcgacgccttccgccacacactgctgccacagcgagaagaggatctgatggccgatgcggtctgcggcgtatgcggctcggcgaatcggttccttgccgaaatccttggtatgcccgccgaaacgacgctgtgcgatgtgtccgtcttcggtgcgggagaacgccacgccagcatgttccagttcgatgaccgttgccggagcctcttgcgcgaacagttcggccgcatcctgatcgaccagccaatcgccgcccttgacagtgtcgtagtagtgccaatgccaatcgtcgtgttcgacattgccgaggctggccgcgatgccgccttctgcggaaccggtgtgcgaacgtaacggctggagcttggaaatcaccagaatattcggttcgatgccggcttccttcagctcttggatctgttcgcttcgcaacattcctaacgctgcggaaagacctgccgctcctgcgccgacgattactgcatcatacatatcttcaacatgcttcggactcataccaacgattttcgcacaaggtgtgacctcgctgtggttcgttggatgacgggcatgttgtcgtatgcgtgttttcacatgttcttgcgtgtttgttcgtcggaggctgtgacgattggcggtgtcagttgcgctgttgagtggtgtttgcgttgacgatggtgatgttgccgtgttgcgtgctgatgagcccgttgagttccagtacaccgagttccaatacgattcgtgagatcggatattcttcgggattggtctctgccagtatggcgagcagcccgtcagtggagacatggccatatttcgcgtcgcattttcgtatggctttcaatatgattctggtggtgtcgtctgattccggcaggacgtcgtcggctggtttttccgtctgttcgccgtctatgacgactggttgcgggcggtgtgaagcatggcagaattcatcgatgtcggtcagtgagcagatgatgtttgctcgtccttcttgaatgagccggttgcagcccgtgttgtgtggcatggtcacgtctcctggcactgcgaatacgcggcggttgagttcgccggcccatcccgcggtgttgagcgcgcctgaacgtgcgcgcgcttgggcgacgatgaggctggacgacaaggccgctatcagacggtttctaatgaggaatcgtctggcttccggagcggttcctgggcacagttccgaaatcagtgcgccggaatggctgatgatggtttcaaaaagacgttcgttgcttttcggcccgatatggttgaggcctccggcgaataccgcgacggtgcggcctgcgaggggagccccgatttcgtccatggcttggatgacaccccagtgggctgccgcatcggtgcccaatgcgcccccggatactatgaggtgtccggcacgggctgcctgtttggcgagctcgtgtgcactttgccctccgtattcgctcactccgcgtgacccgacgacgccgatcggttccggacatgataccaatgcttgcgggttgccttgcccccagagacataatggggcggcccagtccgtatacatggtgaggtcggcgagctgcgaaggccagcagggatggtgtggtgcgacgatccactgtgtgccccctactgtgaaccagtccttgagctcatcgggatcggtgctgggcagcgtggtcaaacgatgctgccaggagaccatcgcaccatggaatgaggccatacctctggagttgatgctgcgtccccaacgcgtgatgccgttgatgaacgccgcatccagggttttgcaagcggctgtggccacgttttcatgattgcctggaccgctgtcggcgagtagttgcaaggtgtgcgtggctgatccgatgcctttgatcagcgcgtacatcattgcgtcggcgctgtccagacagtaggtgagcaccgcacgtgccagggtctcgtcgtcgatggcggttgtgttgccgttcgtattcgtattttcgttcatgtcaacttcgttctcatggagattccctgcatcatctcttccggtcccggagaggttttgcctgataggtcggccagggtccatgcgagccgcatggcacggtccgcccctctgaggctgagccgctcactggccaacgcatggttcaccagttcgatggcttttgtggacgtgttggcgcgaagccatgttccggtggcctgcgcattacagacccacccgaattcacgaaaacgctcctgcgcggtttgcctggccacgatgacccgcaggcgaatggcatggctggattcgccggaaggtgtcattcccggattgattcgttccacgggaggcacttcgatttgaatgtcgatgcggtcgaggatcggcccggacagtcggctgaagtatttgatacggtctttttccttgcatgtgcagcgctctccattgccgtaggcgtaaccgcaggggcagggattggccgccatgatcagttggaatctcgctggataataggttgtgccttttgcgcgcgatattgccacgtacccggattccaagggttcgcgcaatgtttgcagggtgcgtgccgagaattcaggtgcctcgtccatgaacagaatgcctcggtgtgctcgtgtgatcgcgcctggctgcgccaaccctgcgccaccgccgaccagggacgcggtggatgcggtatggtgcggcgcttcgaatggtggaatgtcgctgatgccatagctgggcaatgtgccgcatagggagcggatcgatgcgacttccagctgttccgattcgcttaacgggctcataatgccgggaatgcgcgaggcaagcatggttttgccggtgccgggagggccggtcatcatcagatgatgcccgcctgcggacgccacctccaatgcccatttggccgtttcctgccccatgacctcattcatgtctcctggaggaggacatatcgacatggtgccgtcgttggggttcacgtccctgatcagatcgggaatctcgtattttgtggcgcctcctatcagttcgatcaattcgcccacgtggcgcacgccgatggcgttgacgtcgggcacgagggtggcttcatccagattggcatgcggcacgatcaccttgcagacgccttgatcgcgtgcgtgcaacagaatcggcagtaggccgttgatgggaagcaccgtgccgtcgagattcacttccccgagcacgacggtgtcgttcaggcaatcgtggggtatcgttccagatgcgctgagtacgctcgctgcgatcgccagatcatgagaggaaccgcgtttgggcatggatgccggcgaaagattgaccgtaactcgtgtctccggccattttgcgccgctggcttggcatgcggatttgacacgttccctcgcttcggaaagcgaggtgtcgggaagtccgatgatggagaagtaaggaagtccgggggagacgaacgcctggatttggatgatgaaggctttcagtccgatcagtcccacggaaagtgcgctgccgatagccatcagaacgctccttcgatatggtgcataagcggcttgccgccacgtacgatgacggtgatgacgtcgaagcgtacgccgttatgtggtgtgcgatggtcgctgtccgacagccattgcacggccgcgtggcgcaggttgatctgtttggatgacgttacggcttcctgcggagtgccgtagcggagcgtccgcctggttttgacttcgacgaagacgatgattcccgcatcgtcgcgtgagacgatgtcgagttcgccataccggcagtgccaattgcggtcgagcgtctgccagccttggctttccagccatgcggccgcatattgctcgccgagttctccgagttgccgtgcgcacagagtaccatcatgcaatcgctgtgcgatggaatcaagaagctgttccgaatgctgcattgcggtcggaacgtcatgtgttgtattgccgttcatggttcaagtccagcagaaagaaccggcgtgaagcaagcgtgaacggcaaatgtggataaaggatgcggtttcgggcgtgtttgggatagtcggtggataacttgccgttattcacattgctccacggggccaatggctatggaacgtccgaaaccgtatgcgatcggaatgctcagtgacggaccagctgcgtcagctcgtcaagattcagttcaaagctcacgccacgttcatcatgatgcggctgatactgcgtgttttccatggcatgacgcacaaactcgcctgcgatatgcgccgattcggctaacggcctgcccgccatcagcgcaccacagagtgcggaagcgaacgcgtcgccggtaccatgcgtcatgaacggcagcttgctgtgcgcaagctcctgcttgccggaagcccccgaagcagctgaggcaacataattgcgaatcgtaccatcgtcatgatcgatgcctttcaaaaccacgtttttcgcacccaaatcaagcaatgcgtcaatcatgtcatttacttcggcatcgctcagatcacgccctggatatgtgcgtttcgtcaatatggatgcttccgtcaaattcggcatcagtacgtcggcgccatccaccagcgtgctcatagcttcgcagagttccggcgtgtatgtggcgtagatttcgcctccatctcccattaccggatccactaaacgcaaggcatgcggatattgcgaatacaggcgtttgatgatcgcaacctgttcggcggagccaaggaaaccggaatacacgccgtccaaatcgacgttttccttgcgccatgcgtccagataaccgtccaaaatctcggtcgtatcgtggaaggtgaatacgctgtagcgcgtgtgtgccgaaaatagcgcggtcggcaccggacatacgtcgcatccggccgccgacaggatcggaatggccgccgtcagcgagcaattgccgtatccgcacatgtcatgcaccgccgcaacgcgcggaacataatgcggatcgcgatcatacagaatcacgtcatccatgttgaaaccctctcttgcgattgtctgaccacgactttagccgcccgtctgacttcggagccacgatgctttgtacggtgtatcaccgcagtgccgtttgccggcgtgtcgcagattttcagacggttgtcagaacggttttatagagcatgaatggcaatgattccaacggtttataaagggatataggcaagtgcgataacgtttggcttgcattgcggagcgcggccggattattgtcgctaccaacacctgaccagccgccatacacggcaaggcgggtggccagcaagacaggcaacgaaccattccacacaaggagcagaaaccatggcagattccaagaactaccgcttcgaaaccctgcagcttcacgtcggccaggagcaggccgatccggcaaccgattcccgcgcggtgccgatctaccagaccaccagctacgtgttccataattttgaccacgccgaggcccgtttcggactggcggatctaggcaacatctacggccgcctgaccaactccacccaaagcgtgttcgaagaccgcattgcagccctcgaaggcggcaccgcaggtctggccgtcgcatccggcgcagccgcggtcgaatacgcggtgcgcaacatcacccagtccggcgatcacatcgtcgccgccaagaacatctacggtggcaccttcaacctgctgcgtcacaccctgccgcgtgacggcatcaccaccaccttcgtctccgccgagaatccgcaggagttcgaggacgccatccaggagaacaccaagctcgtctacttcgagaccttcggcaatccgaacgccgacctgccggacttcgaagccatcaccgccatcgcccacaagcatcatctgccggtgatcgtcgacaacaccttcgccaccccgtacctgttccgtccgctggagcacggcgctgatgtcgtggtcgaatccgcaaccaagttcatcggcggccacggcaccaccctcggcggtgtgatcgtggaaggcggcaacttcaactgggccgaagtgccgggtaagttcccgaccctgaccgagccggatccgtcctatcacggattgaatttctacgaggccctgggcggatccgcgttcgtgacccgcatccgcgccatcctgttgcgcgacaccggcgccaccctgtctccgttcgccgcattcctgctgctgcagggcaccgaaaccctgtcgttgcgcgtcgaacgccacgttgagaacgcgctgaaggtcatcgattacctgaagaccgttccggaagtcgagtccatctcccacccgtccatcgaaggccgcaaggacaacgagctgtacaagaagtacttcccgaatggtggtggctccatcttcaccttcgacatcaagggcggcaaggacgcggcacgcgtgttcatcgacaacctgcacctgttcagcctgttggccaacgtggccgacgccaagagcctcgtgattcacccggcctctaccacgcactcccaggagacagtggaggagctcgaggatcagggcatccaccaaggcactatccgcctgtccatcggcaccgagaacatcgaagacatcctcgacgatctcaagggtggtttcacggctctgcgtgaatctggcctcgccaagtgaaacgaatcggatcggcgaaataacgccatcctaaacaaatgaaacggtctgcgacgccgaaaagaagggcggcgtcgcagaccgtttcgtcgtatctgcaagcgatgtcatctcaatgtattacagctggtatagaatttgcgattgttccgaaaagcaatatctcaattcttttctttgaaagaaaaaacattggattctttcaaaaatacaagcattactgatgatattgagaataatgtaaagagagaagagatcatggcccaagaagtcaagaacgatatcaaaaaggcgttgcaggtcaataccattccgctgatcgccattatgaccgcggtcaccacggtgctgaccatgctcgtgaagatcccgaccccgatccgtggctacctcaacctgtccgacaccatgatctatttcagcgcgtatgcgttcggaccgtgggtgggcggcattatcggcggtcttggcccggcgttgagcgatttgatctccggttatccgcagtgggccatcttcacgttcgtcatcgatggcctgcaggccgtgctcgtgggcttgctcgtcaagaaattcaatccggcgaacatcatcatcggctcggtgatcgcaggcgtatggaaggtgttcggctatttcatcgcaggcggaatcctttctggattcggtccggcgttgggcgagatcgcgggcaactccttccagatggtggtgggtctgattgtgggcttcgcgctgttcaccgccgtccgtcaggcctatccgccgctggtacgtttgggcaacctcggtattaaggcgggggagtgatacattaatatcatgtgaaggcaggcccgtggatttgccgatgaaaggcgattccacgggttttattgtgaaatgcggttgtcggctgcggaaaaaatgcgtgaaagcacggggtggacgtcatgattacggttcgcgacttaggatggaagtacgcgccactgaccgacggaggcaagccggtggaaagcctcaagcacgtcagtttcgacatccggtccggatccttcgtcggtatcatcggaccgaccggagcgggcaaatccacgctatgcatggcattggccggtatcattccgaacctggccgacggcaccatgagcggtgtcgtggaggtcaacggcatgaatacgagcaggcactccgtctcagcactgtcggagcgcgtcggctatgtgcaacaggatccggaggcgcagctgttctgctcgagtgtcgaggatgagatcgctttcccgctggaaaaccgcggagtagccccgaacatcatcgacaagcagatcgacatcatgctcgacttggtcggcatggccggataccgcaaacgtgtaccgaccagcctgtcgggaggccagatgcagcgcgtggccatcgccgccgcgcttgcagcggaacccgatgtgcttgttcttgacgaacccaccgcggctctcgaccccgaaggcaagcaggaagtgttcgacgcgctcgaacgtattcgccaaacccgttccatgacggtgatcatggccgggcaggacaccgaacacatcgcctactgggccgatcaggtgctgttcatggtcaacggtgaagtggtgcgtaatggagacgccagcctatttacccgggaacgtagactgttggaatcctccggcgtgcaggtgagtgacggaccatcccccgtcatcaaggcgttgccggtaaggaacgacggcaagccgaagcatacgatcatcagtctggaccatgtgacgcaccgctatggacagggcggcaatgcgtctcccgcgttggatgatatcagtctggatatcgaacagggcgccttcgtggggcttatcgggcgcaacgggtcaggcaagaccacgctcgccaagcatctgaacgggctgatccaacccacacagggaatcgtgaatgtagatgggctcgacgtgtcgaagcatagcgtgggcgaaatggccgcgcacgtcggattcgtattccaaaatcctgaccatcagatcttctgctccagcaccaaagaggagatcgcgttcggtccgaccgcgctcggacttgatgcggccaccgtgttcaaacgtgtcgacgaaatgatgacattgttcgacctgcatcggtatgaggacgtttcaccggccacgctcggctatggcgaacgacgtgcggtggcattgtcttcggtgatcgccatgcgcacgccgatactcgtgctcgacgaacctacggcaggtctcgaccatcgtctcgcatcacgattccttggaaccgtggaaagactcaaccggcatggcgtcaccgtcatcatgatcagccatgacatgcgtgccgtatatcgatattgcacgcacgtgctcgaattggaagacggtcatgttgcgcaatatgggccgatcgacaaatcgcaggaagcacaacaatcgcccgcgcgacaggcgcggcagccgcacaaggcgcgcggtccggtatcagcgacccacgtattgttgaaaatcgccaaggatgaatgtgacaaggaggaatgctgatggatgccgacctgtatgtaccaggcgacggatggttgcatcgcaccgatccgcgcgtcaaattcctcatctccatcgtcatgctggccctttgcctcgtatggcgtaactgggcgttcatcctcggcatcctcattctcgaacatgtgatgctcgccaccgaccgtgtgcccgctgaacgcattggatgggtgtggaagatcctcgccgtgctcatcgtgttcattgtggtgctttggccggtcttcgaccagagcggaacgcacgtgctctggcagtggggatggctgcgtctcacgcaggagaacctgctcatggcggcagtgatgggtctgcgcattccagcgctcggctttgcatgcttcatcacgctgttcaccaccagccagaccaaactggttcgtggccttacctcgctcggtgcgccctacaaggccgggctcaccctggcaaccgcgttacggtatattcccgtgttcttctccatcttccaatccgtgtccgaagcgcagcgtgcgcgagggcttgatctgagcggcaaagtcaatgcggcaggtaaaaaacgcaacatattcgtacgtctcgtagaccggttcaaatcgtatctgccgatcatcatcgccgtattgatccgcgcctacaaaatgagccaaagcgtgggctgggccatggaatcgcgtggactcaacctgaatcggaacggcgtgaaacgcacatatcgggtcaaccttacgatgagaattgccgactggattattctcgtgattaccattgccgccaccgcaggcagcgtgtggttgatgacatggctgtcatagggggtgtgatgacgcaggatgaggagcgtactacaatcaccgcacgtgatttgaaggtggtatcggcgctgcaatgcaacggacgtatgaccatgcaggcgcttgccgataaaatcggcatttccgtatatgcggcgacggaaagctacaaacggctcaccgaagcgggcatcatgaccattgtgcccgtatgcaatccgttgagtctcggaaattacagtcaggtgcttgtgggactgcgcatcaacggcaatcgcaacgaggcgctcgccatgctcaaagccatgcctcaggtcacctatgtggtctgcgcgttgggcgatgccgacatcatcgccgaagccgtggtgtattcatccgaaggtatggaccatttcctgaagtacgatttgcgcgcactgcccggattgacccgtctgcaagtgttctcctgcggtcgattggtgcttgacgaccataatgtcagcgtggtcaaccgtctgctggccgaacgcggcgaaactggattcatgaccaaacgtgaggccagcgtcggcaccgatattcccgtgcatcggttggactcgcgattcgtgcacacgttcaacgaattacagaaagacggcagggcaagctacgccacgctaggggagcatcttggcgtgacgcacaccgcgattcgtgggcgcgtcaaaaaactggaggattccggtgtgatgcgcattatggccacggtcagccccatgcgtttaggcggattccgccaagcatttctcggcatcggtgtgaagccgccgtatcggcttgatgccgaacaactgctggaaatcgatgaagtgacgtacgcgatgagcggcgtcggattgaacggagccgactacctcatcgaaatcatcgccggagatgacggggatctgtggcgtgtggtagacgaatccattcgctcgttgccaggcgtggaacagacctggtgggcatccaccgtcagcgtggaaaaagagtcgtattggcttgagcctccccgcgacggcgtgcttctcgacgattgatggatcaatggtattatgcgccccgtctttgctcattctcaaggatgagatgataattcagaccaacgcatgatattcgaatcagctgtttttccgtaattttggaggtaatccaaagaaaggaatgacagcatggatatcagggacaccatcaaagctaccaatacggccattgcagccgtggatcttgtgaaggactacggttccgggaataacacggtgcatgcgttgcgtggcgtcaacgtcgcttttgaaaaaggaaaattcacggcgattatgggaccttctggttccggcaaatccacgttgatgcacacgttggcaggactggattccgcaaccggcgggcacatcatattcaatggcgacgatctgacgcgcatgaacgacaaccagcttacgttgctgcgccgccgcgacatcggattcatcttccaaagcttcaacctgctgccgatgttcaccgccgaacagaacattctcatgccattgaccttggctggagcgaaacccgaccgacagtggttgcgtctgctggtggaaacacttggccttaaggaacgtctcaatcatcgtccgaacgaactatcgggaggtcaacagcagcgtgtggccatcgcacgagcattgatcaccaagccgaaactagtattcgcagacgagcccaccggcaatcttgactccgtatcaagcgctgaagtgctgagcttcctgaaacgttccgtcaacgaacttggccaaaccatcatcatggtcacgcatgatgcggtcgccgcgtcttacgccgaccgtgcgctcgtgtttgccgacggccagattgtggcggacgtgaacaagccgacagcagaccagatgagtgaactgttgatgaaggaacgcgaagccgccacaatgaatgcggtttccgcgagacattcccactaaacgcactgtagaagcattcgaagaagggaacagaattcaccatgtggtccatcactttgaaactcatgcgaaaaaccaagcgcatgctcatacctgcaggcatcgccatcatgatcggcacggcgttcatcgccagcaccttcctgttcggcaatgccatgaacgactccctgacacggcggctgaccgctatgttcggaaacgccaactatgcggtgaccgtcaacagctccgacctgagcgatgaggaactcaacgaagcgtactccagcactgtcggcgacttccatctcgaccagatcgccggcatcgaaggggtcgacggcgtccgcgcttcggtggaaaccggcgccagcgtttccaagggagacagcaccatcagcggtgagatcatctccaccgcggcacagaagaacatgcttcccgtgaatattacggaaggggaccagccgaaggactccaacgaagtcgcactgccggaagacatggcgaaacagctgaacgtcggcattggcgacactgtaagcctgacctcccaatatgcggtaggcaccgatggcaaagccaaagcggacaacgtgcgcgtggtcggactcacctccgatccgaacggcgcttactcgtactatggtggcgcgattgtaggatccaacaatctgcttgccgcaatgcagggaacggacgatttcaacaccaccggaacaacaacggtatacctcgaccttgctttggatggaaacagcgcatccgcaaaaaccatcaacagtgtgaaagcgttgctgccaaagcatttcgatttgatgccgcgacagcaggtcagtgacgaaagcatcaaatccttaagcggcaaccaaaccaacatcgtcaccacattcctcatgtgcttcggcgtgcttgccatgttcgtggcggcactggtgatcgccaacacgttccaagtgcttgtggcgcaacgccgccgcacactcgccttgctgcgcaccatcggcgcgaagaaaggccagctgtatggttccgtgctgttcgaagcggcagtgcttggcttcgttgcatccgtgcttggcgtggtgctgggcagtctgctcatgtggggcatgtgcgtcagtgacatcatgcaagagggtatgcgattcaatttctcttggcaggccgccgtcgtacctattctcttcggtattgtggtgacggtgctcgcatccttgggatccgcacgttccgctactgcggtgacgccattggaggcattgcgcccgattgaactgaccgacaaccgtcattccagcctcactcgagccataatcggtattctgatggtggtggtcggtatcgccatggcagtattttccatctggcaggtacaagccaccaatggcggcgaggaagcgaacagcgatcaattcacgatgattctgctcatagccatcgccggcgccgcactggtgttcctcggcatggtggtcaccgcggtgttctggatgccgaccctcatgaagggcgttggagcgttggcctcactgacaggcccttccgcaacggttgcgcacgccaacattcagaagaatccgcgacgcatcgcagcaaccggtgccgctctgctcatcggcgtcaccctggtttccaccatcgcaaccggtgccgctagcgccaaagagactatgaatggtgcgctcgccacccgttatagcgtcgacatcgtggccatgggcgatgacatcagccagcaaatggccaaggatgtagccgacatcaacggcgtgtccgacacgttgtatgcgccggcggtttccgtgaccttggagaaagcggatggaacccggcctacgtccgcattgctggtcggtgtgaagaacatcgatcaggtcaagcaggtcatgcgtgccaacttgggtaacgcctccatcgacagtgttagcgttctcatgccaacatacaatgcgcaaaccggcaaggagctgcagttcgccaatggcacggctgatttctccaccgaatggaatcaggacggcgacgctacgcgttcgctgacattgcaagcaaaccaagctgactaccgtcgcgtatccgcacagtatgaagctgttggattcgtggatgaaagtcatttcaccaatggtgaccttgatgccgccacccatgtgttgctggtcaaagcagatactgacaagtcgggagtttccgtcgacggcatctacaacgacatgcagtccgcattggaaaagagcactgatgcgacagtgaccggaccgatcgccgaacgcatcgtatgggcgaacatgatcgactccatgatgatgcttctggtgggattgatcgccgtggccgtgctcatcgcacttgtcggcgtagccaacacgctgtcgttgtcagtgatcgaacgcacccgagaatccgccacactgcgtgccatcggcatgactcgaggccagttgcgacgctccctcgcggtggaagccctgctcatctcgctggtatccggcatcgcgggcgtactacttggcaccctgttcggctggctgggcgcatacgtggtgttcagtatgtacggcaaagtggtgttcccgttcgaatggggcattaacggcatcgtactcgccgtggcagccgtggcagcattgctcgccagcgtattccccgcacgcagggcagtgagcacgcctcctgttgaagcgctcgccgaagcctaagcttcatagcaaacacagcgaaaaggactcctgccacaaacatggtaggagtcctttttgcgtatcatgcatacgcaaaacaacaaatcaatcagactaaatggttttcgtaagcgaacaccaccgcctgcacacggtcacgcgcattgatcttcgccagaatatgagccacatgcgttttcaccgttggcaggctgatgaaaagcttgtcggcaatctcctgattcgacaatccatgcgcgatctcaataagcacttcgcgctcgcgatcggtcagttcatctaattccggatcggtgtacgtcgaatcagaagtggaagaagcagtggaatttccatgtgcgccaacattcgcagccatgaaatcgccttccatcattttctcgataagacgtttcgtggcggacggtgcgataatcgcattaccttgaaaaaccgtgcgaatcgaattcaacaacgtttccggttccgtatctttcagcagaaaaccggaagctccggcagtgatcgcagccataacatattcatccaaatcgaatgtcgtcaaaataatcactttggtacgggcgacttctgattgcgttccatcggcagcgaagcgatgctgcaacgcactgatctgccgagtcgcctcgataccatccatgccgggcatacgcacatccatcaacaccacgtcaggatgcagcgtttccgccaacgccaaggcttccgcgccatcgcgagcctgtgccgcgaccgccatatcaggttgggagccgatcaccatggcgaaaccggcacgtaccaattcctgatcatcggcaatgaccacgcgaatcttctgttcttcactcatactctccaccttatcggcattgttccgctcacagcgcgaaacaaacccttaaatctccctgaaaaacttgaaccggctatcgagacgcgcgctgcagctgctcttccagcggtgcagcgggcctcaactgcagttcgctcgcgctaccggcatgagcgtcatcgctgaaaccagtctcacgaagcacaccaagcagttcgcgcatacgcttaagtgcggcgcgcccctgttctccaatggctttgaacgctgcggaaatctcgtcggcggcaggctctttgccttgtgcttcggcgctatccagcatacggataccatcgacggcttgactaatcacgctgttcaacgtggcggtgacttcagcctgaatgctggcactgatacggtcacgttccatattcgccgcgagaatacgctgcttctcctgctcggccaccagcgcttcctctcgcgcctgcaacaccagtgcgtttgaatcactggaacgagcccaacgtgcccacgccataatgccggcgcacagcatcagcactgcaaccgtatacataacgccggtaaagaacgccgccgtattacttgaagtgactgaaaccggtttcgtcaagcctgcaaaagcggcgatggcgccgaacaaggtagtgtatccgtgttgatcagccgcgattttcaagcccatcagcaccgaacaggtagcggcggcaagaccggtccaacgccatgcgtgttcacgcccatacaatacggctgaatacagcgcacacagcgacgctacgatatgtccgacctcaatcgatcccaaaaacaccaattgcacaaccgacaatacgaacacaataagcgcgcaagtctcggggaacctgcgtcgaagagccagcgccagcaagcagcatgcggcgatcgcatgagagagctgcacttgaggtgaactatcaaaaaagagcgtaaccgacatgcgattcagcagcatgaccaatgccacggcaccaacggaatccatgagcgcataatggtgctgcgtccacgcggaaacacgttccacccaattcagccctcgcgaattggatgtatttgcaagttctacggatttcagtttcaacgatttgagcaaatcatgcagattgggtgcggtgatgcgcaaatgttgcagggcattcgaacgatgatcgcgaccggtcggttggttggtttcctgcgtctgctccgatggttgatctgggattcgcgccgatatgttgacgattgtgtgaggtgcgattgtttcgtcggataatttcgctttgctggatatggcagttgtgttgcacgattcggactgttccgaggcatactgttcgccggtttcgtctgtcgcctgttctttactgccgtaaggcagggtggccatgacttcgaagcctccgccgagttgagggccagcctgcaacgagcctccggccgattcgatgcgttctttcatgcccagcaggccgtaacctggcgtatgcccgtcgatattggccgccgcgccatgaccattgtcggtgatggtcaaagtgagcaaaccgttgttccataactctttaatgtgcacatcgacgcgcggccccgcatacttgcggatattcgtcagcgcctcctgcactacatggtaggaagctatcgaggcttgttcgccgagttgttctgggctggcggtgccggtgatattccgtcggattcgaatgtcgggggagacgttttgcgcttgttccacaagattgccgatatcgttataatcggcgtgcggtgaacccccgaatactcccagaagacgttgcatgtcatgcagtgcgcgttccgattcgtgtcgaatcgtctccatggtgtttctggccaccgcgggatcatgcgtgcctgcatagtgaccaccatcagactgcacgatgatgattgacagggtgtgcgccaccacatcgtgcatgtcacgtgcgatgcgtgcgcgttccgccaacgcggcgatatcgcgttcattctggtctcgcgcggcgattgcctcattgcgttcccgcatcatgcgaatggttgccagacgggcacgctgccagaacgctacaatgacggtggaaataatgcatacttcgaaaatcggcgtcagtaccagcatgtactgcgccatcatgtcggcgacttccgacatggatgttcctgtgtagatggagccgagagtgtcttccgtgaccataacgccatttggatttgggtcattccagctgctccatgtatgcactttgcctccggtgagcagtggtccattggtcatggtccatgccaccagcgccgaagccagaagaccgatggtcaacgccagaataatgaaggctttcgtgtttttgggattgccgtagacgatcactgaatacagcatgaacaatgccagaatatcggcgcccaacaggcaagggccgaatatgagatgcgccaaggtcaatgccacgcagagcaacgctccggtctgcggccaccatcgacggattagcagcggaataagcattgccgcttcccatgccatctgcgtggaaggcttaaggtcaaacagcaatcccggattataggtgatgctgccggtcacgccgaacagcagaacacctataacaagcgtgatgatgagatcgccggcgaaaacatggccatgcatccatgacaagagacgctgcttgagattcgacatacgttccaccctagcgccagatatgctgtgacgccatcatgcgcaggaatgaaatagcggtaagataaagccgcttttgtgaggtaaggttgtctccgcatgtgggtgagatggaagccatcaaaaagtcactacccgcattgaacatgccgatgatgtcaagggaaaggtgaatgcatgacgttgctgagcgaatactacgtgcccggattgcatattgaggatcgttccatcaaggtgccgttggattggacgggccacgagcctggtcatgggttcgatggcgaatcgatcagcctgttctaccgtgtggtcacctctcccgaacatgtgcatgacgacctgccgctgctcgtgttcttgcagggtggtcccggtggttccggtccgcgtccgctcggcccaagttccgatggttggatcgaggaggccatcaagcatttccgcgtggtgttgccggatcaacgtggtacggggcgttcgtctcgtgtcgatacgcatgtgattgagggcatggatggcgacggcaaggcaggtgccgcgtttttgaagcgtttcctcgccgattcgatcgttcgtgatttcgagcatctgcgtcgtaccgaattcgggggcgcacgttgggtcacgcttggtcaaagctatggcggattcctgacgctgacgtatctttcgctgtttccgcaaggagttatcgccagtttcaccacgggtggcattccgcatgttcccgccgatgcgaccgacgtgtaccgtcatacgttcccacgcatggtggcaaagacgaagcagttctacgagcgttacccgatcgatatcgaacgtgccgcggccgtcgccgacattctgcagtcgcgcaaggtcgcattgccgaacggcgatccgctcacggtggaacgtttccaatgcttgggatccgatttcggcatgaagccaagtttcgaacgcgtgcattggattcttgaccaggcattccttgacggcgacggttcggcctcaacctcggcggaactgtctgacgaattcctgtcttccgtgatgaatgcgacttcgtctcgcccgctgtattggccgttgcaggagttcatctacgccaacggtgagctggaaacgccgatttgctgggccgcccagcgcgtgcgcggcgagcatccggaattcgcgggtgacattcgtccgcttaatttcaccggcgaggccatgttcccgtggatgttcgagcaggaacgtgcgttgcgtccgttcaaaccagccatggacgtgcttatggaagacacgcatttcggcacgatctacgatgccgaccagttggcgcgcaatgaggttccgctgcaggctgccgtctattttgacgacatgtacgtagattctggattgcagctcgacacgctgtctcgcatcggtcgttcacattattggactaccaatgagtttgaacatgacggcgtgcatggtgcaacagtgttcaggcacctgttcaatgaagcattgaaccgcggagatttggcggagttgttctgacgatcgttcagcaacgacgagcatcgatagcaaaggaaagaaacatggccaatccaaccatcggattcatcggatacggcaatatggcgcaggcgatcgccgaaggcctggtcaatgccggtacaatcagcggcaacgacattgtggcttgtgcggcacactatgacaagctggaacgtaacgccgccaaacttggtgcgaaagcggtgcataccgctgcacaagtggccgaagctgctgacgtggtcgttatcgccatcaaaccgtatcagattgaagcggtgatctcaccgatcgttgacaagctggcgcagccaaataccatcgtcgtgtccattgcggcaggctgggatctgaacaaattccatgacctgttcggaacgtctttcgaacaggcgcacattcaatgcaccattccgaacacgccgatggctgtcggcaaaggcgtgctggtcacggaaatcgacaacacgctcacgcaggaacagacggaaaccttcgaaaacctgttttcgtcaatcagcctgatcgaacgcgtggacaccgcacacatgggcatcggcatgtgtattgccggctgtgcgccggccttcaccgacatgtacatcgaagcattgggcgatgccggtgtgaaatatggattgcagcgtgccaccgcgtatcgtttggccgccaaaatggtggaaggtgtgggtgcgctctatttggccgacgaaacgcatccgggtgccatgaaagacgctgtctgctctccagggggcaccaccatcaagggtatcgcatcgttggaggaaagcgcgttccgtggtgccgtgatcaaagcggtcgacgccatcgaagcctaatactaagctaaggaaccatgtctcttactatcggaatcgtcggactgccgaacgtcggcaagtccaccatgttcaacgcattgacccgtaacaacgttctggcggaaaactatccgtttgccaccatcgaaccgaacaccggcatcgtgccattgccggatgaccgtctgccggtgcttgccaaactcgtgcacacggagaagatcgtgccggccaccgtcaccttcgtcgacatcgcaggcatcgtcaagggcgcttcggaaggcgaaggcctgggcaacaagttcctcgccaacattcgcgaagccgacgcgatctgcgaggtcgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagttggagaaggatttgcgcggcaagaagatcgaaccggcctacatggaggccgtcaagcaggcgaagaccattcttgaagccggcgaaaccattgataaggcggctcgcgaaggtcgtttcgacaaggattccgtctacgatctgcacttgatgagcgccaagccgttcatctacgtgttcaacgtggacgatgccgagctgcagaacaaagacatgcaggccaagctcgccgcatccgtggctccggctccggccattttcctcaacgcgcagtttgaagccgacctgaccgaactcgacgaggctgacgctcgcgagatgcttgcggacgcaggtcttgaggagtccggattggatcagttggcgcgagtcggctacgatacgctcggcctttccaccttcctcaccgcaggcgagaaggaagtgcgcgcatggcagatccacaagggctataccgcgccgcaggctgccggcgtgattcatacggacttcgaaaaaggcttcatcaaggccgacatcgtttcctacgacgatttcgtggctgccgaaggctccatggtcaagatcaaggaggaaggcaagctacgccaggaaggccgcgactacgtgatgcaggacggcgatatcgtcgaatttaaattcaacgtctccaaaaagtaagtgtttctctggctcccctctttgaggggagctgtcgctacaagcgactgaggagcggcacggataaggcctgagaagtcgtcttctcaggcctttgtcatgacattgttctgcaaggactggctgctgcagcagcataatgtgtgttttattattcggccttggcggctttgcagtatttggaatctacaggttgacgatttccgcgccgaacggccagagcgcaagcttggccatcttgaatgattgcaatccgaacggaataccgataatggtgatgcagttgagcacgccggctcccagatagccgagcgccatccaccagccgaccagcaccacccacaggatattgccgagaactcgcatgatttgcccctttccgattccggtcgatgcctcgcatgttcagcttcactattttgccagacagcatgacggaaacgcgagacgtaacccttagctcgcccctgattcattctcggaccgctattcaggcggatcgtatgcggtaagcccaatccttttgtgaagattttgtgtattgtcgggcatacgtggttttcaccgtcgatttgaatgatgataggcttctcgatgtctgccgtatgaagacccatcaaggagatgccatgaacctgtatcgctacgcgatgttcatcgcacgcgcctgccgtgggtcgttcgtcggcaatgttctgtttgccaatccacaaatggccctattctcgatgctggtgtagcagggacgcgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttaccccggactcatcagtgtccccgcgtcttgacacaagtatggggccggatcgctcatacatgccgttaccaacagaaggaaatgctgtgacctcacagaagaccgcggaattcgggtccgccgccagttccgtaaagcctattgattcgcacgcccgattcatcgtcgtgggcgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcgccgaatttcatgctgttgctcgtcggacgcatactgcaatccgccggctccggcgtgctgttgccattggtcgccgtagtgccgatgctcgtctatccgccggataagcgtggcaccgccatgggcatggccggtatcgtcatggccgccggcccggctatcggcccggttgtcggtggtctggtgattgacagtttcggatggcgcccgatgttcattggcatcgcagtcgtggcactggtcatccttgtcggaggcacgatgatgctcaagaacgtcggcgagttgaagaacccaaagctcaacatcctgtccgtgatcctttcgaccatcgcgtttggtggcctgctctatggcttctcgtctgcttccacgatgggatgggccaatccggtcgtcattatttcaatcgtcgttggtcttgtggccttcgtcgcattcgtatacaagcaagtcaagctcgatgagccattgttgcgcgttgacacccttgccacccgcaacttccgcaactccgcgattctggtcactctgattaacgccgcagtcgccgcaaccaacgtgacgttgcctatcttcatccagaatgtactcggccaatccgccaccgtcaccggcatggtcatgctgcctgccgcggcggtcggcatcatcctgagtccggtcgccggtgccgcattcgacaaattcggcccgcgcggcgtgggcatcggcggccttgcgctcatgaccatctctcttggtcttctcggcaccatcaacaccaggacatcagtgctgtttgtcgccgtgttctgcgcattgcaggcatccggtcaggctatcgccaacatgccgatcaacacttggggcgtcaacgctttgccgaacgacatgatcgcccatggcaacgccatcgccaacaccggccgccagatcgcggcagccattgcgacatcgcttctggtcaccgcagaaacatccgtgaccgcctcgcacatgtcccagggtgtgaagtccgccacggccagcggcatcgcgttctcctacctgctgtgcgccgccatctcgctggtcgccctgatcatctgcatcttcaccgtcaccagccgtgccaaggagaaggccgcacgcaacgccaaggcctacgaggcgcaagcctccgccgaagtcgcggtcgaaaccactgaaggccagcccgccgagcatcactacgccggcgcatacgtggcccctgccgcctccctgttcaagcaggcccaggaacagtccatcggcgggatcatggacgatcagccctacagctgcctggacagcgatgacatcacgcatgtggtgcgcgagttcatccgcctcaacgtctctagccttcccgtggtgaacggcgatggcaggctcgtcggcttcgtcagcgacggcgatgtcctgaaatcgattgccacctatgaatcccgtacggttcccaccggcaccggttcgacgatggtggtgttcgacgacgaaaccgtggcctccaaggtgcaggcgctctccggcaagaaggtgatggacatcgccacgcgtaaggtcgttgccgccacgcccgaccagcatgttggagaggtggcccgaatcctcgccaagaagcagttcaagaaactgccggtggtggatggtgatggcagactcgtcggtgtgatccgccgtaagtccgtgatggaacatgccttcgacgcgctgttcccaaaggatgatcggtgattcggcgtcatcatcgctgaatagaatgaatgaaatatgaggcttcccttctcgcgggggaagcctcattgctttgtccgcggagtcttacggcacctgcgcaagggcaacgtcacgccttcatgatgcactattgaatagtgtgttcctatcgttgcatggtgacgctaacgcatggcgtcacgatactgaagcctgccatctaacggcgggtacggctcgttgctggagtcgtgcacgcatacgcgcgtcggtgtgcgtgggatgtccattcaggtttttcccatcttcggactcgtaaaataggcgaggttaacaagacgaagaacgatgacatccgtcgattcgcaaggggtggacgcatatggattatcagtatcaggccgttgaacagccttccaatccccgcaaaacctggccgattgtcctttccgtggtcgtggcgctcactgtggcatgcggcgcaggagtgtacgtctaccacaacaaacggcaggaggcgttggacacatgccggcaatcgcttgcggaattcagctcggcccgtaaggccgtgctcgacacatccgaaaacggtagcgagctgcagaaattgatccgtggtgcgctcggcgtgaacgacatcatcgacgcgttcgcggacgcggccaccagcgcagagaacacggtcgatacggaaggctgtaaggcggacgccaccatcacgcagctcaatctcatcgccaaaacactagacagcgccacggattccctgaataacagcctgaaggacatccgggagaagaacggcacgaatgcgctgcaggattcgcggaacgattcggatggcacgacagcgaacggaccatcctccaatactcagtccaatacgtcatcggggcaattgctcgacgttccttcgaacggttcttccgccacggaatcgttggatgaatcgaagaaggaactgcagcagtcgctcgacaaggcggacaaattggtcaacaagcttgacaaggacgaaacactgacgttgactggccgtaaactgctgtccgcattgtccaaagctgtggattccggtcaaaaactcattgaaaacagcaatatcaaggattccaagtactacaaggccgccaaagtcacgctcgatgaggccatcgatgtggccgagaattgggtggacagacaggcatccaaagcgcaatgacgattctccctcgtgctgcttccatacgtgcgtctaaagtttcccggaaaaacgtcgacgattatgacatcagagaatatgacgccatgacggatggaagcgtaagaggggatacgaatggcgaaatcggggtgtgggccgtcgggaaacatagcgtttgcgaacccggtcgcccgtccatatcctaggcgatcgggttcgcaagaccgattagaagaacagcgctgagactccggccgcaaagcacatcagcagcacggacgtgatgaaactggcgaggaacgccttctgtcccttcttggcgatggcgctgaaattcacgttgatgccaagcgcggtcatggccatgccgagcacgatgtacgcgaaatcgaccagattcggtgcgatggcaccgatgaacggcacgaacgtgccgatgatggaagcgccgatgaaaccgagcatgaaccatgggaacgacactttgcgtttaccgtccgctggcatttcggaatggtttttatcccaccaaacggcgatgacgatggctgcgaacaccagcatcagtactcgcgacagtttcatgatggttgcgatgtccaccgcgccgaacgcgtcgccggccgccacggcatgggcgatttcgtgcaaggaagctccggcggtaatgcccagctgtgtcttactcaaaccggtcaatggtccaagggtgatttccagtaacgcgaagatggtgcccatgatggcgatgatggccacggccatcacttcgttgttggctttttcatcctctttttccggcggtactttgatggagccagacaatcccatgacggcggccgcaccgcaaatgccggtgccgcccgccaccagaatggcgagttgcgggtcgacgccaaatttgcgggcgatggcgtagcacaccacgatggtgagtgtcacgaccacggccgcgatgggcagacacttgatgccttgggtgaacaatacggtcagattgagcttgaatccgagcagaatgattcccagacgcaacagtttattggaaataagtcctgctgcgtccttcacgccggacctgtgttccacggaacggctggaataccatttgcgaatcggaaactgggccgccatgccgatgagcaatgcgatgatcagcgcgccgaacagactgaatcccggaaactgtttaagccacgaagccactagtgaggcggccaaagtgacgatgccgacgaaaaccatttccttggtggctatgcgagcccaccatgttttgcaaaaatcaatcacgtgtctcaagtgttccggccggttcggacatcggtatggtgcggaaagcaatgacttcagcgccgtgccaacgatactgaaatccaatgcgcgatcggcagcaggtacaggaacactgccaatgtcagactggacgtgggcgctcccaccgaagcgagcggcaccgctccggcgatggaccatggaatcagcggagccaccaccacggcggtatcctccagattgatggccttgcgatgctcgtcggactccagatggtcgcatagctgatttgtcagcatgatcgacaacgtttgattgcaggcgacggcactcgccacgagagacgttaccagcgtggcgccgaatacgctgatatgccgggcaagcgatgcgaccatccgatgcgcgccatccagcagttccgtctcttggaaaatgccggaatatgacgatgaaatgcatacgattagcatcactttgaccattgaaacgattccgccaccatcgatcagcggtgcgacgcgcgcgtcagcacagtggaatccgaataccagtgcgtggccaatcgcggtccaatccatatgttgtgctgcaacgcaaatcggcaatgcagtcagtatgctggcggtcatggtgatgcgcacgtcaaccctggcgatcgccagcgcgaccaacaccactgcgggcaggacggtgacccaatcaagatcgaacgcgttggaaaacagtccggcaatgtcaatggagctgttggaaggatgcgtgcacagcgccaatgccgcatacactgcgcacgtcagcacgaacggtaccgcggcggttttcaacatcagtcggatattgtcgaaaatgttcgtgcgcgtcagcgttttgaccaattgggcgctggtggatacgggggagcagcggtcgccgaaatagatgccggacagtatcgctccaccgaggaacaccggtggaacctgcatggaagtgcccaacgtcatcgtgatcacacccatcgtcgcggccgaagcgaacgatgatccggtcagcagcgacatcagacagttgagcaggaacgtgagtaggaccaccacatgaggatgcaccagacctgccgtattcgtcacaatgaacgacacagtgcctgcggcgcgccacagggtggtcagcaggccgatcagaacgaacgttactaccacgatgctggcggcacgcatggtcgcgaaacctttggaaatcatggcggtgaacgtatgtccggtaagacgcccatgagctaggaagatcaccacgccggccaacaacgccggaataatggaaatgccggcgataatgcagacgatcaacgcaccacagaacaacgccattgtgatgagctcggccatggatacacgtccttccttcataggtgccatgcgaaccacctcaccagtgaacccgattggcatggttgatgcgtggactgtttcgatatatgactatcggtgtggcatgtggccgttgcgctgtgtcggtttgcttcaagccgacttgaagttggtaatctggctctggaagcaaaatcgaacagaataaggagaattcatggctgatttcgaagcaaggaagctggacgaattggatcatcgcactgatgatgcctccgcgcccgaagtgttcttcacatctgtgatcacgccggaaagcctgatcggagcctatcatgcgctcggacgcaagcctcaaggcaacgtggccattaaaatccattccggcgaatcggagaaatccaataacctcaatccggcgctcgtcaaggatctcgtgcaggagatcggcggcacgctcgtcgaatgtgcgaccgcatacgatggcaatcgcgaaacgcctgagaaaagccttgccgtgttcaaggaacgtggatacgcggatatcgcaccgatccaaatcatggacatgggcggtgaaatcgaaattccggtagccaagcaccgtcatatcgcctatgacatcgtcggcaagcatatcgacgactatgattccattttcgtgctctcgcatttcaaggggcatccgatgggcggcttcggcggcgcgctcaaaaacgtgtcaatcggcatcgcatcgtcgaacggcaaacgctggatccattccgcgggcgtggccaccgaccactgggtggaaaccgaccaagatgacttcctcgaatcgatggctgaagccgacgaagcagtgatcagccacatgcatggcaacatgatgtatctgaacgtcatgaaccgcctgtccgtggactgcgactgcttccccgccccctccgaaccggacatgcacgatatcggcgtgttgtcatcgcttgacccggtggcgcttgatcaggcatgcgtggaccttatccacgttgcccccgacggagcttccgtcaccgaacgcatcgcttcccgccacggcgaacacacgctcgaatacgccgaagaactcggcatcggctcacgctcgtaccgtctgaccgtgctcgactgacagtgtccgcaatgaccacgaaaccggcgggaacgggcggtgtcgtaatcgcctatattgaagcgctgcttgtcgaacgcgaccatgtgctcgttgcgatagacgggccatgcgcatccggcaaaaccatgctcgccgcaaccgtcaacaagcgtttcggcggcaacgtgctgcatatggacgatttttttctacgtcccgagcagcgcacgccggaacgattcgcgcaacccggcgggaacgtggaccgtgaacggttcgaaacggaagtattggctccgctttttgctggaaaaaccgtgcaataccgtccatgggattgtcattcgggcgatttcgcggtctctcgtaccgtcgaaccggctcggttgaccatcgtggaaggcagctacagcatgcatcccgatctgcgcgggtactacgattgcatgatctgtcttgcgattacgcctgctgagcaactgcgtcggcttgagcaacgtaatccgcgcatgctgcgacgtttcgtcgacgagtggattccgttggaaaaccgttatttcgaagagaccggaaccgaatcggctgccgacatgatcgtcgacactgcattgccggataacgtatgacgatcattgaagagaagaaaacaaaaggagaatgaatatgtctgattctgcaactatgtccgtgcgcgctttgcatcgtaccgacctgccgaagctgagcctgagcaccaaagctgcggccaccgtgttggccattgtggccgcggtcgcattgccgcagctgttccatgtcattggtgccgtttccgggcagggcaccatgcttggcgtagcatttctgccgatgcatctgccgatcatctttgtcggcctgattgccggtcctgccgtcggcgccatcgccggagccgccgcgccgctcgccagcttcctgctgtccggcatgccgatgctggcgatgctgccgctgatgatggtggaattgtgcgcgtatggtcttgtggccggtctgctgcgcgaagtcaagctgccgagtcttgcgaaggtggtcatcgcccagctggccggccgtgtggtgctgaccgcggccactgcgatcgctgtgttcgcgttcggctcaagcaaggcggtcgccgcaacatggacgagcgacctggccgccggtctgccgggactcgccttgcagtgggcgctgatcccgctcgccgcctactgtaccgagtcgctgattgccaagcgcaatcactgaacaacgatagttcaaatgcggcagtcagccacgttctgaacaaaaccgatattttcgggagccaagccattacgcttggctcccgttgtcatatcagtcgggaaatcgggagaaacggttatgatcgcgggagtgtccatcaccacattgctgctggtgctcgcagccggcatcggggcgggattcgttggatacgcggtcggcgcatcctcgttgatatcctatccggcgttgctggcgttcggcattccgcctgtgttgtccaacaccacgaacacggtgggtgtgtgcggaacgggcatcggcggactgctttccgcccgcagggagctcagaggccaaggcgtgcgcgtggccgtctacgcctgcatcggattggtcggtggcatcatcggcgggctgttgctactggaactgccggcgaaggtcttcgaattcgcggtgccgccgcttatcctgttcagcgcgatcatcatcgcactcaatccacggaagaaggcggccgcgcgcgacgccgtggcacaggcgctgccgcaatcgcatcaaggcgaacgagccgcgcggatcgccagcaaaaccgcaagcggcacgttgtgcaacgatccgtggtggctgtgggtcggcgtgagtttcgtcggcgtctattccggctatttcggcgcggccgcgggcacgcttgccttggcgatcctagatttgggtaagatcggcccgttccaccagatcaacgcgctgaagacggtagtcgggttcggcgcgaacatttccgccgcaatcatgttcatcatccgtggatccgtgtattggccatttgccatcatgatgtgcctcggttgcacgatcggcagtgcgatcgcaccacccgtcacccgccatattccggagaacatcatgcgcgccgccgccgtgctcaccggcatcatcctcgccgtcaagctcggctggagcacctacttgtgacatgcactgtacattgattcgcaaggtgaagtcccgctggaagaaccggtttctccggcggatttctttttctagctgccttgcgattgaaggacctgagagccgtccatcggtatctcgcaaaacagcatcgtgtcagataagcgtcgacagcgctcgcatgacgatgtccacgtccttgttttccaattcgcgaatgacatgcagataggtttcctgtgttgtggtcatgctggcgtggccgaggcggcgcgacacgctggcgatcgatacgccggcgaacagcagcagtgatgcgtgcgtatgccgcaatccgtggatggaaatgactggcacatccacgttcttgcaatgtctggcaagcacgtcgttggctgtggaattgtagactttgccgtgcacgaagatgggtttgtcatgcggaagattcttgagcagtccggaaagctgcatgatgagctgccagtcaagctgcactttgcgcacggaggattcgtttttcgtgggtacaaaaccgccgccgtttttgtaatcccaggttttgctgacggaaagcgtttggtgggcgaaatcgaagtcgtcgggcgtgagcccaagcgcttcggagaagcggagtccggttttcgcgatgaggaggatgagccaatcccaacttgcctcatcgccaagatcaagatcagcgagcatagcgtgcagctcgaattggttgagatacttcatttttttgatgcgtggctgcttgcctttgataatgactttgcgtgtcggatcacggggaatgagtccttcatcaacggcatcgagaatggcgcctttgatctggtgatgaaaatccatggtggtctggcgctcatgatgctgcgcgtaaccgttaatgagctgctgataggcggtgcgatccatatcggcaagtcttagttcagggatgagtttgctgagccaagattgtgtgagtcgatatttacccatggtcacgtctctgatggcaccttccttatacgttctcacccactgggcgtagtagtcgcagaacagcgattccgaggtgatgttttcctgcatagtgtgcacctttctaaaaaagataggggataaggtgcagccatcatacttacgctgatgaagggtgatgagcgagtccagacggtcgaagaacgcgccgattcggcgctgctcgccattgtctggaactagaacttcggtttcatttattgcccgctttgaaagacttggaagccccgtcgactcatccttacttttccaatcaacgttcagaaaagaacacaaaaggaaattaatatctgaggaagcctcaggaatggcataaaataacgtatctaccgtccagaaaggtgcctgcagtctatacggtttgtcgatagttccttttcgccctatgccaattgcatcttcatcatacgaaagagccttagaaacagatgtcatgtaaccacctgttccgtataccgggattggtccttccgccagatgcttatagtctctgccgctgcaaacattggcaacttcacccagcttacgctgttcccaagggtcagtgaaaccagcgaaacgaatctgcggaactagtgttttttcatgctgttcgaccataattattcacccccgagcagtgatttgagctcttccaagcccgccagatcgcgggcattaccggtcaaatcgccaagcattccggccaattccctctccgcttcatcgatttggacgcatacatcggcatatgtggtggcgtacttgttcttcaacgcgttcactttgccaatgaattcgtcgatcaccgcattcggcagcgcttccagctgcttctgcagcggcgtaatccacttggcttccagcaaccttctggcttcgtcatcactcaatgccttaatcgtgttgtaggtcttctcctccaacacgtttcgcttggtcttgatgccggatttcagcttcttcgcctcatcgagtagcttctgggcctgcaccaagccacgctcgaagtcggaagacggattcttgccgatcgccttgaccgctttcttcagctcggcggcaacgaaggcgtcactgtcctgattgattgcatcgctgttctgcctgtcatcctcatcgaaaccttccaatatggtttcaatctcggaatcgatgtcttgcacacggcgttcgtccgtctcgattgcggccaaatcatcgtgcagcagctcgcgctgaaccaggtcgaacggcagaacgcggccaatccagccatcctgcacttccacatccttgccggccttcttcttgacgaccatgttcggatccacggctcttaccacatcgaaaccttcggaacctaacacttccagatcaatggagatgccgttccatgcgtcatcaagcttctgataagcatcatacgggtcaaccagcgcggtatcggcaatcatcgcatccaattccttaccgatggccgtttcctgggcgagcgcatccacttgttcgggatgctccaccaaacgggagcgcaggtcagcaggcaggccggaaatggcttgctcatacgaggcaatgaacgcctgtacgtcggcattgttgcgcaccacagtggcgatatcatcgtgatcgcaggcatagcaggcaccattatcacggaacagttcagccttcagactcggccaagcgttccaatattccttgaaccgctcaacctcgttcttcggaacgccaccgaacatcgaagcgtacacatcccacatttccgcatcctcggatgaatcgacataacgcggaatgttgaggttgtaatcgttggcgcgaatctcatcgatggacaccagacggctgaacttgggtaccgtgcgattgttcgacaccacatcgacaatgcgtttgatatcagaagcctgtagcttgttgttcttgccgtccttgatgaaatgtttcgacgcatcaacgatgagcaccttgtcgtcatcgcgttttttgcgcaacaccatcacgatggtggggatacccgtaccaaagaaaatattcgcaggtagaccaataatcgcctgaatatgacggttctcgatcagattcttacgaatctgaccttcctcgccgccgcggaacagcaccccatgcggcagaacgatggtcatgatgccatcggcacgcagatggtacaagtcgtggagcaggaaagcataatctgccttggacttcggagctatgccatagctgaaacgcggatcgatctccttgtcagtgggatcccaattctgcgaatagggtgggttggagaccaccgcatccacgaacagcggattgtacgtttcctccttgttctccaacgtgtcgaaccacggccagtcgtcctccagagtgtcgccgttgcgggcaacgatgttgtcgggaagaatgccacgcatcaccagattcatacgcgtgaggttgtaggtgttttccttgagctcctgcgcgtaatacatgatggaatccggattgccgttacgtcgagccaccgcctgaccgatatgaatcaacaaggaaccggagccggatgtcggatcgtagatcttgatctgctcgcgcccctgcaaatgccaggcgacgatttcgctcatcagctgggaaacctcagaaggcgtgtagaactcgccggccttcttccccgcattggcggcgaaattgctgatgagatattcgtagatgaagccgagaacgtcataatcctgacgcccatccatcggaatgtctttaatgaggtaaatcaaatctcgcgcggccttggactggcttctcgcgtcggtgccaagtttggaaagcccggtctgcaacgtgtcgaaaataccgtcgaacactctcttacgcgccggattgatgttgcgggagaacgccgaaagcgcatcacgcacgttggaaatctcgaaatcgttgccctttttgatccatgtggaaaacaggttgtcataggcgatgaaatagccacactcatcctgtacgccttccacaatgtccggattatcctccgtaagttgtggcaggtcatcctcggtgaaatcgttggccttcaagcgcatcagctcgttttccgaaaggaatttatagaaaatgaagccaagaatgtaatccttgtattcgttcgcttcgatcttggaacgcatcttattggcggattcccaaatcttcgaagcgagctgctgcttattcatctatccctcctcattgcggtaccggcaaaccaatgcacggctccacgagtgactgcacatcttccataagaataccgcgcccccgcttgggaacagcgtaagctgggtgagctatataaagaggtctcagaaaaaaatgatttgacctacggcaaggatcgtattatttctgttgcgcatatgtatttcaatcccgttgtctatgttactgaagatgactatttgaaaacatacaatgtcatgcgcttgggagatatagctttcgagggaaatcgaagcaagaactttgcgcatgggcgtttggtggaaaacacaattggcgatggtattgtttcgcatgttttcaaggtttttcggccgatccagccttttgacttgatgtactggaaatacagtatcaacaatgaaaaagctatgaaggatgtgttgacacgctcgactaaagcatcaacaatgatgcatgaactcgttgcaaaagacttccttaatgaagaaattgccgttccatctttagaagagcagcgccaaatcggcgggttcttcgaccgtctggactccctcatcacccttcatcagcgtaagtactgtggtgttgcttcttggatgttaggggttgcgctcgtaagattgggctcagaaagtgacggtgcattcggggagatgaaacatgttctacgataaagaatcggatttcgaagacgatctggtcgcggtactgaagcgccatggatggaccgatggcgtgctggaatacccaaccgaacaggaccttatcagcaattgggccaacatcctgttcgacaacaacaaaggcatcgatcgattgaatgggcagcgccttaccaaaggcgagatggcgcagatcctcgaacaaatcgaaacattgcgcacaccattggcgctgaattccttcattaacggtaaaaccgtatccattaaacgtgataatcccaaggatgaggctcattacggtaaggaaatcagcctgaaaatctacgatcgtcaggaaatagcagcggggcaaagccggtaccaaatcgcaagacagccgatgtatccggcgaaaaacaagatgctgaacaatcgcaggggagatatttgcctgcttatcaacggcatgccggtcatccacatcgaactgaagaaaagcggcatccccataagccaggccaccaatcaaatcgccaaatacgcgcatgaaggcgtgttcaccggactgttcagactcgtacaggtcttcgtggcgatgaacccggacgatgccgtgtacttcgccaatcccggtgaaggcgatttcaacgacgattatttcttccattgggctgactacaacaatgagcccatagcggcgaacaagcatgtcgggcaggacgagtggaaacggttcgcgtcggacctgttgtccattcccatggctcatcagctcatcggtttctacacggtcgcggattccgcggacggatgcctcaaagtgctgcgcagctaccaataccaagcggtgaacgccatttccgaccgtgtccgcacctgcaaatgggacgagcctgtgccgagcggcactccgggccgaccgggcggttatgtgtggcacactaccggttcgggcaaaaccatgaccagtttcaaagcggcgcagcttgtcgccgattcgaaggatgccgacaaggttgtcttcctcatggaccgtatcgagctgggcacgcagtcattgctcgaataccgttcgttcgcggatgatgccgacgatgtgcaaggtacggaaaacacggatgtgctcaaggcgaagctggcaagcatcgacccgaaggacacgcttatcgtcacgtccattcagaaaatgagcaacatcaaggccggcgaggggcatatcaccgaagaggaagtgaagaagctcgccggcaaacgcatcgtattcatcatcgacgaatgccatcgttccacattcggcgagatgctgcaggatattcgccattccttcccgaacgcgctgtatttcggtttcacaggcactccgatccatgaggagaaccgcaagaagggctcaaccacatcaatggtattcggcgattgcctccaccggtacagcatcgctgatggtatccgcgatggcaatgtactcggattcgacccgtacatggtgttgacctaccgagacaaggatgttcgccaggctgtcgcgttgcagaaggcgaaagcggcgacggttgaggaagcccaagcggatccggcgaaagccgaagtgttctaccattacatggatccgaatcaaatgccgatgggacctatggaaacgcaggccggagaacgcatcaagggcattgaggattacctgacttcggcgcagtacgcgcagggcaccccgcatgagggcaaggttgtggaggatatcctcgaccaattcccattgctgagcaggggcaacaaattccatgcgatgctggccacgagttccattcccgaggcgatcagctattatcgcttgttcaaggagcgtgcgccgcagatgcatgtgaccgcgctgttcgaccccaatgtcgataactccaacggcgctattctcaaaggggacgcgcttcaggagatcatcggcgattacaacgaactgttcggcaaggatttcatcatccccacatggccgaagatgaagaaggacatcactgcgcggctttcccacaagcggccatatctgacggtcgatcagcatcgcgaggaacggctggatctgctgatcgtggtcgaccagatgctgacgggcttcgattccaagtgggtcaacacgctgtatctcgacaagatcatcgactacgagaacattatccaggcgtttagccgcacgaaccgactgttcggctccgacaagcccttcggaacgatacgctactatcgcaagccgcataccatggaagggtatatcgaagcggcggtgaaactatattccggagacaagccgcttgatctgtttgtgcagaagctgccggaaaacgtgcgtctgatggatgcgcgtttcgaagagatcgcttccgtgtttcgcgccgaaggcgtggaggatttcatgaagctgccggagtctgtggaagcatgccggaagttcgcgaagctgttctcggaacttaatgattttcttgaagccgccaaagtacaaggatttacatggcagcagcgggaatactccgtcacccatgacgatggttcggtggaggttgtgcggccggaactcgacgaacgcacatatctgattctcgttcagcgatacaaggagttgtttgctggagatggcgaaggccatagtgagggtcctgaggctccatacgatcttgatgggcatatcatcgaaatcgacacgggattgatcgatacggattacatgaacgccaacttcaccaaatggctcaaggcactcggcggaggagatacagccctgttggcatccgccgaggaggagctgcataagtcattcgcttcgctcagtcaggaggagcaacggtacgctgaactgttcatgcatgatgtggagcgtggcgagattgagttggaggagggcaaaacgctgcgtgactacattacgtattatgctaacagcgccaagaacagccaagtggagaagatcaccaaggcgtttggcgtggatggagctttgctcaacgagatgatgcggcttgatcttaccgaagcgacgctgaatgaatttggtcggttcgaccagttgaaagcgtccatcaacaagcctttggcaaaggcgtttttcagcaagccggatagctctgtcactcaattcactgcgaatcttctcgccaccaagttgctgaaaagctttatccttgaaggaggattcgatctggatgatcgtaaatagcggacggcagtaaaacagggggagaatcatgtcggttgtcgatgaggcgaaactggggtatctggactttctttcgcgtgaggatcgggtacgccaccatcgctacgttgaggaaatgaaacagtatgacatgatgcgctccggcgacatcaatgccatttcggaaagcgcgaaactgtgggattccggactatacggccatctgtcggacgatcctctgaaaaacgcgaaataccgtttcgtcactaccattaccttggccacgcgtttcgccattgaaggtggcatggacgaggaagacgcatacaacgcctccgatctgtacattcaagatcttgacaattgcaagaccccggaagacgtgcgccgactgcacgccgacatgatgactttcttcacttgggccatggccgacatgcagaaaaccgacacccattccaaagccgtcaacgaatgcatggactacatccactaccatctgcatgagaaaatcactgtcgcgattctggcacagcacgtgcatttgaatcccacgtatctgtcggaactgttcgcacgcgaaacgggaacgtcattgtcgcaatacattaccgacaaacgtatggaagccgccgaaaacatgctgaaatattcggaatacagcttcaatgagattgcacagatcctcgcataccggtcgcaaagccacttttcgaaagtgttcaaaaaacatagcggcatgacaccgggggagtaccgcgccaagtactcacagaacggcatttggccggagtagcagcgcctcggcgtgtcgcgggcgatgcggtgaaccggacgtaacgacatcgcgaacttcggttgtgccaatcgtgaaatcgatgtggtttcgcgtgtggcatacgttcgaatcgactacggtgaaagtattcaatgatgatgcgcgccggccgaatgaacggcaggacggaaacgcgcgcaggatgtggatgaaagtaaaggaataaacgaatatgggaatgccccttgatttgtatgtgattcgacatggcgaatccgaagcgaacgtgattatcagtgccggtgaacagggtgacaactcgctgtatacgcaggacaacgtcaccgtgcccgaccgttcgtggaggcttacggccaccggccgcaagcaggcggactgcatcggccgctggctggtctcacagcagccgttgttcgaccgctacctcgtctcgccgtacgtgcgcacgcgtgagacggctgccacgatggccctgcctaaggcgaaatgggaggagacacgcgtgctgcgcgaacgctcctggggcgagatcaataccatcacgaaagacgatttcaaaaccaattacgcgcgcaactggatgttcaagaacactgatccgctgtattggcgtccgccggcgggcgaatcgatcgccgatgtggccgaaaaccgcgtgcataatctgctcacatccctgaaccgcaagtcggacgcagaatccgtggtgatggtcagtcacggcgacctcatgctggcgcttatgctcactttggaggacttgtccgacgaggaattcatgcaccgtgcggcgtccgacgaatggaagatcactaattgtacgtgcttccattattcgcgtcgcgatccggccaccgggcgtacgtataagcggttccgttgggaacagaccgcccgtccggtgttcgacggtgcggaaggccgttgggtggtgaaggtcgaagattggcgtgaattcaagcgtccagtgctgtcgaatggcgatttggtggacgttgttcatacggttgaccgtcacctgtgatgtgtgtcggtctgttgactgcatgatcggattggctgatatcgacgattgatgcccccatctcgcgtgcgcaacgcgctcgtgtccacgcctcactacaatggctgtgacacgcggcgcgtttttgcttgccgcgcaagagagttaaggagacaatcgcatgtccaatctgttcacgtggcaggtccacggtgacggcaagacgctgaagccgggcgaagtcgttgagcctgacgagcgcctgacttggccgcgcaccgccgaaatcggtgcgcagcacgtcatcgccatgttcggtgccacgttcctggtgccgattctgactggtttcgacccgtccaccactttgttctttacggccatgtctaccgcactgttcctgctgatcaacaagaacgtgctgccgagctacctgggctcgtccttcggtttcatcgcgccgatcgccgccgtggtcagcgcccacaagggcctcgctgtcgcgtccttcggcatcatggtcaccggcatcctgctggccctgatcggcgtgctcgtccattacgcgggcgccaagtggatcgacatcatcatgccgccggttgtcaacggtgccattgtggctatcatcggcttcaacctggctccgagcgtgtggaacaacttcaaggttgctcccgacaccgccatcgtcaccctcgtggccgtgctgctcgtcgccgtgttgttcaagggtctgctcggccgactcaacatcctcatcggcgtgatcatcggctatgcgtacgcctgcttccgtggccaggtcgacttctccgccatcggcaaggccgcatggatcggcctgccggaattccgtctgccgcaggtcgacttcaccatcctgccgatgttcatcccagtcgtgctcgtgctcgtcgccgaaaacgtcggccacgtcaagtccgtctcccagatgaccggccgcgactatgacgaccagatcggcaccgcgctgttcgcagacggtctcggcaccaccatcgccggcttcggcggcggttctggcaccaccacctacggtgagaatatcggcgtgatggctgccaccaaggtctactcgaccgccgcatactggtgcgccgccgcgttcgcgctgattctgagcctgtgcccgaagttcggtgcaatcatcaacaccattccggctggcgtgctcggtggcgtgaccaccctgctgtacggcatgatcggcatggtcggcatccgtatttgggttgagaacaaggtcaacttcgacaagccgctgaacatcatggttgccgcaatcaccatgatcatcgccatcggccagttcgcgttcgctttcaatggcatttccttcaacggcatcgccatcggcaccatcgtggtcctcgtcgcctaccacggcctgaaggccatcggcaaggctaccggcaccattgccaaggacgatccggacattctgtgacggacggcaatcagccgtatcggacccgtcggtcttatggccggcgggttctttttgtatgtgttttcatgcaaacgttccaacatatttcgtcaatcgatcaatgtgttgcgttgagcaggttttatgatggtgcgtgtaagtgaatgcgcatgcggcaagggaggtatgatgagcactgcagcaggaaagaagatcgctatcgtcaccggttccgcgcttggattgggatatgagctgactcgacagctgatcgccaaaggatggttcgttgctggtattgatttcaatggcgcacgtcagacggagttgtcaaagacttttgctgccgacgaatacagagcttttgtgggcgatatttccgacgaatcgttcgtgaagaactctattgccgcaatctcgaaaatcggtcatatcgatttgctgatcaacaatgccgggcagccttcgttcaaagtcccgaccgcatacgaggcggccgatgtggacaagtgtctgaaggggctgaaaggcatggtgttgtggagtgtggaaacgttgaaagcagacggtgagcgggatctcaaaatcgccaacgttatgtctactgcggcaacgcgaggcaaccccaacgaatccgtgtactgcgccaccaagtggggtgagaagggctacaccaagagtttgcaggccgcatacaaggggaccagtgtgaaaatcgtgggtgtctatccgggtggcatcgacaccccgttctaccgtgacagccatgactacgtttcagaagaaaagcagcataccttcatgcgtgccaaccaactggccgaagtgattctgttcaatctggtcaacgaagcgaatctgaccgtcaccgatatcgaaatcaaccgcaatccggcgtgaatataacggatatgaaggattgaaggaacgtaagaaaaagtatcgggcataggctacagttattaggtttgcgcaacgtgcgtaatatttgacatgaaaggccattgtgcccgataccgtttttgatgatgaagataccctcgcagccgcttccgaagtgatgggcgaggaagaggaacgcccgctgacattcgccgaactcggcgttcctggtccgctggtccgcgtgcttgcggctgatgacaagaaaaccgcttttccgattcaggccgacacgcttcccgattcgttggctgggcgagacattcttggccgcggtcgtaccggttccggtaagacgttggcgttctcgattccgctggtcgctcgtctgggtgaagtggatgccaacgaatatgagaatatgagccagttccgccatgaggttgatcgtgtgaagcaggctcatgccaaggagcggcgcgctgatgatttcgtgcctcatccgcgtggcttggtgcttgctccgacccgtgagcttgccaaccagatcaacgacgtgctgatgccacttgcccagatatacggcatcaacaccaccaccgtgtatggcggcgtacgttatgcccgtcagattcgtgaccttcaggccggtgccgatattgtggtggcttgcccaggtcgtcttgaggatttgatcgaacagggcgcgctcaccttggacaaggttgaggtcgcggttattgatgaggccgacgaaatggccgatatgggcttccttccgccagtcaagcgactgctcggacagatttcgttcgacgcgcagattatgctgttttccgccacgctcgaccatggtgtggacgaagtggtggaaaccttcctgtctgatccgaaggtgcatagcgttgattccgcgacggcgaccgttgacgagatgacccaccatgtgttcaaaaccacgcagggcaaccgtcacgagctggtgcgcaccctcgcttccggcaagggccgtcgcattctgttcacacgtaccaaattccagacgcagaagcttgccaaggatttaacgcagaacggcattcctgcggccgaattgcacggcaacctgagccagaatcagcgtgaccgcaatctggccgctttcaactccggcgatgtgaacgttatggtggccaccgatgtggccgcgcgaggcatcgatgtttccggcgtggaactcgtagtgcaggtcgaaccgccggaagatccgaaatccttcctgcatcgttccggacgaaccgcgcgagccggtcattccggtgacgtggtgaccatcattctgccgaaccagcgccgcagaacccgtcgcatgatgcgtgaggccggactgacggtcgaaccaatcgacgtgacccctgattcgccggaagtgttggaactcgttggcgaagtggccgagccggtgttcggctggacgcttgagcagtcgcagccggtaggaaatccgcgccgtaggaagaatggcaaggggggtgccgacggcgaacgttccggcaggccgaaccgttccggcgggcgtaacaaggatcgcggcaaagacaagggcggcaagccgtttaagtccgaacgtaaggatcgtcgtgatcgcgaccagcgtgaggagcgtaacgacagcgcgaagaagttcgagccgaagaagaaccgtgcggaacgccgtgccgccaagttcgaaggtcgtgacaatcgtgaattcgaagcgcgtgaacatcgttgggaacatcctgaaattcaggaggaacgccgcgaacagcacgaggaaaagcgcaacaacaaacgtcgtgaaaagtacacgcgcctgcatgagcagcagcgcagcgacaatgaacagcgcgaaacaacgaacaagcgtaggaacgacggtgattacggcaataccgacaatcgcaggaagccgggaaaaaagaagtccggacagtttgcgaaaaagcagggtgcgccaagcaagaagcagcgcaagtctgaagcccgtgccgagcgtcgatatgacgacgatcgtcggtccaaaggcaagaagcatgacgagcgttcctcggacgcgaaacgctatgaccgtcatacggaagtcaagcgtggcggccgtggcgaacgtcacgacaagcatgcagggcagtcacggcatcgccatgcgaacatcaggaaagcgccattccgtatgcgttgatcgctgaaaagcaaaatcaaagtttgcgtagctggtaaacaatagaaaacggtgtccgccaaaatctatgaacttttggcggacaccgttttctattaaatctgatcatctattaatttgcttggctatatgaaaagttgctcagcctgtaatcggattgtattggtcgtctgcagtgaagcacttacggtacgccatcaccataatgagactatcagccagaagcgtcaacgctgcgatggcggcgagaatcaggaactggtatttcgcagcatcgataggattgccgccggcgatgatctgaccggccatcatgccaggcactgtcacaatgccgctggaagccagcgaggcggtagtcggcagcaaacccaaacgaatcgacgagacgatggacgggcgcgcggcctcccaagcggtcgcacctaacgccagcagcgtatccacttcgtcacggcgttccttcatgctttcgaagaaccggctcaatccaaccgccaaagcggacacggtattgccaagcagcatgccggtcaacggtaccaccaattgcggcgcataccacggttgcgggcgaatgatcaattcagtgaccaacgaaatcataatgagcatggtgatgaccaagctcaaaaacacggggccggccaagcctttcggtacacccttggcacgggacagggtgatttgcacggccgcgatcagcatgaacatcaccagcagcagcaccagccatggattgttcgacttgatgacgaactccataatgaaacccatggcgcacaattgcagcaacgcgcggcacgccgaccatagcagtgtcttgccaatacccatgcgcatcgcttcggaaatgcccgcggccacggcaaccataaccaatgcgataagcagaccccaaatatcaatggaatagtaattgccgctcatgcctgcgctccttgcatcgaatcggactgtgccgcgaaatcattggaatcattggttgctgtggttcgcggagcattcgcactttgcaatacgccattggccagtgtaagaatacgcgtggcacgtccatccggtgggcgatgacgaatacggatcaccgtcatgccccgctctgcggcctgagccatgatggacgccaccttatcggcgttctcatcatccaaaccggcgtcaacctcgtcggcaagcagcacttttggcgaagtaagcaaggtgcgcgccaaactcacgcgggcggcctggcctccagacaagtcatgcggagcacgccccaaatcaatatccgcgcagccaatggcgtcaagcgtggctcgaatgcgatcatccggcagtagatcggcgggtttgagagacttgccggacgaccatttcttgccgaatccttgcttgccttcgcccgcacgaatagccaatgtgaacggtagacgaatcgcctcggccacactcgaaccgatcaatactggcttctgcggcaaatacgccacctgactacgccactgctgcggtgtgaattcgctggcagagcgcccttcaagctgaaaatcgccgttcgcattcggattcaatcgtgcgaaagcggtaagcagactactcttgcctgatccggaagggccaaccaaatccacaatctcaccaagcttcatatcaacggataatccgctgaaaatcgtgcgttgctcaccatcgacaggcacgacacaggaaacattcgaagccgaaaaaacatactgcataatccaacaccataccgcttgactgccggtcggaagcattggatgcgtttcttagtgtcttctaagctggatcacattgcatgggaatattgcatctgccagtcacgaattgaaaacactgctcgccatcctctatacaagagccgatcttattgaattccgccataagcgagataagtccatcgaagagccgttgaatgagctgagattcgatgtggaccgcatgaacatgatcatctccaatctgctcgacgtggtgcaggcagacaatccggaaaacaccgtcaatgcagcacatgatggcgttcgaggcgtgatcggcaaaggcaagaacgctaccgaatagcatcattcattcagcttgctcacagtatttttcgttgatattccaaggaaaatcagcctcaaggatgaggtcgtgccaacgtttcgtggactacaactggcacgttggaagtgaaaaatatgaaagcaagaagtgagcatgcgtgcatggttggtgaacataagtttggtggatggctggtttccggcaacgttgttttcgataaccgcggtgctggcggcgatactgctgggtattgcgatatgggagatggttggcggaagccgtggcggtggtaaacgtgcaattgccgtagttgcgtgtccgatggtgattgcggttattgccggcattgtcggattggtgattacctggttgctgtcggacgtgtttgtggtgttcggtgttgagctgggcccgcgtgtgattgcgtgggctggttgcggttgcgcgatcatcggttttgcggtcagccatgcgatgctgcataggggagtgttgcgtgccgtcgccgtaatactggtggtatgcgcagtgttttccaccgccaccggcatcgatcaggcgtatggagaatatgccaccatcggatcattgttcggccaagacgcctatcgcgaagccgacctgacgggaatggcgaaacgcagcgatttgattagcgtcacgcaatggaggcaggaagcggcagacggtagcatcagcgatattcccgcacatggcgaagtcagtaaagtaaatattccagccgcagcatcgcatttcgaagcgcgacaggcgctggtatacctgccgccggcagcgcttgtcacagccaaacacaatccggcgttgccggtcatactgatgatgagcggccagccgggctctccggggcgcgtgtttgccgcgggcggcattcaaaccatgatggacgattacgcgcagcatcatggcggactcgcacccattgttattgcggccgaccagttgggagacgattcacataacaccctatgcgtggattcgccggtgtacggcaaggcgttgacctacttgacgaaagatgtggtcgactgggtgaaaaccaatcttcctgcggcacagcaagcacaagattgggcgatcgcaggtttttcacagggggccacatgttcgctgcaaatcggtgcgaaccatccggatttgttcggcaccatcatccccaccggcagcgagctcaaaccgaccaatggcagtgaaagcagtatgatcagccggttctttcacggcgatcgcaccgcatatgagaagcagattcccatcaacgccattcgcaaccatgcgccttcgaaccagacgcttgtgatcggcgcgggggagcgtgatcgcgagtccgtgcgcaatgtcgaactcatcgcaccggttgctcaacaggagggcatgcatgttacggcagtcgaatcgctcggcaatgcgcatgactggcatgccgtgcgagacacgttgcggtatgggcttgtcgtattcggttataacacgggactgagtgatgctaagccgaaattggctgactatccgaatcttaaacgcatcacgatctgacatgtcgttttgaagcgtcagcaactcgcaatcgcaagtatcaatctgaatcatctatcgaatcattaatccgaattatcgaatggaagcattgttatgacgacgcaatcgcaggaatcagcagtaaaaccattattcggctttcgcgcgctcatatccgatcttgtcgactggattcgtcggcaccgtatgaccttgggcttcgtgctgttcatcacgctgttcaatgtcggcatgcagctcgtatgcggcatcagacatacgcaatttccgccgcaattgtcgcgcgtgagttttgacgcgctcgcgcatgggcgttggtataccgcgccgatttcactgctgtcggtgcctcatttgggtcgtctgttaatcgacattccactgatactcatcgcattcggcttatgcgaaacggtgattggaaaggcgaagacggcatgggtgtcgctgatcaccacgcttggcggcatagcgctcggcatgggattatgctcgctgttcgcaggcaaaagtccgcaatggcatgcgatttcgcatgatggcgcgattctggggccgctggttgttgtggtgggcacgctgatgtgtgccagcgcattcaccgccatgctgtggcgtcggcgcattcgtgtgatcggctatagcgtggttctgatcatgttcttataccgtggcgaagctggcgattattgtttgctggctgccgcgctgatcggtcatgtgcttggttatttgatggcgtctgagagtcaaggcgatgtgtataggcatggtgccttgtacgagatgcgcaggctgattggtatggctgccggcgtgcaggcggtcggttcgctggttgccgtttcctcaagacaatcattcggattgctctccatgttcggcttgctgaccggttccacggaattcgacacggaacaagtgttggattgcctcaacggttcctcgcatgccaactgtttcgcgcaatatcgtatgatgcgattcaccatgcccggaaactggctggtgtcgttgatgccgacgctgatgctgctgttgatcgcatggggtttgtatcgcggacgccgcattgccgccgtgttaagtgtgctgttcaatgcgtgcgcggtggtacttgcgatgctgttttatgtggtgcttccgctgcaatatgttggagattcgcaggctgatacgttgcctgcgttggctcgtcacggtgcgtttcacgcgatgttttccactatggcattgccattgatttttatcgttatcgtcattgcgttccgtcagtgttttacgattcgcactagaagtgagattatgttgcgtgctgtggcaggtgcattgtcggcttttctgttgttgggattgatgtatgtcgggtatgggcttgcctctcccgaggatttcaacgaaagcccgcaattgattgcattgcttgccgattatgcgcaacgattgttgccgatcggattgctgagtggtatcgaacctgagtttgtacccgtcgggcaaatctccttgctggtatatcagtgcgtcggtccggcgttttggattatcgctctgctgtgtgtttgggagtgtttgcgggatcgttccatggtgaatgacgcttcgcgccatcgtgttgacgcgattattccgcttggcggcgaatccatgtcattcatggcaacttgggaaggcaatgattattggttttctgcaaccggacgttccgcaatcgcctatcgagtgtcgtacggtatcgcattgacggtgacaggaccattcggagatccaaacgaatatacggaagatctcactgatttcgcaacattctgcacacaacattcctggacgcccgtgttttacagcgtacacgagccacagcgagccgaactcgccaaagccggatgggactcacttgacgtcggcacggaaatgatcgtcaatcccaacgaatggcaaacccgaggtaagaaatggcaggacgtgcgcaccgccatcaacaaagccaaacgagacggcatcaccgacgtgctcaccactttcaaggaggcacccttctccgtacaaacgcagattcgtgagatttccgcacagtgggccggcaaaaaggccctgccggaaatgggattcaccttgggtggcgtcgacgagctgatcgactcccgggtacgcctgctctacgcggtcgacggcaacggcaaagtccttggcgtaaccagctggctgcccacctatcgcgacggcacaatcatcggttggacgcttgacttcatgaggcaccgcaccgacagcgtcaacggcatcatggaattcctgattgcacgcatggctgaacgactgcgcgacgaaggcaatgcggaattcatgagcctatcggcggcgccactggccggtatgggatccaacaaaggcgaacacgaggaaagcgaagtgttacgtcatgcactgcaaatggtcgcagacatcatggaaccagcatacggattccactcactattccgtttcaaactgaaattccaccccgatgaagagaaagtgtatatctgctatcccgacgcagccaaactgccgcaaatatcgcttgccgtggcacaagcctacgtgccgtcgctcacacctgccgaagccatgcgattcgtacgtacgattgcgccgcgtgattgacatgatgtcagacttgagacggtccacggttctggggtagctcgggtctacactaaagaacggttcataaagtactacttttcctgatggaaggggccagcatgtcagctgaagcaaacgtcggcgtagtcggtcttgccgcaatgggcggtagcctcgcacgtaacctcgcacaccacggcaacaaggtggcagtgttcaaccgctcttacggccgtaccgaaaagctcatgaacgaacacggcaacgaaggcgaattcttcccggcaaaaaccctcgaagagttcgtggacagcctcgtcaagccgcgtaccgccatcatcatggtcaaggcgggagagccgaccgacgccatgatcaacgcgctcgccgacctgatggagccgggcgacatcatcgtcgacgcaggcaacgcctacttcccggacaccattcgccgcgagaaggaaatcagcgctcgcggactgcatttcgtcggatgcggtgtgtccggcggtgaggaaggcgctctgcttggaccttccatgatgccgggtggctccgaagaatcctggaagactctgaagccgatttttgaatccatcgcggccaaggccgaaggcgaaccgtgcgtcacccatatcggtctcaatggtgctggccacttcgtcaagatggtgcacaacggtattgagtactccgacatgcagctcatcgctgaaagctacgatctgatgcgtcgtggccttggcatgactccggctgagatcggtgacgtgttcgaagagtggaacaagaccgaactcgactcctatctgatcgaaatcaccgccgaagtgctgcatcaggccgacaagaagaccggtaagccgctggttgacgtgatcgtcgaccatgctggcatgaagggcaccggcacgtggaccgtgcagaccgcactgtctctggccgtaccggtcaccggcatcgccgaagccgtgttcgcccgtggtctttcctccgaagctgatctgcgtgaggaagccgccaagcagggcttcaatggccctgacggcaacctgaacctcaccgacgatgagaagaaggccttcatcgaagacattcgtcaggcactctacgcttccaagatcgtcgcctacgcccagggcttcaacgagattaccactgctgccgaagaatatggctgggatatcgatctggctgccgtggcacgcatctggcgtggcggctgcatcatccgtgcgaagttcctcaaccgtatttccgaagcgttcgaatcaggtgaagccaacgtgtcgctgctgttcgctccgtacttcaagaacgccatcgaaaccgccgaaaagtcttggcgtaacgtggtggctcaggccgccgtcaacggtttgcctactccggcgttcgcttcctcgctgtcgtacttcgacggactgcgttccaagcgcctgcccgccgccctgatccagggtcagcgcgactatttcggcgctcacacctaccagcgtgtggatcagccgggcgcattccacacgctgtgggccgagccgggccgcgaggaaatcgaagcctgatagacgtatttctgcaacgaatctagcggattaacagatgaaaagagcctcacgctttatgaaaagtgtgcggctctttgtgttgcggcaaatatgatcagccgcaagggaaactcgttgagttgcctcctgaattattcgcgatgctggttgcgtgggttgccgccattcatgattgcggcgacccgtcgcgtcagagcgcgggggagtagtcgttccgctgcggctccggctttggtgaggtagccgtggtaggcaagcgtgcgcccctgcttcatcttccgatacgcgtaggtggcaagctggtaggcggtggccggtttggtcagcgtgaagaaattcatgccacgcatgttcgcggccttggcgaaccctgtggatgtcggcccggggcatacgcaggtcacactcacaccggtatctcgcaattcgtacgacaccgcttccgaaagcgatcgtacgaacgctttcgacgcgaaatatatcgccatatatgggcctgccatcattgaagcaacagaagagatgttcaatatgcgtccgtgaccctgctcgcgcatatcacgaccataacggtacgtaagttcagccaacgcggccatgttgagctgcatcatctcatgctggcgatgccagtcggcgtcgagaaaacccgtccaatccgcaaaaccggcgttattgacgagatgatccacttcaaaaccttgcgaaactgtgtaatcatgcaactgttgcggtgcgtcagactcgcttagatcaagcgcaaccgtctccacatgcacgccatagcgatgttccagcgtgcgcttcacgtcatcaagtttgccttgactgcgtgccgtaatgatgagatcatgcctgtcggccgcaaacaatgccgccatctcacgcccaatgccactcgaagcccccgttatcaacgcatatgccataaaaccacctttcttaagtattgatgttcatggtagtcaatacgcatgcaataacgccatttgcaacgcaatggtccggaacttttcgactgggctggctgattgacagttttcatgcacttctcgcatggaaagtaatacatcatttacattagttattttggtttggttcgttcacaatgggtgcgtcagcatgaatgtgaaagaaccagtatggaatgtccgaaaggccatgtttttgaactcatacaacagggctgcccgaccgacaaagtcattacaatgcatgtcgtgaaaccgggatcattcacagcttgcatttgacttcgtccacttgaagttcttaagtttgatggcatgacttacgatttcgacactcccgtagaccgatccggcacgtattcgctcaagtgggaagaggcaggagatgcgttgcccatgtgggtggcggatatggaatttcaaaccgctccacagattcgagccgcactgcaacagcgtcttgaccacggtattttcggatattccatcgtccctcctgcatggaatcaggcatacgttgactggtggcaccgtaggcataatcttgatatcgacccggaatcgctcgtattcagcaccggcgtggtgccggcaatctccagcatggtacgaaaactcaccacagcaaacgaaaacgtgcttatccaaactccggtctacaacattttcttcaattcgattatcaataatggatgccgcgtgcttgaatcaccgttggaatacgacggttccggacattactccatcaactgggccgatctggaatccaagttggccgatccgcaaaccacgctgatgatcctgtgcaatccacacaatcccgtaggccgaatctgggatcgcgacaccctcgcacgcataggtgagctttgctggaaccatcatgtgaccgtaatcagcgacgaaattcattgtgatcttaccgatccgggatatgattacgtgccctttgcctcggtgaatgagcagtgcgcaatgaactccgtgacctgcatggcaccgaccaaaacgttcaatatcgccggtcttaacacggctgccgtaatgattccaaatcccgtgctgaggcataaggtatggcgtgcgctcaacacggacgaagtggccgaaccgaacgccttcgccatgacggccacgctcgctgccttcaacgagagcgagccttggcttgaggaattgcgcgcatacttggcaggcaacaaagccgaagcacgagccatgatcaacgaatacaatgctgccgcggcaccggaacgacgcatcgccctgattgaaagccatgccacctacttgttgtgggtcgattgttcgaaactgacgcacgataccgctctgttgtgcgaacatctcaagcgcaatcatcaggtgatgttctccgaaggtgccgagtatggcggcaacgggcatgatttcattcgcatcaacgtggcttgcccgcgaagcaccatgcaagaaggattcaatcgtctgttcgccgggttgcatgatttttcggcagagtaatacattgatcatcgattgtgatattgctcacagccgctaaaaaacggctggttttgtgggttttcacaaaatatggaaaggacgttttcggatggtcactgccgtccgtgacgtgttggcgatactatgaagcacatgactgaaactgtttcatccgtacttggcacgcctgaagagtggacgaatccgctgcgcgatccgcgcgatcttcgacttccacgtattgcaggcccgtgcagtattgtgattttcggcgtgaccggcgatctgtcacgcaagaagctgcttcccgccatttatgatctggctaatcgtggcctattgccgccaagcttcggtttgacgggttttgcacgtcgtgattggaccgaggatcatttcaaggatttcgtgaaggagaacgtgcaggcgcactgccgcacgccatttaaggaggcgacctggaagcagctcgccgacggtattcgttttgtgcagggcacgttcgatgatccgaaggcgttcgaacgattgtcgaacactgttgccgagcttgaccgtgatcgtggcacgcgaggtaaccatgcgttctacatgtcggtgccgccgcgcgcgttcccgcaggtttcccgacagttggcggattgcggtctggcgaagtccgacaagggcgcttggcgtcgtgtgatcatcgagaaaccgttcgggcatgatctggccagcgctaaggagctggatcgtgtggtttccgaggtgttcgacccatcgagtgtgttccgtatcgatcattatctcggtaaggagacggtgcagaatattctggcgcttcgtttcgcgaacgccatgtatgagccgatttggaacaataattacgtcgaccatgtgcagattacccacgccgaggatatcggcgtggccggtcgtgccggatactatgacggcatcggtgccgcacgcgacatcatccagaaccacctgctgcagctcatggcattgacggccatggaggagccggtctccttctccgccgctgatctgacggctgaaaagacgaaggtgctgtccgcagtgcgcttgccgaaggatctggcggcgcatacggcccgcggacagtatgccgccggatggcagggttctcatgaggttgtcggctatttggatgagaagggcattaatccggcttcaaccacagagacttacgcagcgatccgactggatgtcgatacgcgccgttgggccggcgtgccgttctacctgcgtacgggcaaacgtttgggcaagcgtgtcacggagattgccgtggtgttcaagcgtgccccgcatctgccgttcgagtcgaccgcaacgaaggagctcggcaagaatgcgatcgtgatccgcgtgcagcccgatgagggtgtgaccatgcggttcggcgcgaaggtgccgggtggcacgtcgatggaggtccgtgacgtgtcgatggacttcggttacggccgttcgttcaccgaatcgtctccggaagcctatgaacgtctgattcttgacgtattgctgggcgatccgccactgttcccaaccacacgcgaagtggaattgagctggcagatcctcgatccgatcgaggagttctggtccacgcttggccagccgcagccgtatcgttccggaacgtggggccctcaggaagccgttgaaatgctggcccgcgatggacaccgttggaggatgccgtgatcattaccatgaagaacaccgaaacccgtgagatttcggcgaaaatcgatgaattgcacgaggagcgtggcgaagcggctctgggtcgcgtgctcacactgctgatctccacgaatgagacgtcgctggagcatgatctcgccgtggcgaacaacgccagccgtgagcatccctgccgtgtgatcgcaatcgcgccgaattcacgtagggtggatgccgctgccgatgatggcaagccgcacacctttctcgacgcggaagtgcgattcggttccgacgctggcgcgggcgaaatcatcgtgttgcgtccgattggtgggctggttcaccaccctgatacattggtgattccgctattggtgccggacgctccggtggtggcttggtggccgaacgaagctccggcgaatctgtcaaacgatttgctgggttccatggcgcgcagccgtatcaccgatgccatgcattcctcgaatccgatgcggaccatggatgatctgcgccgcaactggtcgtcgaagaatgtggacatgtcgtggactcgcttgactgtttggcgcgcaatgctcgcttcgatgcttgaccagccgccgcatcttccagtaagcggcgtgcgtgtgaccggaccaaagaacttcctgccgttgaatctgctggccgcatggcttcgtcttcgtctgaacgtgcctgttgtggtggaagacgatccgaatgcaaccgccgtgaccggcgtgtatctgacccgttccgatggcgtgctgagtttggaacgcccatccaccgacgatggcatcgccgtattgaacgttccagggcagtccccgcaaaccatgagcgttcccgcacgaaccatcgaggaatgcttgagtgaggaattgggtcgactctatccggacgagatctatgcggaagtcgtgactcaaggctgggatcttatcaattcgaagcactgaatcgattctccgaaacaataaaggaacaatgcaggaaaagcatatggcagaacgcaccaccgttgtatatcccaatcctcagattctggctgaagccgtggccgcacgtacgctgttgaccatcaccgatcttctgtcggaaccgaatcgcactcgcgttgacattgccgtgaccggtggaaccgacggcaatcgagtgttcgacgccatggacgcgagcccattgaacgatgccgtggactggagccgcgtgcacgtatggtggggcgacgaacgattcgtggccgccgatgacgatgatcgcaacgccaagcaggcgcgtgaggcatggtatggcaaactggttgccgacggccgtatgccggcaggcaacattcatgcgatgccgtccgatgagcgtaacttggaaagcgtcgcggcagcctcacccgaacagactgatgcggtgctggctgaagccgccgcgcaataccagcgtgaactcattgaacagttgggtgagaatccagctttggacatcgccatgttcggtatgggaccagacgcgcatttcgcatccctgttccccgaccatggcgagtcggagatcgacgatccgcatgtgcttgtcgccggtgtgcgcgattcaccgaagccgccgccactgcgcctgacgctgaccgtgccgatgatcgcacgatcgaagcacacgtgggtgttcacatctgaagtacgcaaggcggatgcggttgctgcagcattcgcgcaacgcaacaatccgcatgcgccaagctcctacgccgatggtgaggaactgctctggcttatcgacgagggtgccgcctccaaaatatgaaaatagggagtaggcattgcagcgcgcctcgaggcatatgatcattggcagtccctgcaaatcctctgcatgaatcgtcttacgttcagccaacgcatcgtctgcacgcatcagcaatctcatgaggtcgcaacacggtagtgcaaatgatcataacggctcatatccgcaggctgcatgagcacgccagaattggcaggaccatgatggttcatgcatggtcgagcaagtcgattatggcgccgtgtgcagcacattgctggcactcaaaaccttggcattagtgttggactcctaatttaatgtttggtaagcctacgtggacttggaataacgcagattatagctataggttcatgaaaaacacctattttaaggcttttgattcgccatggatggatgttggtggtctaatttatgtggattggaatggtgcggatactgacaacgcaaagaatcgcgctattcgcacggtaaggtggggttatgaaagtagtagtgcaacgagtgagtcaagccagcgttgacgttgtcaacgaactgggcaccatcgaccccaccttcgaaccgcagcagatcggaccgggcttcatgctgctggtcggcgtgagtgatgaggatggcgaggaacagctttcttggctggcccacaaaatcctcaacctgcgcgttttcgaagacgaacagggcaaaatgaaccgttccatcaaagacatcggcggcgaaatcctctccatttcgcagtttacgctgtttgccgacgtgaggaaaggcaaccgccccagcttcgtcaaagcaggtaaaccggaacatgccagcatcacgtggatcaaattcaacgaggcgctgcgttctggcggcgtgccagtacgcgaaggccgctttggaacgcacatgcgcgtcggcctgatcaacgatggtccggtcaccatcaccatcgacaccgacaatctgtgatcagtatttgattacaacaccgattgttgggtgatataaaacaattgagggtctgcaagttaaattgcagaccctcaactattataaatactttttgatcgacggtgacgtttacttgttttcggtaattatcgtcaccttgttcggatcaatcttcgttgggtcaagagtcaattccttgatgacagccgcacgaatcgtgccggacgaaggattgaatacactatcgatagtgctgtgaatatcggcatccacattcgaatattcgaaagcaagcgtcgtattgattagacggcaattacgtaatacgagattatccacatagcacaaaccctgcagactttcgatcgtacagttctcaaacgtgacattacgggaattccaagccaaatactcgccggaaatgaatgaatcacgtactgtcacattctcgcaattccagaagcaatccttggaaatcaatcgagaatttgtgatttcaatattacgtgcgccatcaaatggataattgccaaccaaacgcagattataggctttaatatcggaacaattcatcgccagataatcgccacgagcgctcacattttccagtgaaacgttcgaacaagcccataatgtttcctcggcattgacgaaatcaacattcctcaacgcaacatcatggcaccggcggaaattcttcggcgcttcaaacgtgcaatcctcaacacgaatggtattcgtataccacacgcccgcgcgtgccatctcgaaccatgtgcaatcctttgccaaaatatccgagcaataccacagcggatacttccatttgaacgaactcgacttaagctcaatatcatgcgcatgcttcaacggtgattcgccatcatcgaaaatcgtgtcgatatatcgcttgcctgatgcttggaattcggcgcgttcgccggtcagtaacgcctgacgaacctcgtgcatgtcactcactgataactctccttgaaaacgttctgttgccaagatagaaagttcaagtacttgaagtcaaacgcatgcccatgtttcgctggcgggcgaagcggatgagcgatggaacgcgttataagcaatgtcgatatgcgtgcgggtgtttgcgaaacatgactgtcggtaccatgaattgaacgattagacaattgggtggttacaaggcattgtggtcgcgaacgggcttgccacgtatggcagggaggaatgcggatgagccagcggaatgggggagtgaagacgcgtgcgttcaaagccgcgttccccagagtgctgccgatttgcatcagcttcttctttctggccatgtcgtacggagtgcttatgggaacccgcgggttttcgttcctgtggccgttgtgcatgagcgcattcatctacaccggttccatggaattcgttacggtgaatctgctggtttccgcattcaatccgttcgccacgcttatgttggcgctgatgatgggaacaaggcacctgttttacggactgtccatgctggggcgtttcaagaacatgggggcgaaaaaaccgtatttgatttacgccatgtgtgatgagacgttcgcggtcaacaacggcgcgcaaataccggcggatgttgaccgcggctggttctatttcttcgtgtcgctgctgaatcaggtttcctgggtggctggagcgacgctcggaggcattgtcggcgggcgattgacgttcgacaccaccggtttggatttcgtgatgaccgcattgtttgtggttattttcgtggatcaatggttgacaacgaaacgcaaaagccatatggcggcgttgacgggcactgtggtgccggtgatttgcatggcgctgttcggtgctgacaatttcatgatcccgtcgttgattgccatgctggtgatgttcattatgttgcgtccgtatttggatgatttgaaacctgatgatgttgggaaacgtgatgatgctgatggtggtcgaatccgctgcggatcgtaacgaagtaggggaggtgcggtcatgatcatgaccacatggcagggcgtcgtcactgtactgatggcggtgcttggcaccatcatcacccgttttctgccgttcgtgctctttcccgagccaaagaaaccgccgcacatcatcgactatcttggcaacgtgcttccgtatgctatgaccggactgctggtggtgtattcgctgaaaaacgtcaatccttttgctggaagccacggcattcccgaagcgatcgccatcgccgcgatcgtcgtgctgcacgtatggaaacgcaacatgctgctctcgatcgccggcggcatcgtcgtgtatatggcattacttcagcttgtttttgcatgattgtctgttttgtaggattgcccaaatctgaagtgagttttatagggattttccacagttgttattgctgatatcccatatcgtgagaagaaatgcgttgatgcgattgacgcgcctactctttttctttagccaataaggagctgtgttgagcggctctggctgtatagaagagttatatctaacgagagagaacaatatgactagtgcagcaagcactgccaatgccgcggttccagcgcccggcaaactggagttcaaggatgattacacgcctgaggaagcggaacgcgtcatccgcaattcgaaggggctccctgtcggtgtgaagccgaagatggtgtggacgtggccgaaggccctgctgtgggccgtcatcgccattgtgtgcgctattggttgggctattctggcggtttcccgtggcgagcagatcagcgccatctggttcgtggttgtggcattgtgctcctacgcgatcgcttaccgtttctacgcgtattatattcagatcaagatcatgcgtaccgacgatgcgaacgcgacgccggccgagcgcgtgcatgacggcgccaacttcgaacgtgccgaccgtcgcgtgctgttcggccagcatttcgccggcatttccggtgcgggcccgcttgttggtcctattctggccgcccaaatgggttatctgccgtccgtgatgtggatcattctcggtgtgattttcgccggcgccgtgcaggatatgctcatgctgtggatctccgccaagcgtcgcggccgttccttcggtcagatggcaaccgacgaaatgggcaagttcggcggcactatcctgtcgatcttcctgatcgtgatgaccgccatcgccatggcattccttgcgctcgtggccatcaaggccatggcttcctcgccgtgggccgtgttctctattggtatgaccattccgatcgccttgatcatgggctgcttccagcgtttcctgcatcgtagcgttatcgaaaccacggtgctcggcttcgtgctgctcgtgatcgacatcatcgctggcggttggatctccagcgttccggcaatcgccgacgtgttcacgttgaacgccaaggaactggttatcgcactggtgatctactccttcgccgccgccgcgttgccgcactggctgctcgtcaccccgcgtgactacctgtccacgctgatgaagatcggcacgcttgtgctgctcgtgcttggcattctcatcgccaatccgtccgtgcagatgccggctctgactgaattcgcgtccacctccacgggaccgaccttcgcaggtaacctgttcccgttcctgttcatcaccatcgcgtgcggcgctctttccggcttccacggcgcagtgagctccggcctgaccccgaaggctgtggagaaggaaaaccagatccgcatgatcggctacggctccatgctggttgaatccttcaccgccgtgatcgcactgattgcagccatcaccatttcccagggcgtctacttctccacgaacatgtccgcctcgcagatctccaccgcttccggcgtgaccctgaccgccacttccactcctgacgagcaggctgaggccgcggtcaaggccgtggattcgatgaaggtttccgacattgaaggcaaccagatgaaggtcacttgggattctgtcgacgagaacggcaatgccaagacctacgaaggcgccgacgctttgaagcaggccgcttccgacattggcgagaacaccatcgtttcccgcactggcggcgccaccacgttcgctatgggtatggccaacttcctcaagtcctacctcggcggtcatgactccatggccttctggtaccacttcgccatcatgttcgaagcgttgttcatcctcaccaccgttgacaacggcacccgcgtggcccgttatcagattggtgagttgctgggcaacgtgcgcaagctgaagaagttcgctgatccgacgtggaaaccgggcaacatcatcaccacactgatcgcaaccgccctgtggggtggcctgctgtgggtcggcgtgtgcgatacgaatggtggtatcaacgccatgatgcctattttcggtatttccaaccagctgcttgccgccgcatgcttcatgctggtcaccgtttgcgtggccaagcttggctataagaagtacctgtggattcctgttgttcctctcgtttgggatgtggccgtgaccttcaccgccgacttccagaagatcgtcggaccgatcagttacttcgccaccgcttccaagtatcagacgctgatcgatggtggcactttggaaggcgaagcgttggtcaacgccaaggccgcactctccaatgcgtaccttgacggcgtgctctccgtgttcttcatggtcatgatgggaatcttcctggtcgtcggcatctaccagaccgtgaagattcttgccaagggcaagttcggtgtggaaaccacgtctgaggagccgttcgtggaatccgaatggttcgcaccgtccagcctgatcgccaccaagctcgaaaagaaggtgcagcgcgaatacgcggccaagagctatgagctggcgcagaaggaacaggccgcagcctgatgcagggattcaccaccatggtcagacgaatctggtccgcattattgaaagccaaggccggattcgtctggtatgtgcgcgaattcagcggagaagcgaaatacgaccactatctggagcatttcgcaagcgaacatccctgcgaaaccccgctgaccgaacgcgaatactggcgcatgcgagaggaatacgatcgcaagcatcccaacaccagttgctgttgctgaaactaacggccatacataaacaatccccgtctttcatttcggaagacggggattgttgttcttatatttatgttgcttgcttgcgattattcctataccgaagatattcgattgcatgttccgcaatcaatatttcgcaatcaagaagcgagtcccatgctgtatttcaatgtcatcacacgaatcgcggactgcgttactttgtctgcaaaagcggaatcagccgcggcttttgcgttcaaaccatccaaaacctgctgaacataatcgaaagcgccaatgcaggcaagatcaccgccggcctcaaccaatcgcacacccaaatcactcggctgaatgccacccaacgcagtggcggacaaagaatccgaagtgatgacaccttggaatccgaccgtattgcgcaaataatccgttaccaaagcgctggagaacacggcgggattattcggatcaatagcctgataggtggcaagcgacatcatcaccatggaagggttcgcctccaacgtactgttgaacgcgccgatttccgcaccgtccaacgtagtggtggtatcaagaatgccgtcggcggtgaaatcggtgttgcccgtcaccgaacccaaaccaggatagtgcttgatggcgctgcctacacccgaatccgccatgccctgaatgaacgccttggcatggtcggcattgccgtccgcatcaagaccaaaatcacgatacagtgcgccgatcgggccattggaagccctatctaccgttaccgtgcccaccaccggcgccaaatcaacattgatgccggccgacttgagttgggaaccccatacggcagccgattgccgtagctggttggtcgacattgaaccctgattggtggcggaaggcatctggtcgaaaccagcgccttgaagatgctgcaccaaaccaccttcctgatcagtggtcatcaacagctgattattggccggcgcatacgattgcaatgcggatgtggctgcggcgacgccagccgttcccgaattccaattgccgatgatcaacaccgatccgacatgctggttcacgataagatcctgcaatgtcgaaggatcggatcccgcatacaggggtgccatgacgagctgaccgacgcgctctgcaagactcatggcattgactgcagccacggctctgccatgcggcgagtcgtccaccacgcttggcacgttggatttgtcaagcgcatcatgtgatgcatcggactgctgcgaattggattgctcggattggttggagccagcattcaaactcgcgctggatgaacacccagcgaacgatagcggcagtgcgatggcgcacagtgcggcagcacaacgagcgaaatgaacgtgaactctcctcatagtgtcattatctatcacatgccggtgatggcgaatacgatcgcataagaaaagaacgggtggattcgtgttcgtgaattgcgtaaacattaggctagcggcataaagccgttccgtgcctgtcgataggctattagtatgtctttttttgatatgtttggtcccatgttcgacccagaaagcggtccgaaccgctcccaagggcagcgtgccaataaatccggcaacgatgatcccatcattctcaatgtcgaaaccgatggtgataacaccgcccggtcttcggcgaacatgcctccaagaggtccgtccggtccgcgtatcacacgccagccgaaccgtccgcgcaaatcgtcgaacggcaacaagattctaatcggtgtggtgctggcgcttgccatcatcatcggcctgttctttggcttggcgcagttcatcaccgacgtcatgtggtatgcgcagcttggcttccaaagcgtgatttggacgcagttgggtaccagggtaggcctgtgggtggcgtatgcgctgctgatcgccgcggtcggattcctgtccgcgtcgctggcgatctgggctcgccccgatgctgccgatggttccacgattcgtattaacggcgacaccatcgaagtgggcaagggcgtgagctcaaagagtgcacgtcgtgtggctgtggtgatttcattgatcgtcggcttgatgttcggatcgcagtttaatgcgaattggtctgaaatcctgctgatgttcaacgcgcagagtttcggcaccaccgacccgcaattcggcatcgacaatggtttctatgtgttcgtattgcctggcttgaagctgatcatgtcggcagtgtcgttgctgctgcttgccggcatcatcttctccatcgtcacgcatgtgatgatgggcggcatccgaatcaccatgccagtgcatggtcgtggactgttccacatcaccaagcgtgcgcgtagacagatcggcatctggctgatgctcaacatgttcgcatgggcgacgaatcaggtgcttggcgtgttctcccacctcacgcaggagggtagccgcatcaccggtgccacgtataccacggtcaacgccacgattcccgtcaccttcatcatggctgccatcaccgtcattctcggtgtgattctcggcgtgtggatcatgaagtcgcatgcgttggaaggccaggctccgattgcggtgcgtgcttccgaagcgcttaaagcgtggaaggtgccgaccgtggccatcgcatccgccattgtggtgagcttggtgcttaccgtggcatggccgatgctgctgcagcgtttccgtgtgaatccgaacgcgcaggaaatggaatctacctatatccagcgtaatatcgacgccacccgtgaagcatacggtctgaacaatgtgaagaccgaacagtatcaggccactacggaaggcgaggctggtgcgttggctgattccgcggaatcgaccgcgcagatccgactgctcgatccgcagatcgtttccccgacattcaagcagctgcagcaatccaagcagtattacacgtttgccgatactcttgccgtcgacaagtatgaggtcgacggtgtgagccaagatacggtgatcgcagcacgagaacttgaccttgccggtcttgacaatcgtaactgggtcaacgaccataccgtatacacgcacggctatggtgtggtggccgcctacggcaacaaggtgacggccgacggccagccgaagttctttgaggcgggtattccaacccaaggcaagctcaccgaatccgaacagtacgagccgcgtatctacttctcgccgaacgcttccgaatattcgatcgtgggcgctccggaaggtacgcagtcttgggagttcgattacccgaccggttccgaaggcgccaccaacacgttcggtggcaatggcggcccgaagatcggtaatatcttctcccgactgctgtatgccatccgtttcggctccgaccagattctgttctctaaccgtgtgaactccgaatcgcagatcctctacgatcgttccccgaaggagcgtgtggccaaggtcgcgccatacctgacgcttgacggccgtgtgtacccggcggtcgtggatggtcgtgtcaagtggatcgtcgatggctacaccacgtctgacgcctacccgtattcgcagatgaccgatctgggcgaagcctccaaggattccactacggaatcttcggccacggtgagtgagctggcttcgaagaacgccaactacattcgcaactccgtgaaggccaccgtcgatgcgtatgacggttccgtggacctgtacgtgtgggacgaatccgatccggtgatcaaggcatggcagaagatcttccccggccagtaccaccagttgtcggagatttccggcgatctgatgagccacctgcgttacccggaaagcctgttcaaggtgcagcgagaactgttgaccaagtaccatgtgtcgagcgccagccagttcttctccggtgaggatttctggcagactccggtcgatccgaccgaatcccagcaggctcaggaacgcgacattctgcagccgccgtactatttgacgctgcagaccggtggatccaacgaaccggtgttctcgttgacgtcgtcgtatattcccgcaggcacgtcaactcgagagattttgacgggattcctgtctgtcgattccgatgcgggccacgaaaaaggcaagatcggcgcgaactatggcacgcttcgattgcaggagttgccgaaggattccaatgtgccaggccccggtcaggcacagaacaacttcaatgcgtcggccgacgtgtcgaaggaacttaatttgcttgaatccggttccaccaatgtgcagcgaggcaatctgcttacactgccgctcggcggcggattggtgtacgtgcagccggtgtacgtcaagtcttccggttccaccagtttcccgctgttgaagaaggtgttggtggccttcggcgaccaggtcggattcgccaacacgttggacgaagcgctcgatcaggtgttcggcggcaactccggtgcatccgctggcgatgctgaaaacgtcgacggctcgaccagtggcaagactgatacgtccgataccaacggcgatgcctccaccgatggttcttccggaaccgatggcacggattcgtcatctggaacagactcgggcaatgacagcagttccggcaataccggtagtagctccggcacgatgagcaacggtctgaagagcgcgcttaacgacgcttcccaggcaatgaaggattccgacgcggccatgaagaagggcgattggtccgcttatggcgaggcgcagaagaaacttcaggaagcgttgaacaaggcgctcgaactcgagcagtagtttccgcacaagttccgtacgattgctgtttgcataaggcgggagactggttccatatggggaaccggtcttccgccttctgcatatgcccggtatgctcaaaaacatgatcgagtattcctaccgcatcgcgacgcaagacgacattcaagcaatcaccgacatttacaacgctgcagtcatacgaggtggatcatcggccgatataactccacgcacatacgaacagcgcaaagcatgggttgaatcgcatcatgatccgtatgcggtgttcgttacggaaacggtagatgatgacggagagaggcggatcattggattcagcgcgctttccgttttctacgatcgcgcaggatacgacggcgtcaccgatctcgcctattatatcgatccgcaatggcagggcaggggagtcggtacatacacactcaccaaactggttgaagaatgtcgaaagcgtaatatgcgtaaggcatgcggcattattttcgcagacaatgccggttcgatcgcactgatgaaacggttcggttttacacagtttggcctcatgccaactgctgccaccgattccaccggcaccatgcgtgacatgagttactggtatctcgacctgtaagtacaatctttgcggttatcaagacgagacaatgtgacgcaatatgaacgcgcacaaacgtatgtatgaatgaatggaacgatttcaatggcatctgatttctggttgatcgcaggacttggcaatccgggatccaaatacgaaggcacccgtcacaatatgggatttatggcggccgatctgttggccgaacgttggtcggtcaacttttccgaccataaagggcttgccatgctcggcaaaggcgtgatgaacctgtctggccgtaacgtcaaattcttcctggcaaagccgctcacctacatgaacgagtcaggtaatgcgttggcttccatcagtgcctactatcagattgaaccagaccatattgtggtgattcacgacgacatggatcttgatttcggacgtatcaaagtcaaggcaggcggctccgcaggcggccataacggcatcaaatcaattgatcgtgccttgggaacgccaaagtatgcccgagtgcgcatgggagtcggtcatgcgcaacgcggcgcccacgcccacgacaacacggtgaattgggtgctgggcggattcggtccggatcagcgcaagcagcttccggaattccttgccgacggtgccgacgcggcggaaaccatcatcttcaacggcctcgccaaggctcaggagcagttcaatggccgctgaaccggtgcaactgccgacgtcaggttcgctggctggcattctcgacgtactcgaaactgatgaggattttcgtgcgctgatttccgatgagatcgaagtgccggaatccgacatagaccccagcatcaccgttggcgttcccgaaggattgcgtccggcgctcgctgccggggcagcgggaacacgaccggttgtgcttgtggtggcttccgggcgcgaggccgaggaaatggttgaggcgattcgttcgtggtattccggcgatccaaacgatgtggcacagcttgaagcgtgggaaaccttgccgcacgaacgtctttcgcctcgcgccgataccgtggcgagccgtatggcggtgttccgcagactgatgcaccctcaagagggaagcaagctgtttggccccatcaggattctcgtcatgccggtgcgttccctgattcagcctgtggttgcgggcttgggggatgtggagccgctggtgttctcccaaggtgaggagttggcgctcgatgaggcgtcgcatcgactggtggagaatgcgtatactcgagtcgacttggtgatggatcgtggtgaattcgcagtgcgaggcggcattatcgacgtgtttcctccaacattgccgcatccggttcgtatcgaattcttcggtgacgaaatcgataccatcaaggaattccatgcatccgaccagcgtacgtatggcagtgacattccgatggtctgggccacgccatgccgtgagctgcagctgaccgaaaaggtgcgcgtgcgtgcgaaatccctgatcggctccattccaaacgccgaagacatgcttgaatccattgccaacgccattcctgtcgaaggcatggaatcgttgcttcccgcattagtcgatgatatggaaccggtgcagggcatgcttcccaagcgtgcgttggtgatgctgtccgatccggaaaaattgcgtcgcgctgccgacgatcttgccaaaacggctaatgaattccttgcagccagttggcatgttgctgcatccggtcatggtgccggtgctccaatcacattcgatcaggcgaatttctacgattttgaggaaacgatttcctcactggtgttctctaggcatgacgtatggaagcttacgagtttcggtgtggactccagtagggaaggccgcgttcagctcgacgccaccaatcctggagaatatcgcggagatgaggccaagacagcttccggtatcgaaggtcttcttgatgccggctatgccgtcaccgtcactgcaggagcgcaaggcactcttgttcgactcaaacgtgccatcaacgaaacgggaatcgccaacttcgactgcatcagatcgcgtgccatcgacggattcgtcgataatgccgcgaaagtcgcactgcttaccgaacgcgacctgaccggacgtacatcggccgcgggacaggcaaaaacaccgaaacgtcgccgtaaggccatcgaccttatggagctcaaagccggcgattacgtggtgcatgagcagcatggcatcggcaggttcctcgaaatgcgccagcgtaccatcggagcgggcgccaaccagaccacacgcgagtatctggtcatcgaatacgcatccagcaagcgcggcgcacctgccgacaaactgttcatccccaccgaccagcttgaccaagtcagcaaatacatcggtgccgacgctccaaaactcaacaaactgggcggatccgactgggctgccaccaaggcgaaagcacgtaagcatgtgcacgaaatcgccgaagatctggtcaaactgtattcggcacgtcaacgtatgcaggggtatgccttcagcaaagacaccccttggcagaaagaactggaagacgctttcccgtaccaagaaaccgctgatcagctgaccaccatcgacgaagtcaaatccgatatggaaaagcccgtgccgatggatcgcctgatttgcggcgacgtgggattcggcaaaaccgaaatcgccgtacgtgccgcattcaaggcggtgcaggattccaaacaggtggctgtgctggtgccgaccacattgctggtgcaacagcatttcgagacgttcaccgaacgttttgaaggttttccggtggaagtaagggcgatgagccgtttccaaaccaccaaggagatcaacgacaccatcgagggacttgaagacggttccgtcgatgtggtgatcggtacgcacaaactgctcggaccgaaggtcaaattcaaggatctgggactggtcatcatcgatgaggagcagcgtttcggcgtcgaacacaaagagacgttgaaggcgctgcgtaccaatgtggatgtgctgagtctgtcggcaacaccgattccgcgaacgctggagatggccgttacaggcattcgtgaaatgtccacgttggccacgcctccggaagaccgcttgccggtgcttacctacgttggcgcgtatgaggatgctcaggtcactgctgcggtcagacgtgagctgttgcgcggtggccaggtgttctacgtgcacaaccgagtgcaagacatcgcttcggttgccgcgaagattcacgagctggtgccggaatcgcatgtcggcatcgcccatggcaagatgggggagaagcagcttgacggtgtgatccgagacttctggcatcgcgacattgatgtgctcgtatgcaccaccatcatcgaaaccggtcttgatatttccaatgcgaatacgttgatcgtcgatcatgccgaccgtttcggcctaagccagcttcatcagttgcgtggtcgtgtcgggcgaggccgtgagcgtgcctacgcgtacttcctatatgatccaaccaagccgatgacccagcagtcgcatgaccgactggccaccatcgcgcagaacactgcgctcggttcaggttttgacgtggcgatgaaggatcttgagctgcgtggcaccggcaatctgctgggcgacgagcagagcgggcatatcgagggtgttggtttcgatctgtatgtgcgcatggtgtccgaggccgtcgagcagtacaaggaaccggaacgtacggaatcggttgctgtcaccatcgatctgccgatcgaagcgtccattcccgtcagctacatcgattccgacaaattgcgattggaagcctaccgcaagttggcgggtgctcgtacggaagccgatcttgacgagttgcgtgatgagcttacggatcgttacggcaagcctccggtcgatttcgaggcgctgttcgatgtggcgagacttcggttcaaggcaaggaagttgggcattaccgaaatcatcgggcaaggccgtaacgttcgtgtcgccaaattcgagccgcgagaatccgtgcaaatgcgcatggccagaatctacaagggcattcaataccgtccgatgactaaaacatacctgattcccgcgccgttcgcaggttcgctgggatctggtccaatgagctctgatgaaatcgttggttggacgaaccaattgctggatgaccttgactggaagccaacgccaaagaaatagcaggtgaagttccagacgcatccgacacgatttgtgtgagcgttcacacaaatcgtgtcggataagtttgccatacgtccacaaaacgcactattctaggcaatgtcatcacaacctaacgtttataaggagtagttgtggcagtaattgaaagcgtttacgcgcgtcagattctcgattcccgcggcaacccgaccgttgaggtcgttctcgacaccgaagacggtgctcagggcctgggcctcgttccgtccggtgcttccaccggtgaagctgaggcttgggagcgtcgcgatggcgacaagtccgtgtatcagggcaagggtgttctcaatgccgtcaaggccgtgaacgaagagatcgctccgaaggtcatcggcatggatgcttccgaccagcgcgctctcgatgaggtcatgatcgagctcgacggcaccccgaacaagggtcgtctgggcgccaacgccatcctcggcgtgtccctggctgctctgtacgcctccgctgagtccgcgggccagccgctgtaccgctacatcggcggcaccaacggccacatcctgccggttccgaacatgaacatcatgaacggtggcgctcacgctgacttcgccaccgacattcaggagtacatgatctccccgtacggcttcgacacctacagcgaggctctgcgtgcaggcgttgaggtctaccacaccctgaagaacgtcctgaagaaggaaggcctggccactggcctcggcgacgagggtggcttcgctccgaagatgaagtccaacaaggactccctgaactacatcatggacgccatctccgccgccggctacgagccgggcaagcagatcggcatctccctcgacgtggcttcctccgagttctacaacaaggagaccggcaagtaccacttcgaaggcgacgatcgtgaagccggctacatgctcgacttctacgagaacctcatcaacgagtatccgatcgtctccattgaggatccgttccaggaagaaggctgggaagactgggctgccatcaccgccaagctcggcgatcgtctgcagttcgtcggcgacgacctgctggtcaccaacccggcacgtctggctaagggcatcgagctcggcgccgccaactccctgctggtcaagctgaaccagatcggtaccgtcaccgagaccctcgacgccatcgagctggccaccaagaacggcttcacctccatggtttcccaccgttccggcgagaccccggacaccaccatctccgacttggctgtggcaaagaacaccggccagatcaagaccggtgctccggctcgtggcgagcgtattgccaagtacaaccgcctgctcgagatcgaggaggagctcggctccaccgctcagtatgctggctacagcgctttcaaggcctgcaagaagtacatcgccaagtgagcgtaagcgcatcgaatatgcgctgatgtagagtgcccgtcgtgttcctcgtcgaacgcggcgggtattttcattgctatgagttcaaagtcacgcaagaaagcatccagaaggggcagcgctggccccatcgcgttctttgtggcggtatttatcgtggctttgggatccatccagctggcgtcgacgttccatacctatgcgctgaatatggctgaattgaatggcttgaagaagcaggaagctgcgctgatagcgcaaaagcaggaactggaaaacgacattgcgcgttgggatgacaaagcttacgttacggcgcaggcaagggatcgtctgggattcgtatttccaggagaacaggcgattcgtgtggaacatcccgaagcggtgaccggcgaaaccacagaagatgcaaaaaagacggatgaatcgcagaaaaccgtactgccttggtacaaggagatggcgtattcgttcaaacaagccgaccaatcggacgaagtgaaatcgaaatcgagggaaacgtccgaaagtacgtcaaccggtgaatcggatgcgaatggaacaagccaggaatccggtggccagcagcagacttcacaagacaacaaccaacagcaatcaggagatcagcaggagtgacacagggtatgacaatcagcgaacaggccaaaaccttggcgaagaaggttctcgaccagcctgccaccgagcatgatattgctgtggtcgagcgtcagctgggtcgttacccgcgtggcatggtggctgtcggagcacgttgcgtgtgcggcaggcctttggctgtggtcacgcgtccgctgctgccgggaggtgtgcctttccctaccacttgctatttgactggcccggaagcggtgaaagccatctcccacatcgaagccgaaggcaagatgaaggagtacaacgatcttttggctgaagatgacgatctgaaagccgcctacgagcgtgcgcacgaactgtatttggcgttccggcatgaaatcgccgttgctatggaagacagcgaagagcatatcgaaggcaccagtgccggcggcatgcctgttcgcatcaagtgtctgcacgccttgctggcgcaaacgctggtgatgggcgagggcgccaatccgatcggagacatggcattggaggcgattcgtcatgaattcgaccccaatgtatgccgttgcacggtggaaaacgaagactgaaccatattcagacagaaagaagaagcaatgaaatccgttactgttgccggcattgattgcggtacgaactcgattcgtctgaaggtctcccgagtcagcgaagacggcgttgaagatattgttccgcgtattcttcgtgtgattcgcctcggtcaggatgttgataagacgcatcgtttcgccgatgaggcattggaacgtgcctacgccgctgcccgcgaattcgccgaggtgctgaaaaagcatccggtggatggcattcgtttcgttgccacttcggccactcgtgatgctgagaaccgtgaggaattcgaagacactatcgagcagatcctcggcgtgcgtccggaagtcattcccggtacggaagaggctgatctaagcttccttggtgccacgagcgtggttcgtcgcgacgtcgaagctccgtatttggtggttgatttgggtggcggctctacggaattggtgcttggcggcgatggcgtaagccatccgaacacgcaggtgcaggccgcgttctccatgaacattggctcggtgcgtatgaccgaacgccacttgaagaacgatccgcctaccgaagcgcagattcaagaggccattgccgacatcgacgagcatatcgatgaagcgttcaaaacggttcctgcaggcaaaacccgcactatcatcggcgtgtctggcacagtgactaccatgaccgctctggccatgggattgaccgaatacgaccattccgcggtggatggtgccagctgctcgctggaagacgcttatgcggtcgataacaagttccttacgatgccgcgcgaagagcgcctgacctacaaaaccattcacccgggtcgtgttgacgtggtcggtggcggtgcactggtgtggaatcgtgtgctcgccaaagtcagcgaagcggcctatgccgaccatggtcagcatatcgactccttcatggccagcgaacacggtttgcttgatggcattgtgttggattacggcacgcgattgcttgccgaacgttaacgtggcataatgacttgggcgtcggcttgttcgatgccttgccgccatggcgaaactggtatacgcaaccgacttaaaatcggtctcttcggattgcgggttcgattcccgctggcggcaccgaatgacgttgtgaaatattgctggatagcacgtacgaaacaatccgttattacactggcggcattgataaccccaagtagccgactggaacggaaaaagtatgacgtcgaaagatatcaagccagtaatcgaacagcccgatacggaaattccgctgatgctctcccaagcgattatcgtcgcaggagttttggctgtgggcgaactggcttgttctccgctgtatttctcgttgttgaaggcgtcgttggcgttgatcccatgggctatggaagcggtgttcatggcagtggcgttcacgttcgttgtgggctttgcgctgctgtggtgcgccgaatcgttcacgctcaaaatgcgtgaacggttccgaccgttcgcatatgcgattgttggacttatcggttacggtgcgtggagcctgctggtgttctccgccaccatcaattccgtgcttgccatggtgggggagagtgtgctcaccaatggccagattggtgcgattgcgttgaatggcgcagcgcttggtttcgtcgccttcctgttcgccaagttacttgacgttaaactcggcaatcgtaaaaccacggccattatcatgctggtggtggaagttacggccgccatcattggtttgatcattatgattctcatgttccgtgcattgtatgcagcctgagcaaggcacctgagaagcaaggcgacgattggtatgttcagtattctcgaaatgttcaagataggcgttggaccaagttcctcacatactgttggtccgatggtggcggcatgcaaatttgtcgaatcgcttgaacatacgggaacgcttggccgtgtgagacgcgtgcgtacggtactgtatggatctcttgcgttgacgggtttggggcacggtaccgatcgcgcgactgtggcaggtctggaaggtaacatgccgcaaaccgtcgatacggaccatgtgaacatcattcgtcatgaatgcgagtcgagtggggaactgctgctggctggtaagcatcgcatcgatttcgactatgcgcatgatgtggtgatggacgtgtggcatcgcttggccgcgcaccctaatggcatgcgtttccaggcatttgaccagcagaacaatcttgttgacgaacaggtctggtattccatcggtggaggcttcgtacggcaaggcaatgccgaggatctgatgatcggcattcatgagcgtccgccgatcggaacgtctttcgccgatcagcagagtgattcctcacttgatgacggctcggatgtgccatatccattcacgtcatgcgacgatctcattgcattatgcgagaagcaacatatgagtatcgccgacattgtgtgggccaacgaaacggccatgcagtcggcggtgcaggttcgcagcgaactggataacgtgtggcgggtgatgcgtcgttgcgtacagcacggatgccatacgtcgcagaccgtgttgcccggcggtttgaatgcgccccgcagggcaccgaaaatgtatgcaaggcttgcctcgaacagtgatgtgcttgcgcgagacaagaaacgcgcggatgcggtgctcgaatcgtcggatgcggcatgggtggatttgttcgctttggcggtgtcggaggaaaacgccggcggtgggcgaatcgtcaccgcaccgaccaacggtgctgcaggaatcattccggcagtgcttcactattactggcatttcgttgaccatgcgaacgaagagggtgttattaccttcctgctcactgcaggcgcggtagggtacctgtttaaacgcaatgcctccatttccggtgcggaagtcggatgccagggagaagtcggtacggcatgttcgatggctgcggccggtttgtgcgcggtgatgggcggtactccacagcaagtggagaacgctgcggaaatcggcatcgagcataatctgggactgacctgtgatcccgtgggaggtttggtacagattccatgcatcgaacgcaacgccatggctgcgaacactgccatcaacgcggttcgtatggccatgctgggagatggaacgcatatcgtgaccctcgatcaggccattaaaaccatgaaagacacgggcgaagacatgatgtccaagtataaagaaacctcaaaaggtggtttggcggtcaatgtcgttgaatgctagcggtggttggtgctagtctaggtggcattgtgcttttcaaggaggttcaccatggcatctcaaatgcccgttgtcaatgttgagttcggcgatcgcccgaccatcgaattcccgtccgagaccgctccggcaggtctgaaggttgtggagctgctcgagggcaatggcccgatggttcgccgcggcgacaccgtcaccgttaactatcacggtgtggtctggggcaaagacaccccgttcgattccagcttcgaccgtcaccagccggccagcttcggcatcggtgtcggccaggtcatcaagggttgggaccagaccgttccggggcacaacgtcggttcccgcttggtggtatccattccgccggagtatggctatggttcccgtggcgttccgcaggccggcatcggcggcgaagacaccctggtgttcgtgatcgacatcatctccacccgctgaaactaagcggcatagagtaatttccaaggtcaaggaggcaacatggccgaagaaaaaacgcttctgctgacgcaggaagcttatgacaagatgaaggaagagctcgcttggcgcgaaggcgagtatcgcgacgaaatcctttccaaggtttccgcggcacgcgccgagggcgatttgagcgaaaacggcggctatcaggccgctcgtgaggctcagcgagtaaatcagggccgcatcgaggaactgaccgtcaagctgcgcaacgcgaagattctgaccgcgcccaaggccggcgaagtcggcgacggttctttggtgacgctggatgtcaacggacgtgaaatggtctacgtgcttggcacgcgtgacctgtccatcgccacggactacagcatcatcagcccggaatccccgatcggcgcggccatcaacggcgctcacgagggagacacggtgtcgtatacggctccgaacggacgtgagatttccgtgaccatcaaggaagccaagccgctcgcctgagtgatgttcgtcataagctgaatctgatattccagcgatataaatacaaggctggttcatcgaatacaacggatgaaccagccttttcgtatatttcgtcaaactgcaatcagatatgatctgaacttacgtccatagctgcacgatcaccatgtagatcgccaccatatggcatgcgtaaccggcgacggtgccgcagtggaaaatctcatggaagccgaacaccttcggccatggatcgggcttacgtagcgcgtatacgatggctccggcgatatagcaggctccgcctgcggccaacagcaccacaaccgccggaccggcatatggcgaaatccagaacaatcccatgaatgccactccggaaacaccgaaaataatatacacaatcacgtaaagccagcgtggggcgctgatccagatgacgtgaatgatgagcgccacggtagtgcagatccacatgcccgcgatgattgaattgcgccagaacggttcgagtgcaaaggagaccggcgtataagtgcctgcgatcagcaggaagatattcatatggtcgatgcgtcgtagcacatccgtgacgcgaggtgaccaatcgcccaaatggtagcaggcggaattgccgaacaataccagcgaacacgtcatgaacacggcgcaggcccacttcaaaccggtaccgtgtgccaggcagatcagcacgatgccggccgccaatgccagaggagtggccacggcatgaatccagccgcgcatcgccggcttggggcgaccgtgcacgtcaagacgaatcttacgttcgatctccgccggagtgatgccttctattttcgcggcacgagcttcgcccttggctatagccattttcgccttgccgtcggccttcttgcggatgttctcggccttgttgcgtgccttcacgcgaataatatcggccttggcttgaagggcctgttcgcgtgcctcggcgatgatcgctcgtttttcctcgatctctacgtctgtgggtttcgccatctgtgtgcctccactgtaagttacggaaccgtaacctacgttaccgtaactcatggatatgtcaatattgcttttcctgcaatatgcgtcgtgtcgtgcaaaacctctggtgtgatgcgtatgatggagcgcatggctgatttctcacatatcttgacgacccgtcccgatttcgatgacgaagatcgtgaatggctgcatcatctggtcgccgactggcaggtgatcgccgacctgagttttgctgatctgctgctcattctgcaaaatggcgagggcaaatacattattgccgaacagtgtcgtccatccacggtgatgagcctgagggccgacgatgtggtcggcgacgttgtcgaggaggaaatgagcgctgaattggatgccgcgatggcttccgaatcggtgttccgttccacggtgctccgcactgtgggcgagtccacggtgtgcaatgtgtacgcgccggtgcgtcataatggcaagacgctgggcttggtggtacgtgagacgaatatggccacccgggagtcgaacggacgttacgaatccgaaagcatcagcgcaggtaagcagctgtatgagatgattcctcgcggtcagttcccatatcgtaatccgattatgaaccagcgtcacaatgcgcgtgtggcggacggcttcatcgtgctcaccgtcgaaggtatcgtgcgatatgcttcgccgaatgccatcagctgcttccgacgtttgggatcggtcagcaccatgcagggggagtatctgagcgaaatcggcaccaaattgctgcgcgagaacgatcccgtgctggaaaccttgcctctggtgctcagtggcaaagccgccgtcgattccgaactcgatgccaacaagtccgcggtgtccatgcgttcgctgccgttgatggatgccaatggccgcgttggcgctgttgtgctatgtcgcgacgtgactgagcttcgccgtcgtgaaaaggaactgcagaccaaggatgcgacgatttccgaaatccaccatcgcgtcaagaacaaccttcaggcggtttccgcattgctgcgactgcaggcacgtaagaccaagtccgaagaggtcaagaaagagctgaaagaggcgcagcgtcgtgtacaaaccatcgccatggtccatgaaggcttgagccagaccgccgatgaaatcgtcgattacgacaaggtcatttccagcctgttgaagatggcggtggatttggccaccatgcgtgaccagcatatcgacatcgacttcatcggcagattcggcatgatgccggcgcaggatgccacgccgttgtcattggtgctgaccgagctgatcaccaattccgtggaacatggcttcgaaggtcgcaaagaaggtcatatcacgatttccgtgggacgcggtggcaacaacctcaatgttgtggtcgaagacgatggcacgggcttggccaatgaggagcatgatggtatggcacgttcctccggatccggtttgggaacgcagatcatcagcacgttcgtcaacaacgatttcggaggcacggtccgttgggagccccgtcgtggcggtggcacccgagtagtgctcgatatgaagctgcgtgcggcgcaggaacgataggaaagatacgaaaatgtccggttgaccaggggaagtcaaccggacattttcgttgtaagtcgctattcgcagagcgtatgcaatgatggatctttgaaaatttcagatctgcatctgcatggcttgggagcggcgggcacgcatggcacggcgcttgagcgcacgacgttcgtcttcgctcaaaccgccccaaacaccgtaatcctgattggtgtcaagcgcgcacttcaggcacgcgtcaatcaccttgcaggtgcggcagacggccttggcctcttcgatctgctgataggcggcgcctgtattgccgaccgggaaaaacagctccggatccttgtcgcggcatgcggccttggcgcgccagtcaaaagcactgctcatataatcgccttcctcttgccatgtacggcatgtaagtccgttactcagataaccacgaatcgcgcgacttttcaagagtcttcgcgaaaagaatcccacgaatcgttaaaaaccttggaattccacgcactgaatagggcatgctttggcctgttgcatgagcacgccacgacctgggagggtatagtcgtcggctgcgaacccgtccagaattgcgccgggaatgccgagcatcagatcgttggaacgttctccgcaggggaacgccacacgagtcggacatcggtccagcagtgcggaaataggtttttccaccgcggcaatcactgtgatattgggattgaccaacgcctcacgcaattcgttcgcttcaggcgcagaggaaaagggattaagcgcttcgtccgcatcatccacaatccagatggttcgcttatgcgacggtaagggtttgccgtcatccgtcaccatgccatgttcggttttgcgtgtgaaacgaatattggcgcaacccgtgtcatatagccagcgtgcgcaatgcaacagtagattggttttgccgctgccgtaggcaccgatgatggcgatattctgttggctcacgtcaagaatggcggtatacaccaatacgccatcgtcggcaagcgcaaagggaacgttatgccatgactggtttgatgggatggaaagatcggattgcgttgcatgttgcgtgagaggctcggaaaacaggagatcggggcgtttgcaggcgtggaatcgtgcggccgttccaatattgcggacaagtcggttgacatcgcggaccgcgctgcataggaaaggtgtggtgtgttgtccgtcattgcaataggctgcaccgggaatgctgggaggaatcagcgctgcgtcacgtatgccgatcaattcgttcgactgcatttggtctgtaacccgtaagcatatgctcagcgagatattggctttcatgtcggcatggacttggcccataggatattgcgtgcagacgatcagatgcatgccaagggaacggccaagtgacgcaagacgattcagccgttgcatatagtcgggcagacggtctcgaagcgcatggaattcatcgatgaccacaaccagtcgtgccggaggccggaccaattggtcgaatctggaaacacgttcggcgctgaccagagcctcacgacgcaccaattcctgttcaatggcattcaacgcgcgaatcgcgtggaacaaatcaagatcgcagacattgccaacggtgtggggaagatgttccaaagcgttgaatgtcgatcctcctttgaaatccaaaaacacaaaatgcagatcatcagggctgtattgcatggcgagcgacaagcaccaactgatgagcaattccgattttcccgaacccgtggtgcctgctaccatggcatgcggtcctgatcgttgcagatccgtgcgaaacaagccatgctccgtgactcctatagggcaggatgatgtggaggaaagccatgttcgtgtgatggtgcgccaaggcagcgcgtcctcgtccagagcgtagaaccgctcgaaacacatatggggcattgcggcgaacggcgaatggctgttttgccttgcggtctccaccacctttgcataggtggtggagaccggttcgtcatgctgctgcttctgattggaacgcaacgccatggatgccagagacaacgcgctgctgatgagtccaggagcaagcatggccacatatagccattgccgttgcgcgatcattatgacaagcatgacaagttgcgataataccggcgcggcccagctgatgagcatcagccgatcctcattgaatccattggtatgcttgcgcttggttttgctgttcatgccgtcattgtgaacagcagtggcggatggacgcaagcgagaatcagggttgtggtcggaggatatggttatccacatcctgaccacaaccctcaactttgctgttcggcgagcgtgcctacagtgccagcccgatgggtccccttagccaattcggagaacagttcgaggttcttaccctcgtccaagagcacgcttgagccgacaccatcaacgtagtagtcgggatcggtccaataaacgcttcctgaaatgccttgatccccagaagcgcttttgaacgccaaagccatgcgcatcagcgatgaggtcgaagccttttcatccacggttacggagcccaacgcagcctccgcaacttttttgaccttgccgaagttcagcagcgtatccttggacgcgccctttttcactatggcgttgatgacctgacgttgacgggctgcacgaccgaaatcgccttgcgcgtccgcgtaacgcatacgagaaaacgcaagcgcggtggtgccgtcggcggtatggcagccggcagtccagttcaactgggagtacggatcgcttacatcctggtcgtagcacaattcgacgcctcctaaagcgtcgaccactttgaccagacccccgaattgcaccattgccacgtggttgattttttgcccggtgatgtcttcgacttcgttaaccagttgtttgccgttgtacagttgggcgacggcgttgattttcatgtaactctggtcgatttccaccaaggaatcacgcggaatggaaatcagtgaggaaggtccggatttcggtttggtgagtaccagaatggtgtctgttctgaaaccggtcacgtctcccgcatcgccaatggtgccttcgcgttcgtcggaaccgaggatcagccagctttcgccagcggtatcggctttgttcgtcaaccaagactgtttgttgagctgtccatccacccaattccatgcggagaatatcgacagtcccaaggcgagaatcacagcaaggaaaaacgcgagaatgacccgccccatatgtcgttttctgtgggggagcacggctttcgcagtggattggtatcctgttgtgctattgccggacaaaggttgtctgggcgtgttctgtcgcgttgttcgtggcatgccagtgggtatggaggaggatcctcgtacctgctgagacgcacggtgattgttcggagctgaagcaggagcaaacgatgcaggagacgatgatgccgacttacgtggtctgctggtggagtttgcggcaggacggaaactctgtggagcgctggaaccggatggagttacggatgatggttgcgctgtacgcctgctggcgtgcggggcacttgagcgcgctggctgtgcggcaggcgaaaaactcggaattgacggagagccggattgagaaggaattgtggatttgtgaggctgtgattccgtcttcttccgtcctgcggacgggatgaagctcggtggtgcgggcatggggtccttgccgccgttctcttcactcatacaatgtcctccaaaaagaaatccgttcctacaccatttacactgtgtaggaacggattcggtgaaagcggtctagttctttgcgggaacggcacaaactgtcgcgttgaggtaacgatcggcaagtccgatgtactgcccggtaagagcgtcatggatggagccatcttccggatcgacggtgccaccggtgttcggatcgataagcgtgccatcggcttgcgtgatcagaccagtgaccggatcaggcgtctgtgcggcttcctgggaacccgtgttgtcagtgcccatattatccgtattgtcagtgccatccgtcgaattatcggaagaaccgtcggaattgcctgcggtattggcatccgtgttcgcgtcggattcgtcggaaccataaatcggcttgtccgcgcgcatcttctcccatagcgtctccgcctcatcggtccagaccgaacgattcgggtccgacggcgcggatactaccggaacggtctgcgaatacaggttggacagattgaaatccttgaggctcatggcaagacctgcaagcgctgcggtatcggccatgccttgcgagatatagagtgattgcaaggctgatttcgctagctggtagagctgtgcggtgtcagtaaagaggttcttgctgagcgcttcgttcatcaactgtttgatgaggtattgctgtctggttgttcgtgatgtgtcggatccgtctcccagaccatggcgggttcgtgcgtactgcgttgcctggtgtccgtccagatggtgcaggcccttggtgagttgcaggctggtgtaggggtcgtcgacgtcctgtgggatgcacaggtcgactccgcctacggcattgatcattttgaccagtcctgcgaaatccacgacgatgaagttttgaatgttcagtccggtgaggctgttcactgcattcagggtgcagcttgcggctgaagcgagatcgccgccggtctggtatgcgttcgcgaaaatcgagttgaacatcacattgtattgcgcgggaatcgtgccgttggtcgtttcgcactgcggtatgtccactagggagtcgcgcggaatggaaacgagattgattttggtgcggtccgcggaaatctgcgccaccattgtggtgtcggcctgatggttgcctaccacgtcgtcgaagttgcctccgacggactggttctcttcgccatcgcgggaatcctgcccgatgagtacgaattcgatgggtttgccggagttgggatcgatgatcgaggtgttggcgtcaagtgagccttgtccgatgatttcgaccgaatggtctttgatgatgccattcacatccagccatgttgcggccgctgcggttcccgagaacaccagcatcgccgcgatgaccgaagcgactatcgtcctcgcacgatgctgcactcgatagccaaggctgtgacgcggctttgcgtcttgcagtccattgacgttaggaagcttatcgccggctggtgatgtggtcacggtatcgccttcctgtttatacaaaagatcacgccatatctcaacgcgttctagaacataccactactctgtcatgggattatagagatgttccccgattttcacggattctgcttcaggcccccgtcgttcttggagttaccatgtaccatatttttctcgaattatagtgattgacacggcggaaaacttgacaaaaagaaattgcatgtgtgtaatttaacacgactaaaagtgcgcatacgtatagcaggggaggacgcatgtggggcgtgatcgacgagtcctccgataatccgcttgcggaactgtggggtctgttcaaaagcgatgatgatgtttcctggcagcatagggctttatgttctcagactgatccggaagcgttctttcctgaaaagggcggatcaaccagggatgccaagcgagtgtgcgcccagtgcgaggttcgtgagcaatgcctgaaatgggccatcgagcatgatgagcgtttcggcatttggggtggcatgagcgaacgtgagcgccgtcggtataagaaggaacacaaggaacgggcataacgcacggcacaccctgtgcgtacacttgaaattatgaattctaacgccagcagcgatatccagggaattgtgaccgatctgctcaacagcaggccgtactcccatcggcaggatgccgattcatccgtggctgcggtgattaccgcgcaaagcgatctacgttttttctcatccacttttgccgcggtgctcgcacagcgtgtgcttccaggcactattatcgttgcggattgcaccaatcaggttgagcagcctatgcagatgacgtttagcgttatcccgtcgcctgccggtgtgcttacggaagttcccgaaagcaagaccatacgtgtcattctcgtaggagtgaagggtgcctcttcattcatgaatgccgtggctcgtgcaatgcaacagatcgatcttgacgaccgggtcggtgctctgtggacattgcatgacgattccaggccggccgatgagtcatgccttgaggtgttgctcgatgcttggaaaaacacgccgactgcgtctttgcttggcgcgaaacagttggattggcaggcggaaagcctgcataacgtcggtttgtatgcggggcaccacaatgtcacgtctctggtggtggacggtgagccggatcaggaacagtatgatggccggcaggatgtgttggctgtgtcgctttccggcgcgctggttccattggccaccttgcgtacttggaagggtgccgatccatggttcggcacgttcgccgaatccacggacctgtgcaggcgcatctgcctgggcggtggccgtgtggtggtggtcccgcaggcgcgaatcgcccataggagggcaagatttgaaggcgtgcgttccaaaaacggccaacctgttgaagatgaggaaggccgcgtcgatccgtaccttgcggtacgcgaggcgaatacgaaatacgcgtatacggacgtgcatcgttcttggtggccgctgctgtggatctggtcgatactgaaggcgttgggactggccgtgctgtgcctgacgcgcaaacagccataccatgcctgttgcgaattggccctgccttggcgttcgttgctccacttgccgggcgcatggagggcccgtgcccgattgcgtgagcagagtagggtctccttgaaggcattggccgcattgcagacgactcgtcagcagatcggccaatggaacgatcgcaagcgtgcgtttcttgaccagcgtggcactgtgatcctcagccctcttgccaaggcgcatctgcgtaaaaggctcatgcgcaggtgggggcttgccatcgcatcggcggtgatcgccttcgcatggatcgtcttcctatattggaatgtgcttcggagcgtattctccggcgcgtcgatatattctcaaacgttgctgccgaccgatgccagtttcagccagttggtgcatgccgccaccacgtcgtgggcgtataccgcgggaactggaatcagcgccccgagcgcgccttggctgctggtgctcatggtggtttccgtattcacggctggccatgttgcgaccgcagtcgccgtggtgttcttcttgtccgctcctttgatggtgctgtcgttctgggctttggctggaatctttactcggtccgacacggtgcgttgcgtgatcgcgttggcatggttcgccatcgcattgtcgatgaacgtgtacagcgatgccgacgtgacgatgatgacggtcatggtgtttcttcctgcggccttcgcgttttctttccgagccgtaggcatgtaccgtacggaagatctggtcaatccgcaggcttccgtgcaggccgcggcgcttgcggcattgtgctttattcccgtcgtcgcggccgaaccgcaattgctgctgccgctgatgttgtcgttccttgtgttcctgatgcttgtacgctcccatagaacgacgctgctgctgattccgctgccggccgcttccgtatgcgcgcccacattggtcaacacggtacgtttcgcaggagcaggtacgtggcgtcagatttttggcagtgtgatattgccgtcgtctgcgcatgatgggcatccgatgatcgcaaatctttcggatattgtttcccgtgcgttcggcgttgccgtatccggcgagatttggcagtatgtggctgctgcaatgttggcattgattgtgcttcttgccgcggtatcgctgttcctgccattcgtgcttcgcgtgtcgcgtatgatgtgggtcgtggcgatcgcgggtcttgccacgtcgctgctttccgccgcggttgtggttgcggtcgatgcggatggcgccgtggccggttccgtgcttcccggcgtttcattcacgatgatgggactgctgtcttgcgtgtgcatggtcgcaggcggtgcggtgcaacgtttcgtcatgctgtggcagaggcccaccggcgatgtcgaagttgagaggaatggcgcttctactggcattattgccgggcgtgcggcacgaatcgtgctggtcatgctgattgcggcgtcggttgtggcgagtgctggttttgattatgtcgccagagaccataacacggtttcgaccagtgattccggtttgccgattgttgcttccgactatcttgcgcaggatgaggcgaggcgtgtgctcgcagtacgcgcggatagtgccggttccatcagctacaatgtgatgcgcacccgccgaggtgatttgatcgacagctctccggcacagcgtgtcgaagtggcgttcggacgttccgatgatgcgaacaaggccatcgccaaggattgcgcgcagctgttgtcgaatgctgattccgacgccgtcgccgatttgagcgagttgggattcggaggcatctatgtggtgcgctccggcgaagacaaggcgcaaaaggagataaccgatcagttgagttccaatatcagcgcttccgatggcacgcagaatgtcgtaagcactgatgcgggaacatactatcgtctcaccatccaagatacggccaagcagcatatcgaccgcaagggatatcgacaggctgaatcgagtgtgtggcgtcaggcatggctgtggtgcatgggtattgttctcgcagcgtattgcttggttgcgcttccgcgcatgaggcgtcacggtcaggaggaagcatgagcaaacattcccgttccaaaacggtttggcgtgtaattctggccatagtgtcggtgttggtcattgtcgcactggcgaccgtggccgtaatctaccgcccgacttggattcatgcggattcgccggtaacgcagcgttcatccgtatcccgtaccgtcagtccgcgtcagctggaaacatattgtccagcacgaatgacgatagctgatactgatgcgtatggagacagcgaatatcaagcgtccaacggcaatatcatgtcgtcggcgcgttatgcgtccttcggttcggtgttccgctcttccgtagggcttctcggagctgatgaagccacttcgtcattggtgttgaacaaggatgatgccggatcggatgatgatattttcatggcgtccggcacggtcgatgacggagcccaattgcagaatacccgattgctgtcggcttccgatggaacgggagcggcctcttcggtgatgtcttgggctactgagggagatttgaaaggcgtttccgctgcttcctgcgtcgttccggctttgaagcagtcgctgatggtgtcgggcaccaaaacaggcatgacccagcagctggtcgtggccaatccgtcggctaaggccacgtcggtgaacatcaaggtttggggatccgacaagtcgggtgctttggcattgtctaccggttcgacgttgacggttggcgcgggcaaggaatctgtgctgaaccttgccgcagcagcttccgggcaggatgctttgtacgttaccgtgtccagcgtggacacgcccgttgcggccgtggtgcgcaccatagccatggatggtctggttgcaaaaggatcggattatgcggttcccaatactgttgccgcaaaaacattggcgattgacggactcacggaaggcgatgccgtcaacctgtatgtgtatccgtctcggcaggccgacgtcaccgtatcttggacggatgaccaaggtctgaagaaaaccaatcagcagacgctcgaatcgaatcgcgtttcggtcatcgacctgggttcggttcccaagtcggcgaccggacttaccatcagcgccagcgagccggtatccgtcgccgcgaagatcaccaatgatggcgatgatgaccaggctgatttcgccttggtcaacgcttcagtgccgatgagcgtctccgccatggccgtgcccgaccatgccacggctcaagtgggcatcaccaacatatcgggcgatgagcgcacagcaacattgacgtcctataacagtgtcggagatactgttgaccagcgcgagattgctctccaatccggcgcttcgacaacggttgatctggcggatatcaacgatggagacgttgccgccgtaagctttgccgatccggaccaatcaatggtgtggaacatccgtatcagccaaaaagacgtatcggatgcgaaactggccggagtgtcgattatcggcgcaacggatctgaaggaagcccgcgagcaggtgctggccaaccagaacatgaccgtcgtgcgttgatcacataccccaatcggggtcgatctcttcgggacggcgtccatacagttccgccaagcgcaacaccacttcgtcgcggatggcgaattgcaggtccatacggcttcgcgcatgcgattgcaaaggcatacggtacagcacgacgcgcggcggaatgccatgttccgcggggaaagactgcgagcccaagtgcgcagtggcctcccaaggtgccgggtcggatggcggaacatcctcgaccgcaaactgtaccggtgccaccagttcgggccatgcatcgttgagcctacggatctgagccaccagcatgtcgtcgaacataccgcttcttgtacgataacgtggaagtctggtaccgaacatgggagtgcgggtcccacgaccatgacggtttctatacactgttgattcccaaggcaattgatacatggcttctaccatatcagggccttgcgcgaatcatgcgatagcatattgttcattgcatcgacacaggaggaaacgatcatgacggatatttccgtgccctgttggaacgacgtggatatcgaggaattgtgcaatggagtacgccttatcgccttcgatctcgacaacacgttggcaaggtcgaaaaagccaatgaaggacgacatggccgaatgcttctccgcattgacatcgttgattgatgtcgcggtgatcaccggtggcaagtatgcattgctgaaaagtcaggtggtggaacggttgacaggtcaagccaatcggtcgcatctgcatcttatgccgaccagcggcacccgatactaccgttggggcggatcggattgggcgccggtcttcgcccatgacctcagcgcggatgatcgtgcgaaagcttacgaatcgttggaacgcaatgcgcgcgaacagggtatctggctcacgcacgtttggggtgaacgtatcgaggatcgtggcagccagatcacattctccgcattagggcagcttgcgcccatcgaagccaaggaggcgtgggatccaaccaacgagaagaagaatcgtctggcacgagcggttgccgccgatctaccgcatttggaggtacggccgggcggcgccagcagcgtcgatatctccgaaaaaaacgtcgacaagtcgttcgctgttcgagaattggccgatattctcggcattacggtggcgcagattgtttttgtgggagaccgtatggatccggatggtaacgattatcccgcggcaaaggcaggcaccagggcggtgaaggttacctgtccgaacgataccgtgaaattgtgcggtggaatcatcgccagtctatcgcgatagaacctgttgggaggtttcgcatgaactcaatggcgagggcatgctcgatggtggttaatctgctgtttccccggggctgcgccgggtgcgacaaaccggatgaagtgctatgcgaagcttgcagggcattgttttcccagccgaccgcacagtcgtttgacggtgtggcgatgcaacgctggttcgcatgcggatggtaccatggcacggtcagaagggcggttctcgcgtggaaggatcacggcgacgaggaatgtgaccgtgcgttcgccgatgcgatatgcgcccttgcaaaagcgtctggcgttattgacttcgttcgtgataggcatggttcatgccatgatgttgttgtggttcccgcgccttcgtctcccgcttcaatacgtcgtcgcggacgtaaacatatgatgccgatcgccaaacatctggcaggttttctacgggaggaaacaggctgcgaggtgacggtgcgtgacgcgttggagaacaggggggtcaaagggaaatcagtgcagaccagcggtgcggcgcaacggtcgcaacgtttgaaggggcatgtttcggtgtgtccttcggtttccttgcgcaatacgatggtgattctggtggatgatattgtcacgaccggtgcgaccatgcgcagttgcgtcgaaacgatgcggaaggagggtgctacggtcgtgaccgtgcttgctttggctcacactccggcgggaacgcagaaggttggcccaacgcaagcatggtcacgcacgcaagtgcagtgacgtgagaaatcctctattcgtcatccgtaacatggtatttcggcagaatgatttcaaaatcggctccacgcgggtcatcgacgaccctcaccgaaccaccgtgcaactgggcggcccaacgtgcgatggacaatcccaagccggttccgcccgattcggtgcccggacctgtttttcctttgacgaaacggcggaaaatgtcggaacgcgcctcttgcggaatctgcgatccgaaattgacgacattggtgacgatggtgccgaaatccttgttttcgtgtgcttcgataagcaccgtggtattgtccgcggaatgcttgagcgcgttcgcgatgatattggtgaacagttggcgcaggcggtcctgatcgcctgccatctcgatatcgtcgggcacatgcatttcgatgtcatgcgcatgcccggcatcggcgatttccaaaggttccacggtttcgtcaagaaaatcggcgaaattgaacatttcgatttgcaggcttgccgcgccggcttccatgcgggaaagatcaagaaggaacgcgatcagatcggacaggcggtgcgtctgattgaggatgctttccagatttgatggcgtagggtcgatcacgccatccgccatgttttcgaccatggcttgaagcgctgatacgggcgtgcgtaattcgtggcttacgttggctaccatgtcccggcgcatctggtcggcatgctgaagctcttccgccatttcgttgaaggtgagggcgagctggccgacttcatcgcgactattggagtcgacatggacgcgcacggtgtaatcgccttctgccatcgcttcggcggcgtcgcgcatttggcgcaggggagaggtgagtcctctggagaagaaatatgtgattcctaaagccacggcgagggtaatgggcatggcgatccatacgctgagccctactttgagcaggaaccacgccatgatgaacgcaatggcggtggagatggtgatcagaacgctcaattcaattttgagcgatgagaacaaaccaataggacgttcggtttccaatggattcaccgaacgccctggttttgtatcggtagtacgcataccaccgaattttagcgcattagtcttggacttctggcggttcgaacgcgtaaccgacgccatgcacggtacgaatggtcttcgaaccgagcttatggcgcaatgccttgacgtgcgaatcgacggtgcgagtgccggaagcatccacccaatcccacacttcctcgagcagtttctcgcgagtgagcacggacttcggcttgcgggccagcgtggccagcaaatcgaattccgtaggggtcaggtgcacctgcttgccattgacggtgacgatacgttgcgcgggatcgatgaccaaggagccgaaatcgagaagcttctcgttttcggagtttttggcgatgaccttggcacgatctacacggcgcagcaacgccttgcaacgggcgatgagttcgcgcatggagaacggcttggtcatgtagtcatcggctccggcaccgaggccgatgaccttatcggcctcgtcgtctcgtgccgtcaggatcagcactggcacagggcgctccgccacgatgcgtttcgtggcctcaagaccatccatcacgggcaacatgatgtccatgatgaccagatccggacgcaacgtagtcgcggcctgaaccgcactggcgccgtcggatgccacgcgcgccgtccagccttccgctgtgatgcgctgcgcgatggcagtggccagtgtcggctcgtcttcgaccaccagaacggtgcgtggagccgttgtgggttgtgctgatgagttgagcatagctttccgcctttctcagagttccggcttcaagaatactgcgcccagtgccggaacggtgattttcgcggaccaatcacgtgaatggtattcgccttcgatcgcttcgaccgtgccattgtgaatgccggaaccgccgtagatctcatcatccgtggtcagcacttcggtccatttgccgcccttggtgagcggtacctgatagtcggtccatgcctcgccggagaagttcaccacaaccaccatttgctctccgtccttgccgatacgcacgaagctgagcgtgttgtgatcggcgtcatcgctggtgagccactggaagccggccgggtcgaagtcttggctccaaagtgcaggggaagccttgtacagcgtgttcaaatccgcgacaagcttttgcacaccctggtggtccggccattcaagcgcggcccaatccacggaaccatcatgatcccactcgccgtactgggcgatctcattgcccatgaaggtgaggttcttgcccgggtgggcccactggtaggcgaacagcgcgcggacaccggcatacttctgccaatcattgcccggcatcttgccgaacatggatcccttgccgtacacaacctcatcgtggctgatcggcagcacataatgctccgaataggcgtacaccatggagaacgtgatctcgttgtggtgccacttgcggttaatcggctcctcatgcagatactgcagggtgtcgtgcatccaacccatgttccacttgaggccgaatcccaaaccgccggcgtcggtcggcgcggtgatgcctgggtaagccgtggattcctcggcgatcatcatgatgcctggattgttcttgtatgccgtggcgttggcttccttgaggaagtcgatggcttcgagattctcgcggccgccgtagatgttcggatgccactggccggcctcacggctgtagtccaggtacagcatcgaggagaccgcgtccacacgaagcgcgtcgatatggaactcatccagccagaagcaggcgttggccaccaggaagttacggacctcgcgacgtccgaaattgaacacgtacgtgccccaatccgggtgctcgccacgagtcggatccggatcctcatacaacggcgtgccgtcgaagcggcccagtgcgaacgcatccttcgggaagtgggccggaacccaatccatgatcacaccgatgccggcctcgtgcaatttctcaacaagatacttgaaatcgtcggggccgcccaaacgcgaatcgatcgcgtagtagccggtcacctgataaccccaggatcctgcgaacggatgttccgccaacggcatgaactccacgtgcgtgaagccttccttctgcacgtagggaaccagcttgtcggcaagctcacggtagtcgttcacgtccttgcgccagctggaggcgttcacctcatagatgctgaccggtccgttatgcgggtcgctggccgcgcgttcggccatccaatcggcatcatcccattcatgggtggattcgaccacgatggatccggtgcgcggcggaatctcgtgggagcgctccatcggatcggccttcatggtccattcgttattggcgttgaggatttcatacttgtagatttcgccggcctcaatgcctgggatgaacagttcccaaatgccggaagaaccaagttcgcgcatggcgtgggtacgtccgttccagccattgaaatcgccgaccacgcgcacggcatgcgcgtttggcgcccatacggtgaacgcggtgccaaccacctgctcgccatctacgccttcagaagaacccatcggatcgtcatagcggagcacatgtgcgccaagtgcctcccacaggcgctcgtgacggccttcgccgaatagatacatgtccatctcgccgatggtcggcagataacgatagggatcgtcagacaccacaacggaaccgtcttcatactccgtgcgaatacggtaatctggcacgccgtacccctcttctgctgcggcggcgggaacgagtgccatgaagacgccattgtattcatggattgcgagcgtttgaccttgttcagtgataatcgtcacggattttgccaacggacgcaagactcggatcgtgacgacatccgcatgcttgccggaaccgaggtgcccgccgagcacctcgtgaggattgtagaacgtaccgttgcttactgcatccagtgtgccctggggaacaggaacagcaacgacatcttcattgatcttggattctgtagccatggcaaaagtgtaagcatgaaacggaagaaaagtggcccgtgtcgcgcctatttttccgtttttcaagtgtttttgtccaagtccacccctgatggcacaataattcgggttttgtgtaagcttttcacggaggattcatgggttacaaggtcggcgacatggtcgtctatccacgtcacggcgctgcgaaggtggaggccatcaccgaacggacagtcaagggaatcacccgcgaatatctgcagctgtcggtgctttcgtctgacggtctggtcatcaacgttcctgttgataatgccaaaaaggttggtgtgcgagatatcgtcgacgccaacgaagtggccaaggtgttcgagattctgcgcactccgatcattgagaaggagatgaactggtctcgtcgctacaagctgaatgtcgagaagatcgccaccggcgatgtcaataaaattgcggaagtggtgcgtgaccttgcgcagcgtgatgttgacgagcatggtctgtcggctggtgagaagcgcatgcttaccaaggcccgtagcattctgacttccgagatttcgctgtccgaacaccttgatgaagccgaggcccagcgtttgctggacgtgaaccttgggtatgagccggcccagcccggcgatgaggagcatcataccgaggctcccgaggaggctgccatggatacgctggcccgagttgaggccgaaagcaagaagtccaagaagaggtaaggcgtttcatgcgtatcggtcagggttttgacgctcatcgattcgcatctcacgatgcaggcaagccgttatggcttgcctgtttgcgttgggagggcgatggcatcgagggcgattcggatggcgatgtcgtcgctcatgcgttgattgacgcattgctttccgcggccggtcttggtgatatcggcaccttgttcggtgtcggctcgcagtccgatggcgcgggcaagcatggcgccgaaatgttgcggaccacggtcgattatctgaacgaacgtggtatgaagccagtgagtgccagcgtggtcgtgatcgccaatcggccgaaaatcggaaaacacagggaagaagccgaacgagcgttgtctgaagccataggttgtgaggtgtccatgaccgccaccacaacggatggcatgggattcactggttcgggcgaaggcgtcgccgcgattgccgatgctttggtggaacctgttgatccatcgactcgtcaggcagtctgatttcgcccgctgacggctttccgatacttctttctgctactttcttttgaaggattcaatagccttcgcaaccgcccaaaacaacgtcgaaattgtcacgatgatgaagctcgggggagcggggaacatggcggaaatcacgagccctccccaaatcgaaatcaggcagatcaccgtggcgacgaccatcgccttgaatggtgagcgggcgatgatgttggcggtggcggcgggggtgatcgccaacgcgaagatcagcaatgtgccgactgcgggaacggcaatggtaatgacgccggccataattgtcataaagcaaatgttcatgaaaccgacgggcacgccttttgcctgtgccacctgctcgtcaagcgaactgaacaatagcgggcggtagatcactgccagaacagccaaaagcagcacgtcgaaaatcgcgaaaccaatgatctgaccgtcggtgatcgtcagaatcgagccgaacagaatcgactgcatctgctgcgaagccgagcttgacatgcgtgcgaaaaagagaccaaggccggtggcgaaagcgagtacggttccagtggcgatctcacgctgtgaagccttcttgccaagcgcgccgatcaccagtgctccgccgagagcgaacacgccaagacctgcggaaacaggcaggccgagcaatacggctccggtggcacctggcagtccgatatgtgccaaggcgtgggctgcgaatgtggaatgtctggcgatggtgaaataacccatcacgccggctgccaatgcgatgcacaggccggcgagaaacgcgttcgtcatgaatggggcgttgagcgtggaaacccaatccgggtcgaaagcgaatacggtaccgtccatgctcagtcctcctgcgtggtgtggctgtgatggtgaaattgcgcgatttcttctggagcatgcgcatcgatgctcatgttttcagactcgtcctcgcttggcgtcacgaacatatctccttgcggagtggtgaccacctgtacggtcgtgccatataaatgcgtgagtagatgggaatccagcacctcgttcatgcctgcatagtgtggatgtccgtcaagcagatagacggctccagtgaggatgggcagaagcatattaaggtcgtgcgccaccacttggatggtcatgccgagttcgcggttgagtttggcgagtacgtgcacagtggcgcgttgactcgccagatcaaggttggcgagaggctcgtccagcatcagcagtttcgggtcatccacgagcgcctgcgcgatggcgaccctttggcgcagtccgcccgaaagttcggataggcgataattcgctttgtcttgtaactcgacgaagtccatggccttgcgggctttctcgcgaagtgttttggtgacgggatgaatgccgaatcgagttcccgtcaagccgagaagcaccgactgttccgcggtgatgttcgattcgatgtcggatgcgtagctttgcggcacgtagccgatgcgccggtttgcggagcctgcaggctgtccgagtaccttgatgctgccgtgcgcggttggaatcaatcccagctcggccttcatcatggtggttttgcccgcgccgttggtaccgacgattgcggttaccgagccttgcggaatgctgaacgtgccgtgttgccagatgacgtgaccgcctcgtttgacgcaggcgtcgtcgaattcgatgcaggcaggtgtctcgtcgtgcatggcttctccttgatttgaatgcacgtacatactcgcaaatggtgttgacaatcattctcaataaggattgtcgttgaaaccgtcgtaacgatcagacgagaggctttgcgtaaaaagcaaaacgtcaggcaaacaaaaaagaccatcccgcattcagttggacgcaggatggtcttggcaaaagcgattaccgatcgattgttcggcaatcgcttttgccgaacaatcatttcaccggatttggttgcggcgcatcgttcgatccgttcgttgtctgatcgttgtcttgcgtcgaggaatctgcggttgattccaaggaatccgcgttttccgacgtgctgtcggaacttgttgcatcctgatcgtcggcatcggattgttcatcgaacatatcggtcaacgacaggataagagcgcggatccacgatgtcaggctggtgtaatcggagggcatctgttcgctgacatcaagcacgggaacgtcggatttgtaagcaatgccggtcagcgtgttcgtggcgtcgcttgtggattgtgtgtcgttgatcagcacctcgactttatgcttttccagcaattcctgaaattcctgaagatcggtgggggttggctcggaattcgtgctggacgattgcagatacccctccggcgtgttgtcggtgaaccccatgtcgctgagcagatagtaggccaccggttcggtggcggcgtaggagacgttcttatacgagtcgctgaacgccttcatgtccttttctattttcttctcccgcctgttccacgcggtgagtttgttgttgaaatatttcttttgcgcgggcatgatgcggctatatgtgtcggccaattccttggccatggcgtttcgggcgtcactggagaaccataaatgcggattgtctccctcgacggcgcccaccatttgtgctgcggaaacggaaaccatggtcttactgaggttcttggtggcccaagtgtcatagccggcaccattggacactacgacctgtgcctgctgaagtttgtcgatatcgtcggttttcggctcgaaatcatgcgcattgacatcggttgaagagagaaccgacgtgaccttcacatggacgccaccgatctgctcggcaagagaaccccattgattgaccgaggcgaccacttcgattggagtgatctgttcggttggggtttcggagtcggcggaggcgtcattctcctgcgaagttgaccctccggaacatgctgccgtgccgaacgccacgcaaagcgcgattcccgcagcgaaagcgcgtaacaaagaacgtttgtgcaagcgcatgtcgattgccctcttcctgaaccgccctaatcgtgttcatctcataaatacgtgtgcgacttacgactgaaaccaagatagcctacgatacatgcaaatgccaatacaacaatgagacaacgaaaaggggagtggccggcatggcggtgaaaatcgatggaaagatggtgtccgcgcagatcaaagcgaatctcgccgagcgagtcgcagcgctgaaagagcagggggttaaccccggtcttggaactatcctggttggttccgatgccggatccgtcaaatatgttgccggaaagcatgccgattgcgctgaaatcggtgtgaactccattaagaaggagttgcctgccgacgcaacattcgaacaaatcgccgaagtcgtacaggagcttaacgccgatcctgcctgcaccggctacatcgtgcagttgccgttgccgaagggcatcgacgagaacgccatcatcgatctgatcgaccccaagaaagacgccgatggtatgcacccatataatcttggcgaactcgtgttgcatgcgcgcggcgagatcactactccgctgccatgcactccgcgaggcgtgatcgaactgctcaaagcctacgacattgacctggacggcaaagaggtctgcgtgctcggccgaggcatcaccatcggccgcactattggtctcatgctgactcgcaaggcggtgaatgccacggtcacgctgtgccataccggcaccaaggacgtgcgcaagcatatgcgtgaggccgatatcatcgttgcggccatgggctccgccggtttcgtcaagccggaagatatcaaggaaggcgcggtgttggtcgatgtcggtgtttctcgcgtgttcgacgaggaggtcggccgttatcgcgtgaagggcgatgtcgataaagcctgttatgagaaggccttggcatacacgccgaatccaggcggtgtaggccctatgacccgcgccatgctgctggaaaacgtggtcgagatggccgagcgtcagctgtaattgcgctctgtgtgtgaaaatatgaagtaatttcgggcgtgtcgcgggttgcggcacgccttttttgtgcatggtcccatgtaaacttacgccttgcgtgtgttatatcgcacgcacataattgaagaccgattttatccacccactatttgtaagaaaccaaattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcacgacgaggtcctgctcgacatcggctacaagactgagggtgtcatcccctcccgtgagctttccatcaagaaggacgttgatccggacgaagtcgtcgaggtcggcgacaccattgaggcccttgtcgtcaccaaggaagacaaggaaggccgtctgattctgtccaagaagcgtgcacagtacgagcgcgcttggggagacatcgagaagatcaaggaagccgatggcgttgtcgaaggcaccgtcatcgaagctgtcaagggtggcctcatcgtcgacatcggtctgcgtggcttcctgccggcatccttggtcgaaatgcgtcgcgtccgcgacctgtccccgtacattggccagaccatcaaggccaagatcctcgagctcgacaagaaccgcaacaatgtggtgctctcccgtcgtcagtacctcgaagagacccagtccgaagtgcgcgaaaccttcctgtcccagctcaagaagggccagattcgcgaaggcgtcgtgtcctccatcgtcaacttcggtgcattcgttgatctgggcggcgttgacggcctgatccacgtttccgagctgtcttggaagcacatcgaccacccgtccgaggttgtcaaggtcggcgacaaggttaccgtcgaggtgctcgacgttgacctcgatcgtgagcgcatctccctgtccctcaaggctacccaggaagatccgtggcagcgcttcgctcgcacccacgttcctggccagatcgtcaagggcaaggtcaccaagatcgtccagttcggtgtcttcatctccgtcgaagacggcatcgaaggcctcgtgcacatctccgagctggccaaccgccacgtggagaacccggagaccgtcgtcaagccgggcgaagaagtcttcgtcaaggtgattgacgttgatctcgatcgtcgccgcatctccctgtccctcaagcaggccaacgactccgtcgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcataaggaatttgtggccaaggagctcgagaacgctgaagcttccgccgctgaagatggccaggctccgaaggaagagaaggtcgaagaggtgtcttccaactactcctccgagaacacttccgccggcaccctcgccgactccgaccagctcgccgctctgcgcgaccagctgctcggcaagtgattgtatcctgagctaggatccaatccagctcaggctagattttagaaaagaccccgttcctgattcaggttcggggtcttttcgtatgtgcatggcaagcgcgcatgcgaagcgcattacaatggcggttgtggtgattcgaataggattgactggtggcatagcggctggcaaaagcacggtatccgcaagactgcgtgagcttggtgcagtacttgtcgattatgatctgcttgcgcgtcaagtggtggaaccaggcagcatcggccttcagcgtatagtggaatgtttcggctccgatgctttgaccgatcgaggcgagctcaatcgagcgtggatggcagagcatgtgttttccggcgctgatgcggaacgaaaacgcaagatgctggacggaatcgagcatccactgatttatgaacttgcagtgcaactcgaacatgaggctgttgaagttgattgccaagcagtagtggtgcatgacataccgttactcgccgaagtaattgacagcattccttttgaattcgaccatatcgtaactgttgaagcgcccgaacaggtgagggtcagcagaatgatgtcaacgcgaggcatgagcgaaagccaggcatggaatcgtgtgaaccatcaatccagcgtggaacagcgtcttgccattgccgatgagatcatcgattccacacagtcattggaacaaatgttcgagcatattgatatgctaatgcaacaatggcgcacggaagcgaggtaggtatgggattcaatattgaacgcacgaacaagccgtttgtggtcaaatcgccatataagccgagcggcgaccagcctaaagcgattgaagagcttgcggaacgcattgaaaacggtgagaacgatgtggtgctcatgggcgccaccggaactggcaaaaccgccaccacggcatggcttattgaacgtctgcaacgtccgacgttgatcatcgaaccgaataaaacgttggcagcgcagctgtgcgccgagttccgtgagctcatgccagacaatgcggtgagctatttcgtttcgtactacgactactaccagccggaagcctatattccacaaaccgatacgtatatcgaaaaggattccaacatcaatgacgacgtggaacggcttcgccatgcggccacggcgaacctgctgacgcgtcgtgattgcgtggtcgtggcaacggtttcctgtatttacggccttggtacgccggaagaatatgccgggcgtatgctgtttctcgaggaaggccagcagatcgaccgtgatgacttgctgcgtactttcgtcgccatgcagtacaagcgcaacgatatcgccttcaccagaggtactttccgtgtgcgcggcgataccgtcgaaatcattcccgtatatgaggaactggccatccgtattgaattcttcggtgatgaaatcgaccgtatttcaaccctgcatccacttaccggagatgtgatcgggcgtcaatcgcaagtccatattttccccgcatcgcactatgtggcagggccgcaacgtatggagcgagcgttgtctaccattcagcaggaacttgatcaacgtaccgccgaattgcgcaaacaaggcaaggaacttgaggcgcaacgtcttaccatgcgtaccacatacgatttggagatgctttcccaggtcggcgtatgttccggagtggaaaactactcaagacatttcgatggccgtgagccgggcacgccgccgcatacgttattggatttcttccctgacgatttcctactcgtcattgacgaatcgcatgttaccgtgccgcagatcggcgccatgtacgaaggcgatgccagtcgcaaacgcacgttggtcgaacatggcttccgtctgccttcggcgatggacaaccgaccgctcaaatggccggaattccttgagcgcgtcggccagacggtctacctttccgccactcctggcgattatgagcttggcttgagtgacggtgtggtcgaacagattattcgaccgacaggattggtcgatccgcaaatcgatgtgcgcccggttgacgggcagatcgatgatctgcttgcggagatcaaggaccgtgtgaatagaaacgagcgtgcgctcgtcaccacgctcactaagaagatggctgaggatctgacggattatcttctggagcgtggcatcaaagtcgaatacctgcactccgatgtggacaccctgcgacgtgtcgaattgctgcgcgaactgcgcgaaggcaaaatcgacgtcatcgtcggcatcaacctattgcgtgagggtcttgatttgccggaagtatcgttggttgcgatccttgacgcggacaaggaaggtttcctgcgttcctatcgttccctcatccagacgattggtcgtgccgcgagaaatgtgtccggaaccgtcatcatgtatgccgatgacattaccgatgccatgcataaagccattgatgaaaccaatcgtcgccgcgacatccaaatcgcatataacaaagagcatggcatcgatccgaagccgttaatcaagaaaatcagcgacgtcaacgacatgctcgccaaggaagatgtcgatacgcagacgttgctcggtaccggctaccgtaatgaaggcaaagccggcaactcgcatcttggcgtgcctgctaccagcaaggaggaatctgacagacggcatgaggagattctcaaggccggattgcccgcgcaggatctagctgatctcattcgacaactgtccgagcagatgcatgccgccgccgaacagctgcaattcgagcttgcagctcgtttgcgtgacgagatccgtgacctgaaaaaggaacttcggcagatgacggaggcgagcaaatagttctcgaccggtcatgcggcatccgtaccatagtggattatggctgaaacaccacttgtttttgaaatcgccacgttcgcggtgcttgccgtcttcttcgtggttgacttgtttatcatcggacgtaagccccatgtgccctccaccaaggaatgcgtgcagcatatcgcgttctttgtagtcatggcgttgatcttcggcggacttatgtggttcttcgcgggattgaagccggccatcgaattttattcgggctggcttacggaatattcgctgagtattgacaatctattcgtcttcgtcatcattatgtcgaattttgcggtgccaaaacagctgcagaaattcgtgctgtccatcggcatcacgatcgcattggtgttgcgcggcgtgttcatcctcatcggcgcggccattatctcccgcttcacctgggtgttcttcctgttcggcgcatttcttatcgtcaccgccatcaagttggtcactgggggagacgaagatgaggaatatcatgagaatggcttgattcgtgcattgcgcaaggtgatcaagatcaccgatgagtatgacggagaaaagttgcgtaccgtcaaaaacggtgccaagtattggactccgatgctgatcgtctttctgaccatcggcaccaccgatgtgatgtttgcctttgactccattcctgcgattttcggtttgacgaaggatccgttcattgtgttcacgtccaatgtgttcgcattgctcggcttgcagcagctgtacttcctgcttggcgagctgctcgacaagctggtgtatctgcctcttggactttccgtggtgctgggcttcattggagtcaagctcattatggaggcattgcacggcaattcgttgccgttcatcaacggcggtcaaccgatcgcttgggtgcctgaagtgcctacatggctgtctttggcggtgatcgttgtggcgattggtggtgccgcattggccagcgtactgaagatgcgtgccatcgaagcaaaggaaaagtgacgatttgagaaaccgcatggaaacatgcggtttctttttatcaaaaaaatgtgagcgctcacaacacgcctcgtttcagggtggaagtgagcgctttttgctagtagactggtcggttggaaacagggtcgtcagatccaaaatcaatatcaacaagaataggcaggcattcatgcgtaaagccaagatcgtagataccatcggtccagctaccgagtccctggaaggcatcaccagccttgtcgaagcaggtatggacgttgctcgtctgaaccgctcccacggcactccggaagaccacctcaaggtctacaacaacctccgcgccgctgccaaggccaccggccgcaacgtcgcagccctggttgatctgcagggtccgaagatccgttgcggttggttcaagaagaacgccgacggtgaagacaaggtccagctgaccgaaggccaggagttcgtcatcaccaccgacgacatcgagggcgacgagcatatcacttccaccacgttcaagggcctgccgggcgattgccatgctggcgatccgattctcatcgatgacggcaaggttcgtcttgaggtcaccaaggtcgaaggcaacaacgtgtacaccaaggtcgtcgttgccgggccggtttccagccacaagggcatcaacctgccgggcgttgcggtgtccctgccggctctgaccgagaaggatgaagccgatctgcgttgggctatccgcaccggcgccgacatcatcgccatgtccttcgtgcgtttcgccaccgacattgaccgcgcccacgagatcatggacgaggaaggccgtcgcatcccggtcgtcgcaaagatcgagaagccgcaggctcttgagaaccttgaagagatcgtcaaggccttcgacggtatcatggttgctcgtggcgacatggccgttgagtgcccgctcgaagaggtgccgctggctaccaagcgctgcatcgagctcgctcgccagtacgccaagccggtcatcgtggctaccgaagtgctcggctccatggtcaactccccggtcccgacccgtgcagaggcatctgactgcgccaacgccatccttgacggcgccgacgccactatgacctccaacgagaccgccgtcggcaagtacccggcagtcaccgtgagcaccatgagccgtatctcctccttcgccaccgagcacggtttcgaccgtatcccggagctgaagaacctggatatgtcttccaccggcgctgtgtcttccgcagctgtggatctggctgacaagctgaacgccaaggctatcgttgcctacacccagaccggttccaccgtgcatcgcgtgtcccgcgaacgcccggccaccccgatctacggcatcaccaacaacgagcacacctatcactggctggctctgtcttggggtaccgagtccttcctgctcgatgaggattaccacgacaagtcccgcaaggacctgatgatcttcaccgataagatcctgaaggatgccggcaaggtcaccgatggcgacaagatcgttgtgctgagttccgcccagggcgagcaccagccgggtcgcaccgattccatctacgtccacaccgtcggtgcttgcgactgagatgcgtttcggtcagtggctgactgattagcgaataggagggcttccgtccatttggatggaagccctcctattgttttcggatgatgttgattttgtggtcgatttatagatcgcgataggttgtgattaagctgccgcgcatggtgcgaaacgccgaccactcaaggactttgcgaaatcatttttctgtgttaacatggtcaagttgtgcgaaagcccctgtatcccaattggtagaggagacagcctcaaaatctgtacagtgtgggttcgagtcccaccgggggcaccggattgatgaacagccgtggttggaaatttccagccgcggctttctctttgaaaacccatctggcgcatgcgccgttacgtggtggctcagtgccttccatccaccaggcgatacgggttacagggactaaacgtggtgttttagattttttgaataggatattttcacggttgacggtgctgtcatggcttgatgattccggcatcttcctcgtggcgtatgaatgtaagcgagtgaatggaaaccggaaaagcaagagagtggcgcagtttaaaaacaacgaatagtgtaacgtcattccttcgaatctcgaaccggggcgtgatgtggttttgtctccggaggggacggcgactatgaggaaaggcgagacgaaaccgccgaaatcattcaccgaagcgacactgctctcagcgatggaacatgcctcgcgtttcgttgacgacaaggatcttaaggaagcgttggacgacgacgaatcgcattcaggcggtatcggcacgcctgccacccgtgccgaagtaattgagaaacttatccagtccgaatacgtgaaactcaagggcaaacagttgcgttccatcttgacgggacggaacctgattacggttgtatccccggagctcaggaacgtggagtacacggcaaggatggaacaaaaactatcgcaggtcgaacgtggcgaacggtctacgttagaagtcatgaacctgttcaggaaagaagttgcagggattcccaggcaagtgggggagatcgtcagactgaacggggacgccattcggccacgacaacagaatccggagacagaatcatatggactatggccaaaatgcggccaaccggtcatccgaaaaggcaaattctggcaatgctcgaccaacaaacgagaaaaacaatccgacggcacatggcagacagtcagcggatgcggctggaaactctaccaaaccatctgcagtaaaaacctcaccgatccgatggtgcgaactctgctcgaaaagtaccagatccacgtcaacggttccacctcacaagccggtaaaaagttctccgcaagcctgattctaaatccggacaacacggtcaaatttgatttcagtcagcgaagatatttgcgaagataaataccggatggtgaggcggggaagaaagtttacctccgcacctcaccatccgtttggtatctagttctgaatggtctattctaaaccgattgaatcaaatggtttaattttcttcgtcctcgtcttcgctgccctcgtggagttctgccttacctccaagcgaggctagcagtgcaagtgcgagtactgagaggagtcccgtcagtaaggctaaaagtttatatttgaacttttttgtttcggtgtctttgtttcctttgagttgaactatcgctatcatcttatcgatgattttttctttctgttcgaatgatatgtcgctctgttcagcgaggcttgccagcagtgcaagaattacgtcgcaggattcattaaatgatttaacattaccctgatcctctttcagcacttccagcatggtttcttggaagcaagacataacatctcttgtggtggcggcgaattcagggaattgcaacaatgcagtttttgcgacttgcggatccatgtttggcaattccgacgcgaatttcatcactttgtcttttgacatatgtcggaaatcggggatatccagaatctccagcacctcttgctcagtcaattgttttccggccataaaaacttctcatagtgcgctgacaaactttggaaactatctggcatgctgatactgcgacagtgggggtgaagctacctctttcgcttctgacgagcttccgtgtcgttttgtggaagatcgtcatcgtcgaattctcccatataagtcacatcgtgatattgctctccatcgtattcgtaaccagtatatgggtagcctcgttgtgtggttccctgatatggtttgaactcggcttctgcctcttccttggagtagaagtcagagtcgaaccagactccctcttgctcttcgtcccagccgatttttgtggctttgaaaacgtgtctcatttcatattcctttcagttgttgtagctgcggaagtcttcttcagagtcacagatggaatctgaagagatactgttcttatggccgcattcagtgcatttccatacgtagtgatggtcatcaaaacccgactagctgttcagctgtgcattgtagcgatcacaataccagtcgatgcccggaaatctatcgttcatggaactatccatcctttcctcagaccgttcgcggaactgtatccgtcgttggatccagcttcgttgcttaagcgttccgtactgtcaagtatggcagagacggtgtgaaagcattgaaaatacattcgacattgcggtgtcaggcgaatttcgatcctcgctttcgtccaatcttttgtgtcattatgccgcagctgttatagcgttttttacggtgccaactgaatttgtgagatggcttttgaacttaattgtgcagtatgaaggcatgttgctggctgaatttcttcagctggtttggcgtgatgagcgcgtgattcgcgtcgatgatcttgtaatcggattcgttccaccaggctgcggtctttccggcggtcccggattggacggctaaaccagaaatggttgtcggagcattgtgcgcgatggtcgggtcgaacagtcctgtgacgacggtccggcccagttccgtctggtgcgtgttcgtgccggcacagcggtacagtctgtttttgaggatgatgtctcctgattgggaaagcagcctgaaaacctcgtctatcttcgggtcgtctaatttgctatctagcttcttgtaataggtcgccagatcgccaatccaggtgcggcatcgttccagaacgtgtttcggtgtggtgccgttcttaaagaatccagcgaaacgctcattaaatcggccggcgagaccatcgtgcgtgaggtcgaaaccgccaaaagggaaaaaggagaagcagcccatcgagggcatcatccgcgaccacctgcgtggcttctcccgtacgattccatcgttcctcatggcctacggcgacgagaacaccaaactggagaatttcgaccggatcattccggaaaacgtgttccaggaagtgactagcatcacgacggaccagttcaggttcctgcgtgacggcggcgactatgtggacgaggaaaccggtgggaccgagcaattcgacggacacctgttcgacccggtcgtgttcgacgactccgtgaaggagtgcatccaattgcggcacagactcgccaactacttcgacgagaacctacgggaggacatcttcgactacgtgccgccgcagaagaccaaccagatcttcaccccgcgtcgcgtggtcgtgcagatggtggacatgctcgaacaggagaacccagtctgcttcgacgatccgacccacacgttcgcagacctgtacatgaagtccggcctgtacatcactgagattatcaaacggctctaccgcaacgaaggcatgcgcgatgcgtatccggacgaccgcgaacgcctcgaacaccaagtgtacggcatcgcgcccaccgagatcatctaccagatcgtgacccactacatcctcggatgcgacgatgaggtcggcaacggctgcaagacgcatttcgtcaaggccaacttggccgaactcgccaagaacggcaagctctccgaatacgtcgaacaggtcttcggcgacagtctaaacgactgaaaccgctggtcgctcagtgttttacagccaaggtctgctgcagcgtatgcgaatcgtgtggagacacgacgaccgcgcaatcgcgattgttgaccgcttccacgcagacgaagccgcgccattcgccctcatccaaatcgccgatggcgtttccggcttgttctcccggattccataccacggtctgcgccgcaccctgcttggcgacaatgatggtgcgctgcaacacggggtcgcgcagctcaagcgtatccgccgaatagtagatgcggtcaaccatgccttggaaggtcactggttcatcaccttggctgcaacggggatcgccgtccaatacggtatcgagataatcggtgccttccagcccgcacacctgcgactgttcggcgtctccaacctgcagatacgtatgcagtgcctcttcgtaagacaatggctcgtctccatcgttatatacggtaagcgacatcgtcaactcacagccgacttcaatggtgtaaacggcatgaaattgaggattcggtccagaaacaaactgggaaagtatatctgcgttgatctcgctggaatccaatgtatagcgcaacaaggcatcggaagaaccttccttgtcataatgccagaagctattgcgggcaaaaccatgcttgggcttcttcgaagccacatgcccgccttcgaaaccggaattgaaccaagggaaaataatcggaacaccgccgcggatggcagttccttccttaagatgaatcgcctttggccgccaaaccacagtctgttcgccggcaggtgcccaggaaagcacatgcgcaccgtaatcgctgactgatgccgttgcgtcttcgttgacaatatctctgatagtgaaagtgctactcatacgaccagtataaacaagacaacgttgaagcgggattgtggaaagaaggactttgcaggattgcggaatttcttggatttttcggctttgcacgtgaaggaaaaagaggattgcggcaacacgcgcttgtaggcttctgctagtatcatccatgaaagtacaaggaagatagccggttcgttccaacttgcgtggtggaaggtgaatcaaggctgtgaaaagctgaagatttccagaatccgaacgattgcaagtaacggcatcgaatcagtccaggaccaggttggggtttgtgagaccggctttgggtgtgacagtggaaagagaccgacatgtctgcagaaaagaccacggaaccggacgaagtgctcaccgacgatgaacttcaggctgccgcagcgcctgagcagtccatcgaggaagatgacaaacctcgcaagcgtaccgtcgtcgtggccgaagacgaatccgtgaaccgtatggatttggttgccatgctggaagatagtggctacgaggttgtgggcgaagccgctaacggtgaggaagcagtcgaattgacccgcaagttccgtccaagcgtggtatgcatggacgtcaagatgcctcgtatggatggcatcgaagcggcgggcatcatctgtgatgagaatatcgctccggtcgttatgcttacggcattctcccagtccgatctggtcaagaaggccacgggtgcaggtgccatggcatacgtcaccaagccgtatgaggaatccaagctgcttccggctctggaagtggccatgggccgtttcgccgaaatcaacgatctgctcgacaatgtggagcgcagcgaatccaagctgcacgaaaccgaagagcagctgaagaaggcggaagagcagctgaagaaggctgaggaaaccctcgaggaacgtaagcttgtcgaccgtgccaagggcctgctgatggataaggctgacttctccgagcagggcgcgttccgttggattcagaagacctccatggaccagcgcatcccgaagaagcgtctggctatggccatcatcgccaagtacggtgatcagaagtcggaagcagaggatgagcgctaacacagcaactgtggaaggcactacgcgcgggacgctattggtcgttgacggccattccttggcgttccgcgctttttttgccttgcccgtagagaatttcagtacatccgcaggtcaggcgaccaacgccgtctggggcttcgccaccatgctgtcgcaggtgatcgacgcggaacatccggatcatcttgccgtcgctttcgatgtcaaaggcggtaccttccgcaatacgatgctgccgcagtacaaaggcacgcgagatgcggctccagaagatctattgacccagctgccgttgattcaacggatgctgacggcccttggcgtcacattcatcgaaaaacctggatacgagggcgatgatgtgatcggcacgttggcaagcatgggagacaaagcaggctatcgcacgctggtgctatccggcgatcgtgacgcgttccagctcatcaacgacaacatcacagtgttgtatccggggcatcatttcaaagatttgaagcacatgactcccgacgcggtggtggagaaataccacgtcacgccggagcaatatccggatcttgccgcgcttcgtggcgaaaccgccgacaacatccccggcgttcccggcgtgggcgatggattcgcggccaaatggatcaacctgtatggcggacttgaccagattatcgagcatgccgacgaaatcggcggcaaaaaaggcgaggcgttgcgggccaatatcgatcaggtcaaactgaatcgttccgtgaatgccttggtgcgtgaccttgaccttggcgtgtccatcgaggatttgactttcggtcaggtggacgccaaccagctcaaccaactgttcaccagacttgaattcggcatacgcaccaaaaaccgtgtgctgagaacattcaatgcggggaagcccaccaacgatcccgtgcagcaagacgagtccggcaagctcgaaatacctcagtatgaaacggttgactcgccggaagcattggaagcatgggtacgagacaatctgccgatgccgaacgggcatctgcatgacgaacgtgaaatcgcgccgaagacgactccctccggcttcgccattgatcatacgaagcagtgtgcgcagtccgtggcgcattcgtgggtgttgcaggtggaaggcgaaagcaagccggggaacgcggcctatgcgtcgctgatgatcgctgcacatgataaagcgattcgtaccaatcgtgttgaccgtgacatggcgtcccagctgcaaacggtacttgacgaacaccaccaatccatggtggtgcatgggtataaggaacaatcccacctgctggaaagcgtcggtgtggcgttgccgaagccgctgttcgacaccaagcttgccgggtatctggtccatcccgatttccatgccgacacgctggaacaggcggcggcgcatttccttgacctgcatatcgaggaacagtccgagggcgcgacgcaaggcacgcttgatttcgacgagccggacgatagtgcgcagcggaatgacaaccagcttccgcgccatactgcgattgttggtttgctggcgcgtaaactggcggattcattggatcagcgtgagcagttctcattgcttgaatctgtggagattccagtatcccgtgtgctgtatggcatggagcatgccggtgcgcaagtcgatatgaacaggctgatgagcatgcgtgaacagcttgccgccgacgcgaattacgcgcaggaaacggcatggcagtatgcgggcgagcgcgtgaatctgcaaagtcctaagcagttgcagaagattctgtttgaggatatgggtttgaagcctacgaagaagactaagactggttcgtatactacgaatgcggctgctttgcaggtgttgcgtgatcgttcgtatggtaatgatagggcttgtcagtttcttgatgcgttgttgttgcatcgtgagaagaataagcttaagcagattgtgcagacgttgattgatgcgacgaacaggtctgatggtcgtattcatacgacgtttgagcagactgtggctgcgactggtcggttgagttcggttgatccgaatttgcagaatattccgaatcgtgatcctgctggtcgtgagattcgttcggcttttgtgcccggtgagggttttgagtcgttgttgagttcggattattctcaggttgagttgcgtattatggctgatctttctggtgatgaggcgttgattgaggcgttccgttccggtagggattttcataagtatgtggcgagtttggtgtatggcgttcctgtggatgagattacgtctgatcagcgcagtcatgttaaggcgatgagctatggcttggcatatgggctgagcacgtatgggctttcgcagcagcttggcattaagccgggtgaggccgagtcattgaagcggcagtattttgcgacgttcggcaaggtccatgagtatttggagtcgttggtttcttcggctcgtgaaaagggatatacggagacgatttatggtcgtcgtaggtattttccgggcttgaagtcgccgaatcgtgcggtgcgtgatgctgcggagcgtgccgcgttgaatgcgcctattcagggttctgctgcggacattatgaagattgccatgattcgggctgatgatgcgttgcgtgaggctggtcttgccagtcggattattttgcagattcatgatgaacttgtggtggaggttgcgccgggcgaggcggagcgtgtcactgcgttggtgaaggatgccatggagcatgcggtcgatatggcggttccgttggatgtttccacgggtattggttcggattggcagcttgccgcgcactgatacggtactgggtttcgtgtgtgttgcggatgtgcgtggtcgagcaatggcataaggaggaatgatggcaacgctgaagcaggttgtggatgtgctggaaacgttgtatccgcttcgctatgcggagcagtgggatgagcctggtcttatcgtgggtgatttgcgtcggcctgtgcgcggtatcgcttttgcggctgatccctctatggcggtggttgatcaggcgattgccggtggtgttgatttgctggtttgccatcatccgttgttcttccgttccgttcatgcggtgtcgggattgggtttccgtggtgagattgtgcgtaagctcaatcttgccggatgtgcgttgtgggtggggcatacgaatgccgatgcggcgtatcgtggcgtcggcatggctgcggctgacatgtttggtttggtggatcagcgtccgctggtgcccatcgatgatccggatgccgagcatccggtcggtttggggcgtgtggggcgtcttgccgaacctgtggcgttgcgtgatttcgccagtcgagtagctggcgcgctgccgtacaccgagcttggcgtgcaggtttgcggcgatctggacgttccggtcagcacggtggcggtgcttccgggttccggtgattccttgttcgatgaggtgcgtgcggctggtgccgacgtgtatgtgaccagtgatctgcggcatcatccggtgacggacgccatagagcaggcccgctatgaggcttccatgcgtgcttccggcgttgccatgggccatggtgacgggcgtgtgcgtccggcgttcgtcaacactccgcacagcgccatcgaatccatgtggttccagtatgcgatggaagacgttccccatgcggttgcggaagcgaccggcgacattcccgacgtgtgttggatttccatgaataccgatccatggagtatggttatcccttcaagcggacaggaacgatgacgcgtcatgagtaatgaagcggcagacgaaacccaagttgatgcattgctagacaagtccagtgacggagtggacatgtccggcacggtaacggtgcttgacagcgagcacgtgtaccgaggcgctatcttcggtgtcgacgacatgcggatcgcattgccgatgcgtggtggcgggcaaacggtgattcgccggcaggtgatgcgccacgcgccttgcgtggtcatgctagtgcatgattgcgcgaacgaccggtacctgatcgaacgcgaatatcgtatcggttgcaacgccttcgcctatggtctgccggccggactcatcgacgggggagaggacgttgaagaggccgcgctgcgggagcttcgtgaggaaaccggtgtggagcccgccgggcgtgacggtgtcgaattcgaccatgtggggcagttttactcgtccgaaggcatgaccgacgagcttgccaacatcatggtgcttcacctgcatgcatggcatcccgtcgaacgtcatttcgacggcgatgagcacgtcgaatcggcgtgggtctcctggcagcggctgcgcggcacccgtattacggcctccaattccatgatcgctattcttcacgagcaaattcgacgaaaccggcaaaatacaggcaagagttctttcgaatcgtaaaaataatcgccgaacaacacgaaattgcgatttgggggctgaaacgtgagatacttgaatcatgcaaatcagacccggatcgatgtatccactcggcgcaagctatgacggcgccggcgtgaattttgccctcttttcccaagtggcacaaaaagtcgagctttgccttttcgatgaggaagacaacgaaactcgaatcgaaatgaccgagcagaactcttatgtctggcacaactatctgcccggaatccaaccggggcaacgttacggctatcgcgtgtacggtccatacgacccgacgcaaggcctgcgctgcaacccgaacaaattgctgcttgacccctacgctaaagccatcgaaggcaacatcgacggcgatgagagcctctactcgtactggttcagaagccccgatgacgttaccagcatgaacacgctcgactcggccgcccataccatgaaagcggccgtggtgaacccctatttcgactggggcaacgaccagcatccgaacatctcatatcacgattccgtgatttacgaagcccacgtacgcggcatgaccaacctcaacatggacgtgccgccggacattcgcggaacctatgcgggtctggcgtacccctcggtaatcgaatacctgaagaagctgggcgtcacggccatcgagctcatgcccatccaccagttcgtcaatgacagcttccttcaggaaaaaggcctgagcaactactggggatacaacaccatcggcttcttcgccccgcacaacgcgtattccagctccggacagcgcggcgaacaggtcaacgaattcaaatccatggtcaaggcataccatcatgccggcatggaagtcatcctcgacgtggtgtacaaccacaccgccgaaggcaacaaccgtggaccgaccctcagcttcaagggcatcgacaacggcgcctactaccgtctggtcgacaacgaccgcagacactacttcgacaccacaggcaccggcaactcgctgctgatgcgctcgccgcacgccctgcagctcatcaccgacagcctgcgctactgggtcaccgaaatgcacgtcgacggattccgattcgatcttgccgccacattggcccgtcagttccaggaagtcgacaaactgtcggccttcttcgacatcgtcgaacaggatccggtgatctcccgcgtcaagctgatcgcggaaccgtgggatctcggctctggcggctatcaggtgggcggcttcccgtccagctggtccgaatggaacggccgctaccgcgattgcgtgcgcgacttctggcgctcgcagccgtccacgttgccggaattcgccagccgattcatgggcagttccgacctgtatcaggtcaatggccgccgaccggtcgcatccgtgaacttcatcaccgcgcacgacggcttcaccatgaacgatctggtgagctacaacgagaagcataatgaggccaacggcgagggcaacagggacggtgaaagcaacaatcgttcttggaactgcggtgtcgaaggtcctacgaccatcaaggatgttaacgagcttcgtcaacagcagatgcgcaacatgttcgccacgttgctgctcagccaaggcattccgatgatctgcggcggcgacgaagtggcgcgcacccagcagggcaacaacaacgcctactgccaggacaatgcgatctcctggacgaactgggatctggacgaggatcaaaaggacctgctcgaattcgtatcgaagctgatccatttgaggcttgagcatcctgtgctgcatcgccgccgcttcttctccggtcgcgagcagggagacgacagcactgcgattccgcaggtcgaatggatggatcataccggctccattatggatatggacgactggtcaaacacacacgccttcactgtgatgatctatctgaacggttccgatattccggaaaccgactggtacggcaatcagatggtcgacaatgatttcattctgattttcaacgcgcattacgagccgatcatgttcaccctgcccgatgagcaatatggcaagaaatggcgcttaattgtcgacacgcataatccaaaggggccagaactcaattatgaggccggttttgcgattactgcgcaatcaagaagcttcctgctgttgatgagcgacaagaagccgtccaacaagcactacaacttctgacggcgcactcgcgttatgccgtcagaatccagtggggtggagtcgtcgccaatgcgatggctccaccccactggtatgtatatgttgaaatccggcggttgccagtcagccttgcatcagacttgtgcggcgagcctcgaaactgtgtcgggaacagtttcgctgacttccgcaagatcctcgacggagcgtggtctctcagattgcgccagtatcagctgcgtctgcacgcgatccgcttcgatggcggcgatttgacgcgagaaaatgatgaaccagccaaggaacatcatgccggccaacgcctccacattcgtcagcgtgttatgcccgctcagccattggaatccggcataagccccaatcgcaatcgcaagatcggaaaccacgtatacgacctttgagagttgcggggcaagccaaggcagggcaatcatcagcacgctcatcaaacatggtaggccgcgggcgaacacgttgtgcaaaatcggatgcggcgtgtaacggaacatgccgatacctacgaaagcgatgccggccaacgtcaacatgattgacagcagcagaatcctcgtacgaaaatgcttcggcgtctcattgatggcattggaatccagatactgcaattgcagacgatacgtggtgatgagctcggaaacggcgaaatagctgatgatcacaatgcagatgcccgcgagcgtcagcgtcgaattgaacatacgcgcggcgaacgtcgtacggtcgcccaattgagagaaattattgttgtaccagtacggatcgtcggacgtcaatcctgcgatactcacgccagacaccacgaaaaacggcagtagggaagcgatcgttttggcattcataagttccgcctgcacgaaagtgatatagcctacaacgcctgcgatggccgcgcataggatcggcagatagcctttcagcgtgcggatgcccatcatgttgttgacgatggacaacatcatgaacgatgtgacgaaaatggtcgaagcatacaccatggaaagcgcgaggatctcgaaaatacgacggaccggaatagcccaaccatgtttgagtgtcagcgaacgtgattttcgtgcgtaacccaaactgaatgaaacgactccgcatcctgccacgattcccgcgcagacggtgaacagacgctgcgtgacacgccagatggccggggcgaactgcatgtatgcgttcatgacgaaccaggcgataacggcgcatgtcacaaaggagatgatgcctgacgattcggcctgctggtgacgtcccatgccactctcccttccgaaatgctattgtaagcctgtcgttgtccaaccatacgctataatggaaactcgtgttcacttgatgcgattccgtgaggcggattcgcggggtgtgaacgtgaacgggctgtagcgcagtttggtagcgcgtctgctttgggagcagaatgtcgcaggttcaaatcctgtcagcccgaccggaagccttggaaacatctgggttacggaaagctatttcacaggccagcagccgcagacgcggaaatagtatccgctgttcatactgccgctgaccgtgaccttgccgccagagtcgaatgacaaggctccatgctgcccgttcacaccttccagcagtatcgcgccttgtccttccggcagaaaaccggcggccatcgtctcatgcacggtcaggccgttggtattgatgtcggataagaaggacgtgttgccaaaagcgaacgccatcatgccgactttggcgatatgtaccgtcatgccgtaaggcccatgccagatttgccgttcaagggttacggaatgctattaaaaatggatttccacgattccacctgtgacagtaatttcaggaccaacgagcagattgactgttccatcaggtgcaatcgatacttggaccgaacgttgcaggtatgacgggtggatgaatggaatcgccactgtcgttccggacgacagtgtggctctgccattcaaggacttgatcgcatttgggctagataccttaccgattgggtatattccgccattactgttgccgttgccgttgccaaatgggagggttacggaatgctatcagcaggtcaatatgagtttctgccatgctttctgcatgtccttgaggacgctcagatcaggcttcaaataatatctggcggtggtttggatgtcggagtgtccgagctggcgtgcgaccacactgatgtcggttccggctttgatcgccaacgtgccgaacgtgtggcgcaggttgcgtggaggcacgcagggcagtttcatgcgcctgcaccagctgcggtagtggtttgccacttggttcgcgttcaggttgccgaccagtcggccggtcttcgtgccgtggcgtagttccgccaatcgtttgaccgcgaaccgtggcaatgcgacggtacgtcggctcagatcggtcttcggttcggtgacggtctcatggcccgccacccactgcaccgaccttttcacggtgacggtgccgcgacgcaaatccaagtcagcccattccaagccgaccgactcgcagcggcgcaatccggcgcacacggagaccagcagccacgcctccaacgcgtggccatagaagcctttcaacaggcggcgcacctggcgtgcgtccaatacccgcggctcgtaacggcggagatgcggcaaacggatctcccttctggtcacgtcgttgtccgtgacgccacgccggtaggcgagcctcagtatcgcccgcagaacggcccaagccttccgtgcggcgccagcccgcttgaacgagcctagccattcctcgatatctgatgcagtgatcgactccatctcgacaccaccccacttcgactggatatgacaacggtaggccgactcgtagcccaccctcgtgcactcgcgaagcttcccgcaggagggccaccagacctcatccacaaacgttcccaacaacattcttcttacctttcaccttgtgaaaacccacagtcggcattgttcctgcagaatgttccggcctgtgggttttcctctctcgtttttcaaaccactgttctaaaggaggacacggatgacccaaatcaatttcgacttcggcaaactcgacgccaccggcatcgtcgacctggctaacgactcgatcagcgtcacgcccacgagccgcttcgccaccgccaccaaaaagatcgtggtcgacgagccgctcaagaccgcgctcgaccagcacggcaccatcacgctgaatcttccgccgaccggaaaggactgggcctaccagctacatgtcggcgccggaacaccgcacgaattcaaggtcaccttcgacgtgccagacagcgccaatccagtcaacttcgccgacctcgtcaccgtcgacccggccacgctgattccgaacgcggggaatccgctgtccgacatcgaccaatccgacatcgactgggccgtcgatgccatcaacgcctgagtagaaaggaacgtaaatggtgaatgcagacaaagtgatccgtctgggcgattacgtccggctggaacgcgcgcagaagtccaaggacggcgcaaatttcaaatacgacgcgtcgacggggcgcgtaaccaatctcgcggaatacttcgcggcccacgcggatccgaacatctataccgtccggttcccgctctggaccacgtccaacagcacgcagggcgtgaaactcgacgacaacgccggattgtccatcgtcccgtccaccaacaccgtgagcggccgcgacgactaccgctcccttccggccttccgcgtgtgggacgtcaacggaggcgtcgacgacgccggcaatccgttcgtcacggccatcaaggacaaggccggcacatggtccgccgacggctcgcatggcgacgcgctcgtcatgaccgccacgggcttctaccggctgcagctcgactcccagtacatgaccctcagctacagcggcgtccaatacgacggcttcgtgcccatgcccggtgccatgctcccagacggaaccctccgcccgtgcatgctgttcgccaaataccgcgcatggtgcgacggctccggcatcccgcactccttcaccggcaagcagacgtccaccgccttcggctcgcagaacggctgcatcgatcaggccgcgaagaaaggcaagggctggagcggcaagaccgtggccgacacctggtacgtccagctcatgcacatgctcaaatacgccgaccgcaacatcgagaacaccctcggcggcgacttcggaggcaacgggcagatcaccatcagcaaggccgaagccagcgtcaccagagcgctcgtcaagacgaccgacgcgcaatacatcgacgtcggctcctatatttccgtcggctctggcaccgaccgaggagacccgaaggtaggagaggcggcatcctggcggaaggtcctgtccaagaccgtcgtggactccgtcaccgccgccatcaacgtggccggcagcaaattcacgaccacgaccgccatgcacgtcacccagatgccatggccgaccggcgccaccgacggcgtgctcggcaccgacggatacgccaccgacgcgatcccgcgcagccaccagcccatccgcatccagggcatcgagatcttcaccggcgtctacgaggtcgaatccgacgtcatcctcaacaacgtcaaggactccgatacagccggccacaccgagatctggaaggtcttcgacgtgaccaaggcgtccaagtcggccatcacctccgactatgtccacctcggcgatttcccggccgtcaccgacaagaccaacaacaactggcagtacgccaagggcttcaccttctcccacggcatgaccatcccgaccgagtggggaggcaccagcaccagcggcctgtccgacgcgacgctcatcaacccgatcagcaatcccggactccacgagctccgccgcggcggctatctcgacggcggttcgcgctgcggcctgttctgctcgtgctgctgggactcgctctcgcgcgcgtggtggagctgcggcggccgcctatcgaccctcggccggacgagggcgtagcccgaatccggtgggggtgagcgaagcgagggggcgacgccccctccattcgcccaccgattcatttggggattcgtgacgacaccaccggaggttccatccgtctccgctccaccgcggcggcaatctcaacgacggttcgcactgcggcctgttctgctcgaactgcaggaacacgctctcgaacacgtggtggaactacggcggccgcccatgaggacagcaaaaacaatcattccgccacgactacctcccgcacgggaagcgaggaggcacagccccggccagttccgaaaatcaaaccgagaaggcggccggtagacgcatcgaaagccgccattgtccccatagcttacaaaaggacgaaaaatcaaaacatactgcaaacacgcgccggtcaccgatccggcgttcgtccgggaatgcatcgacgcctgcctgaaaggcaagggacaccggagggacgccagacgatttatcgaacgccatccggacctcgaccgatttgcccgcgaggtcgccgacgacatccggaccggcaaattccacctcccgccgatcacataccaccggcacgtcgagcccatcagcggcaaggtcaggatcatcggcagggagaccatcgagcatcagatccacgactacgtcgcggcccgcgcgctcatgccgctgttccacgcgaagataggccgctggcagaccgccagcatcccgggccgcggcatcaacgacgcgcgcaaggccatcagaaaatgggtgagggagcgcgatagcagggtcttcgtcaaactcgacgttgtcaaatgctatccgtcgatcgaccgtgccgtgctcaaagcgatgctcgcccatgacgtcggcgacaggcgtcttctgcggctcatgttcgcgctcgtcgaccagtaccgcggagaccgtggcctgaacataggctcgtatctctcgcaatggctcgcgaactattacctttccgcggcatggcattacgccgagggatctctcttcgccgttagacgaagccgcaggaggcaaggcgaggagatacggcgccgtctcgtcatgcacgtgcttttttatgccgacgacatactgctcatcggccggtcgaaacgcgacctgaccatcgcggtcaaacgcctccgccgcttcctgcgtgaccggctgcatctcgagatccacccgacctggaacgtcaagcacatcggagcggagccgatagacatggtcggctacacgttccgtccaggacgcaccggagtcagaccggccatattcctccgagccgaacgcgcctactcccgcgcagcgaaacgtccgatgaccatggccatggcgcgcaaatgcatcagctactacggatggctctaccactccgacagcgtggcgttccgccgccgccacgacatcgacaggattttccaccaggcgagacacgtggtctccgccgccaaaacaggaaggacaacacaatgatccagaaggtatcatcctccgagcaattgcaggagctcgactaccacgcccgaggagacggaacggccgacatccgcatccgcaagaacatcaagcaggtcacgcatgaggccaccgaccagacgcccgcatggagcgaatggaccgccattgaatcctaccagatgctcccattgcaggagcaggaggccgtcgagcaggccgacatgctcttcgaaggcgacgtcaccagctcccagccggtgctcgaccgaatcacggcgctggaacagtcctcactggacaacgcccagcttttggccgacctcctcgccgatgattccacagatgactccaccgatgattccgcagataactcggccaaccacacgccgtccgacaccgatgtggccgatgacaagaccaccaccggccacatcgattccgtcgacacagacaaatccggaaaggaggagtgaccatggccaaagtcaaccgcgcggcagccgtccgcatgtatgtcagactcgtcaaggccggacgcatggaattggacgaagtgcccgagagataccgagacgatgtgcagtccaagcttgacccctgggatgactgatgccaccgcttttttcaagcacggaattctggacgtctctcatcgttgccctgatcggcggtggaggagtgggcgccatcatcggcgccatctccggcagacgcaaggacaccgcggacatcgccgcgaaggcttgcgacatcctcaccgattccgtcatcaagcctttgagggaacaggtcgagtcgcaggaggagcagattcagcatctggaggtccagcagcgcaaatacttcgcgctcacagcttacacacgctcgcttttccactggcttcagcagttctgcgagatcgtcgaaccggacttcctccaaagacatccgaaaccgcacctgccggacgagctgcgcgccgacgtggcgcccgagaccgtggaggactcatgaccttcgtcatcgcctggatcggtctcgccgcgctcgtcctgcttttcaaccgtggtgcccacatgtgacgccgccataacccatgaaaccccacgtgaaaacgtggggtttcccgtttatagagaaaggaaaagaatgcgcaagcacaagccacagtggctcaaacgattccggctggcggtgaccggcgtggtcatggccatcgccatggtcgtggcgccagccgcgatggccgacatgaacggatacgacatttcgaactggcagtgcggcatcgacaccgcgagcgtgcctgccgatttcgttgtcgtcggcaccacgtggggttccggcggcgtgtacggcggatgcctgtccaacggcgtcaacaccgacgctaaccgtcagctcgccggtgccatcaatagcggcaaggagacgggcgtctaccattacgcgcgcggcggcaacccggagaccgaagcccggttcttcgtcgacaacgtgcgcggatacgtgtacaggagcgtcctgatcctcgactgggaggcgcaggacaacgcttcctggggcgacaagcagtggccgcgccgctgggcgcgcgaggtcaagcgactgaccggcgtgaacccgatcatctacacgatggactccgggtactggcaggtcgccggcatggagaccgaactgaactgcggcatctggatcgcacagtacgccacgaacatggtcaccggataccagaccgcaccgtggaacctcggcgcgcgcggcgaggtcatgcgccagtacacgagcaacggcagtctcagcggctggtcagggcgcctcgacctgaacaggttccgcggcgaccgcgcggcatggcgcaagtacgcgaaccccgacgacaagggcgcggcgagcctgccgaacgtcaggccgacgccacagcccacgacagcgccgacggtcgacctgaacgctttggccacgcgcaccatccgcggcgacttcggcaacgatccggcccgcaggcaggcgttgggtggcaattacgcggcggtcatgcagatcgtcaacagtcgcctcggcggaggttccggcggaacggccgccacaggttcgcgtagcgtcgtggtccgttccggcgacaccatgagtgcgatcgccgcgaggaccggactccagccggtgtccgcctggcgtgtaccgagcggtgacgtcaatcggatctatccggggcagaccgtcacctatggcggcgcgtccgcgtccaccgcttcgagcgtggtcggaggccatgtggtccgttccggcgaaagcctgtggagcatctacggctccggctggcagtcggctgccgcacgcaatggcatccgcagcccatacgttatctatcccggacagtacctgcgctgaaactcccgtttccacgactttaagcgttgtggagacggttgccgcaatgtttaaggaggtgaaaaatggatgaatccaatagcccgcaatccgattacctgctgccgggcagggtatacgacatactcaagtggctcgcgttgatcgctttgccggccgtcgcatggctcgtcggagcggtcggcccgcaatggggactgccacactgcggcgaactcgttacgaccatcaacgcgatcggtttgttcgtcggcgcgctcatcggcgtgagccagctcacgtctgtcaaggccgacgaggacggccagtgattaattttctgacgtgagactcgaactcgcccctctctcagcttctatgctgtgggaggggccttttcattttccgatggaaggctgcgcggttcgaccacatcgacacgatatcgacacgatgacagttgcgaacagttaatttcaacaaagcgaaccactgcgtatcgtattgtcacgaacgttggaatttcaacgttcttgacaatgctcacacccggctacgctcagtcatgccatgcccgaatatagcagaatgtcgcaggttcaaatcctgtcagcccgacccccgcggtctcaaccttggcaaggttgcgctttaccaactaagctatgtccgcaagttgtttccaccgtggtgggcaacgagtagaaaatatacatgaagcatgccaactccgcaaatcgcggcgtgtcgcgctattttccaacgacttaagccgatgttatgccatggttcgcggagccggtgccaacgatacaaccggcattccgaccgatatcgcccctggtgcgtcctgttgccacatgccttgccgttccacctttgcgtccccgttgctttcttcgccttatggcaggcacccattatccaaccacggcggataaagcaaatgtcgttgggggcgtaagcggttgacacggattgaaagcgactaggcgtcccactgacaacgggcgagatcgactcgcagtccggaagctccggcgttcgagtctttcatcttgcctgactcgcttagttcgggcatacctttcggagagatgaagacaacgccttcctcttcgagcagaagccgctgtctttccggaccgccgaacgcgaatccgggcgccaacgagccgtctcggaacaccacacgatgacatggaatcacacccggctcaggattcgaatgcagggcatagccgacaaaacgcgcgttgcgtggcgctccggccaaagccgcaacctgcccataggtggcgactttacccttcggaatgcgccgcaccacctcataaacacgcctgctgaacaatcccttctccattcgttgtcccattcctcaagaaactagtcgaggatgacgccggcggagagcatttgctggcgggctgcgatgccgagttcttcactgaccggttcggtcaggctttcgatgacatgcacttcaagtccaagcttacgggcgtccagcgcggtttccttgacacagtgcgattcggccaagccaaccacgtcgacgcattcgatacccgcggattccaatgcaacggcaagcgtacgccctgtagccatgtcagaggcgacctgttcgcaggaaggaatcgaatccgtattatcctcgtatccttcgaaccccgaatatgacggcgaatactgtcccttcttgaaatgatgctctacatgcagcgcggcgatcgctggatgaagttcggcgccgggagtgccggccttgccgtgcacgggccacgtatccacatagtcgggttgctccgaccagtgtgagccgggctcgatatgccaatcctgcgtggttgcgatgtattcgtactcgccgcgatgcgcattcacgtaatccgcgatacgttccgcgacggcattgccaccggctacacccagttcgccgccttcgcaaaatgtcggctgcacatccacaatgatcaaagctttcttcatgtttgctcccttccgaatttgcctgctcaccagaataatctgattgttacgcttccgcgcaatctattccatttgcgattgcgtaccacgcggtgggattcacgtggttacaggcgttcggtatgatgttcgattggcgtttggccttatgaaatgatgggcaggccgttatgtgcggcacagccagtttggaacgacagtaacgaaagtgcagaggtgttgaggcatggcaattgaagcgcaggagcttgagattcagatcggcgcgcgcacgttgctgcatcccacgaatttccacgtcgccaagggcgacaagatcggtctggtcggacgtaacggcgccggcaagaccacgctcacccgcgtgatcaccggcgacatgctgcccaccgccggcaaagtgcgtgtatcgggcaagctcggctatctgccgcaggacacgcatgctgccgatccggaacagaccgcgctcgaccgcatgatgagcgcgcgagacatcgcttccatcatcagtcgtatgcgcaaggccgaaaaggaaatgaccgacccggatccggacgtcatgacccgagcgatgaaccgttacgacaaggccatgcaggatttcgaaaaggccggcggctatgcggcacagtccgaagcgaccgcaatggcggcaagccttggcctgccgcaggaggtcatgggccagcaattgggtacgctttccggtggtcaacgccgtcgtatcgaattggcccgcatcctgttctctgacgcggatacgctaatccttgacgagccgaccaaccatttggacgccgactccatcgaatggttacgcggatacctgaagaaatacgagggtggattcctggtcatctcccactccaccgaactgttggacgaagtggtgaacaaggtatggcatctggatgcgcaactcggacagatcgacatgtattccctcggttggaaagcctacctgcatcagcgcgcggttgatgaggaacgtcgccgtcgcgaacgtgaagtggccgagaagaaggcggaacgcctcatgcagcagggtatccgcctgcatgcgaaggcgaccaaggccgtggccgcacagaacatgatgcgccgtgcggagaaacttctcgagaccacgtccgaggcacaaaagcaggagaaagtggcggatatccggttcccggagccggctccgtgcggtcgcacgccgatcatggcgaaggacgtttcgaaagcctatggttcgaacattgtattcgccggcgtgaacctagctattgacaagggctcgcgtgtggtgattttgggatacaacggtgctggtaagaccaccaccctgcgtctgctcgcgcatttggaagagccggacaccggttccgtggactacggtcacggctgcaaaatcggctatttcgcgcaggaacatgacacgcttgacctgaatgccacagtgttggaaaacctcattcatgtggctccggaactgaatgatacgcaggcgcgttcgattctcggctcgttcctgttttccggggatgatgcgttgaagccggctcgtgtgctttccggtggcgaaaagacccgcttggcgttggcgacattggtgacgagccgtgcgaacgtgctgctgctcgacgaaccgaccaacaatcttgatccggcctcacgcgatgagatcctcaaggccatcgccaagtatgagggtgccattgtgctcgtcacccacgatgagggcgcggtgcaggcattgaacccggaacgcgtgctgctcatgcccgacggcgacgaagacctatggaacgattcctatctggaattggtcgccgaagagtaagccgagtaattcgagttttattcggattgtatttatgccggacgcgaaaacgtccggcttttttctttccacatgcgtttcgagcacgttcggtatttccgtatttgtcttggggtctgcgaacaatctgtgatttgcaagcggccccgactcatgaatcgcatcttgcatgcccattgagggcttgagccgattcgtttgccaggaagtcgccattgcgatcgtccgaaccttttcggatttcgttatgcgccccctagccttccgcgctcctgttggaacatgacgtgcggaacagaccagaggggccgatgcagcaacacatcgaacgcatagcgaaaggaagttccgtgccacgtaacggcaaggagggcattctcttcagtttcatcatgtccgcgatcatgatttatgtgatggcggcactcaattacggcgtacgtatcggtgacgtcggtgcggcggcgtggagctacgcattgttcaactggccgttggcctacgtggtcggcatgatttgcgatttgtgcatctgcacgccaagctcccgcgcgattatgaatacattctgcgcggcaaccgaccgtgcggtatggaaaggcatcacggtcaaattcctcatggtggtgctgatgaccgtattcggcgccatcatggcattcggtttcacattcggcgcgttcacgggattctggcgcatgttccccaatttcaccatcgcgttgccgattcagatgctgatcgtcgcgccattgtccggcaagatagttcacgccatcggcgatgccgccggatggaacaagtccgcgcaacagcatgttcccgctttggatgtcaagaccgttgccgatgtgatgcagcatgacgtttacacggtagcctcggatgccgaggtacgtgacgcagtgcgcatgatgttggaaaagaacatcagcggcatgcctatcgtcgatgacgaacgccacgtggtcggcttcatctccgatagcgacgtactgtgccgcttcgcacaagacaacgcgccggtttccgacatttccacgctggtcactggcatggcccgcggcgaattcccggaactgtctcacgcagaaccgcttgatatgaacgtcatggttattgccgcaaagccggccgtcaccgtgcaatcggatgccaatatcgcgcaagtctgccaaatgttcggctatcaacagtacaagaaagtgccggtggttgaacaaggcaagctcgtgggcgtcgtcaaccgtggacgcctcacccgccgttccttcgaagcatgccttggtactgccgaatagcaattaaataataactaaatactgcaataagtggagggcgccgaatctgtcaatcgacgccctccactgtttatctcattccttattgcaatcaaaccgaatcatgcgcgatatgcgcaagccttcaccggcttcgcttggtgagcggctcccaaggttcaagctcgaccggctgatcggccagtatttcgcgtgtggtctcatcgagatactccttgcgaatgatcagttcggtaacataacggtcgaaccaagcatcggacgccacataatagccatcctgaccattatccttgccccaactgttctccaccttccaacggttcggacgcccgtcagcatccaaattcacgccagtcaacgtcatggcatgattgcttgggcaatcaccatactccaatcccttggccttgtcgaacgtgaatttcgtaccgaaaagctggtcaacgcgcacggtatcgcaatcaaaatagccatcgccacgcaacgagaactgcatgcaatcacaagcgaaccaaatcggatgaccaccactgatctggtccacagcagccttcttgaacacgtcaagaggcacgttcacaaactccatatcacccgcttccgccacattggcggaaaaacgaatacgataccgcttgccaaacggacgactctccatcggcacattgcataacgtgaccagatcgttcacatccaccggcacgtacttcttataaaactccatcggagtgataccgaattcacgaatctgcggacgctcatccttaccggttttcgcagccttttcagacggcccctcccccgtggttttcttcttgccgtcatccttgtcatcgctcgtacgcgcaagaaaatcaaaacgctccggaggctcacccaatgcaatcgcacacatgcgatacaccgtagccatatccgcattcttcaacgcacgcaactcatccaacgacgttccagccgcatgacggtcacgcaaatcggacgcgaactcacgtagcttcgtattcaaatactgcttgaacgcatccgaactcttcgaattagtcgactccggataagcactcttcggcaccaaaccatacttgttcaccaaatcagcgaacatctgccaccaaccaccatcatcggccggaccataattaatcgcctcgaacacacgactatccaacggctcatccaacgtggcaagcacattctccaaatacgtgttcgacttctccatcgtatcccagaaaaacaggtaggtttccgaaaactcgaaatcctccaaattccaacgatgcatcaactcataacgcaacgtattaagcgccgcaaacatccaacaacgccccgaactacgctgattggtgatactcccctgcttcagctcgatggagaaatcattctgcagcacgcgctcgcccttatagtcggtggctgcggcgagcacaccggatgatactgccgcgttggctgccaccagattggcgcggtcagcgttgaagtctgtggaatactgtttgagcagcgcagggtcgagtgctttgacgtcactcatggttcatggtcctttcgatatgttcgatttcggattctatgtcgcgcaggcggcaacgcaggtcggattccacgtctacgccgtcacgttgcgctttgcggatgatggcgatgatttcgtcagcgtaaggatgatcgccatcatgctgttcgtccatttgacttgcgcttgttgtgaatgctgtttcaagctgatcgcaatactgcgatttgtgtactctcgatacgatttttgtggcacgcggcaatgcgccttgcgcatgggagatgccttcgagcacagacttgcgatgcttttccttctgcttcatcgcttcccacaatttcaacgtatcttgcgcattttccggtgccggtacggaatcgtcggcagcatcgtccgtttgaaagacgtgcggatggcgggtgatgagcttgtcgacgagacggttgcacacttcgtcgatattgaatggatcctgcgcatccacggcgcacacttgcgcttggaaaacggattgcagcagcatgtcgccgagttcttcacgcatgttgtcgcgatcgttcgtttccacggcgtcgatgtattcgtaggtttcttccaacagtggtttaagcaggcttgtattggtctgctcgccgtcccaagggcatccgcctggttcgtgcagaatgcgtacgacctgcttgacacggtccaacgcgctaggcgcatcgcgtacaggggcaagtttcaaacagtgttcgaattcttcgggcaactgataatcatcatgtgcggcttcagtcatgccactgattcttctcgcatgtgccgaccatgcgatcgtaaccgttaatgggcagattcctccacccactggagaatttggtgcgctcatgtgctcgtcagcgggaagaatcttccagtagctggaagattcgggacgttcacagtcacctcagcgtgctggtgatctggtcgacggtttcgccgtctttgcgtgcgacgggctggaggatggtttcgtcctcggatgcgtagtagtagccttcggcggtgacttcggtatcaccgttccatgtgttgtgggtggtgccgtccacgccggtccagcggagcgtgctggtgccggtcacgttctcgctgatcgagctgccgttacggctggtggtgaccgtgtccgccacgttctgcgtgtcgccggccttggtggtcgtgccggatgccttcgtggccacgctcagcgtgtagtccggcggggcgagctggtatttgtcgagcacgatcacgacgatgctgcgggtcgagtcgacatggcgttccatgatcttgtcgacgctgttcgacggatcgtcgctgaagccatcgccggtatggtagtgctgagagcctgcataaaggtattcatttggcgcgatgttcttgtaccagttgtccttccatatcttcgcgtcgtagacgccggacccgttccacacgctggtggtggacccgttgccggacgccgcgcccacggccacgacgcggcagtcgccgtcgctctcgcccggatgcctctggcggaagccggccacgcattccgcgttcgcgtcgctcaacgccttggcggccttgccggccgaatcgtccatggtcacgcctttccaggccatggcgcggctcacgctgttcaggtcggtcgcggaaccccacgagcccgtcgcgtcgtccttgtaggcccagaactgcgcggccgagccgcctccgccggtgcctccctggtctccgccgccgcccgcccaggcggtgccggcggtcaggcctccggccaatgtcgccgtggcggcgagcagggccagcgtctttcgccttccgttactgttcttggaacccaatgttccgtctcctttcagagattcatctgcagatgttcaccccactcccggtggggtcggacaggagaacaaatcccgtccgaacacttcacatgcccggccgtcgacaaacgtcgatatcggattcgtttccgtcatccacctgctatgcaacccggtttcgggcgtgtcgggttggacattttcccggaaggctgcggatacgaaaaagggaccccgaagggtcccttgagaagaagagtcatctaaatcagtggtgaatcaatccatcgcttgaggacggagggcagtctgtcgtgcatccgagacctccgctgcttggaacgaagtccggcacgctgctggaaccgccgccactcgatgtcgaaccgcctgaatacgagggcgtgtacgactgttgcggcgccgaatacgactgctgcgtctgggcctgtgcggcggcctgtgcggcggcctcctcctcggccttgcgctgcgcctcctcgtccgccttcgtcttcgccgtcaccgagtcgttgaccttcttcgacgcggccgcgatcttgtccgcatccctggccttgactgccttggacagttcgtcgcgcgtcgccgcatcggcgaccttgccgtccgaattcttcaacaaccgttccgcatcggaaacggtcttctccagtttcgaatcgttcacggccctgaccgcgttttccaagctcttctcgtgtttcccgtaccagccggtgttcttttcaatcaggctggtcttcgactcgtaatccgccttcgaatcggccacgcaggcgaccacgtcaggctcgttcgccttcaacgcttcggccaacgcatccacggtcttcgcatccgccacctgcttcacggtgatctgggaggctgtggccgcgtcgccatccaccagcccggaatacgagtccgccgccttgcggtagctttccgacgcttccacacacgcctgtctcgcctcggccagctcatggttcgcgtaggtcttccaaacgaaccagccgccaccagccagcacagccacggccgcgaccgaagccacggcgatcacagcaggctttctgctcttcttcttgttttcagttacattctttgacccggcatcgcttatattcgggttggaaacttcagatagttttccctgcatacttgtgctttcgatgagttatgtcacatacgttttaggaaaaagcggatgggaatcgttcgttcccatccgcacatcattttctaggattttatggcaaaaacctacttggcgtggcgcgccataagaccgtaacggccgtcaccacgacgcttcagcatgagcgtggctccggcggtaccggcggccataatggtaaacacggcggtctccatcacgtccacgcccgtgtcgccaagcttggcctgcgtggaggtcttcacggccgccctgttcgcactgttcgcactgtccggagtatcaaccgtgatggtcgtatccttcgacggggtgacaaccttgtgggccttgtcgtacgcgtcctgcgcggattccgcgtcggacttcgccgtggccaatgcggtttcggctgtcttcagcgtggcgttcacttcagccagagcagcctgggcggcatccacatcggcctgcgcgtcagccgccgactggtcggcatccttcttagccgactgggcggcatccagttcggactgcgccgcattcgtggccgggtcggaagcatacgcatcatccaccttggattgagcgtcctgcacattctgctgggcattatcataagcggtctgggattcggatacggccgtgttggccttgtcgagcgcatccttcgtcggatcggccgactgggtctggcccaccatcggatcggcggccgtctcatctgccatggcgggcgcggccataccggccacctcggtcaagcctgcgatggtcgcaacggccagtttcttcggattctccatattctccattttctccatcctgtctcccggagcgttatgacaggggcgcatgcgtccccgaatgcaccgcccaccctaccactttaggggggggtaagtgtgtctcgcatctcgagataaacaaaccaatcgcatccgagacatacctccacctagacgcctttgcttcaagaaaacgggttttacgatctattagatatgggggtaatccattagattagaggaatcatacgaaaggaaatgtaatgagctatagcattgagcagttcatactggatagcggcattactcgcgccgaggttgatgaggctaaagctcggatgttggaaaggatgcatatgtatgggctcaaggagacgcataacaagaaagcacatgaaaaggaggagctggcactccgaactcatcggaatgccagctcctcctgaaaaccgtatcgtcgcctcatactctacgtctcataaccataggtacaccgcacaccactacgagacgattttgtggtcggcgcggtagaggtcgggctctacgtagatttcgaaacggaaccacggcagcgcggtacgcacgcttcgttcgattttgttcacggtttcaacatcgtaatcgcggtcgagcttgctggtctgcaccttgacgcacagcagaatgtcatcctcggacatatgcacggtctgcatattcagcagtcgttccacaccaggcgttgaaataacagcctgctcaatcttcttgcgcgtatccgaatcgacggcctcaccaatcaacagcgaaccggatttgaacatgagcagcaacgatcccgcaatcaatacaagaccaaccatcaaaccgccgaatgcatcaaatatctcattatcaaacagaatcgcaagaccgatgccagcccctgcgaatgccaagccgatcaaagcaagcgtgtcttccataatgacggacgcaagctccgccgacttggtacgcctccaaaaacggaacacacccatatgggccacacccgtgcgctccatacgctcgttcgcttccttgatgctttgatgcaggccgtagccttccaaacaagcgctgataaacaccacgataaacgccaccagcagttccatctggttggcgtcacgcagtgcggggtcttcggcaatggcgaacaatttcttcaccgcctccgaagtggagaagaaaccaccgacgaaaaacagcagcgtcgccactacgaacgaagcgagatatttggcgcggtacagaccgaacggatgatcgccgtccgtcttatgcttggagaagcgaccgcctgccatgagcacgatttcgttggaacagtcggcgatggaatgcaccgattcggaaagcatcgcggacgatccggtaaagaacgccgcagcgagcttggcgatggccacaccaatgttggctccgagcgccgcttttacggccgctccttgatgttctgcctcctgttggcgaatatcgttcggattgctcgtactactgtcgttggaatcttgcgattcgttcattgcctttccatttctttctggagttaatacaagacatattcaatcatacatagggtgctgtcatagggtgccacccggattgacacgcttgcaggttcagcgaaaaatcacttccttgcacagcggatagccccacgcgaactgacatgccatagtcaggaacttcaccaacaccgcattccatccgaatgcggaagacagccatgccagcatgatcgaaccgaacaggtaattccaaacccacagcagcatgaacaaagccacgctacggccgaaattgctggacgatttgaacgtgacattgcggttcatcaggaagttgtacgaagccgacagcacgatggccacgccgttcgcgatggcggatggtacggaaagcacatgcagcaaggtgaacgatccgaattccacaatggtttgcgttgccgacaccaacagatatttgccgagcgttttcggcttttcgatgattcctgattggaggatttcggattatccgacgtaccactttgcgctgccattgcctgccgcccggtcccatcactcatatcaacccccccaccgaatcatatgtcgttcaatcgcaaaacactataatgcgcccgtctcatattcccgacgtaatcgtgcatttttctgaaggattgactagtcttccctaggtattttcactgacagcacaacaaggagcatccaatgacgtattcccagaacgcgccgttccgcgccgacgtggtcggctcatacctgcgtccggcagaactcaagcaggctcgcgccgatttcgcagcaggcaagattgacgaggccgcactcaaggccgtggaagataatgccattaccgaactggtcgccaagcagaaggccgccggtctgcacgtcatcaccgacggtgaattccgccgtggctggtggcatctcgactgcatgtggggcttcgccggcgtggaaaaggtgtcgatggacaagggctatttcttccacgatgaggagacccgcgccgaatccgcacgcctgaccagcaagatcgccttcgacccggcccacccgttcgttgagcatttcaagttcatcaagcagttcgaagacgacaccgccattgcacgccagaccattccggctccggcacagctgtatgcggagctgttccgcccggagaacatcgcttccgtgcacgagttctacggcgacacccagaaggattacgacgagcttgccgacgacaacgccaaggccttccatggtctgatcatggcattgtatgaggccggctgccgcaatgttcagctggatgactgcacgtggggcatgttctgtgatccgaacttcaaccagcattacaccgccgatgagttcgccgccatgcaggaacagtatgccgccatgaacaacgccgccatcgaggatctgccagaggatctggtgatcaccacgcacgactgccgtggcaattaccactccacgtgggcttccgccggcggatacgccactgtggccgacgtgcttttcggcaaggaaaacgtcgccgcctactacctggagttcgacgatgatcgttccggcgacttcgagccgctcgccaaggtttccggagataagaaggttgtgctcggtctgatcacttccaagaagccggaacttgaggatccggaagtgatcaaggctcgcattgccgaagcggcccagtatgtgccgcttgaccgcttgtgcctgtccacccagtgcggtttcgcgtccaccgaggaaggcaacaagcttaccgaagagcagcagtgggccaagatcgcgctcgtgcagtccgtcgccaaggacgtatggggcgagtgatgatcgcacacgcgtagcgcgcttgtaaaaaacatataaggggctgtttgccaatccaatcgtgactggcaaacagcccctttcgtactgaagcgaacgaaatcctaccgcaatcagccttgcatctgctccgctgcatcgttgatgcaacgaatcgcattcagcgtacgcggatacccgatatacggcatgcactgcgaaataacggcaatcagaaatgccttctcattgcctacgcccatattggccttcgcatgagacgtcagctgcggctcgcaaccgccctgcgcggcaaggaagcacaacgtgatcatttcacgctcacgcgtgctcaagccaccgcgcgtgtagtagtcgccgaagcagttgcaggcaagccacttgttgatgtgtcgcgtatcttcggggccggattgcgtgaatccacgcattccttcaccgaagatttcgatctgcttgtcttcgcccgccctggcacgcgtttccggcgtggtggtgccttgcggttcaagcggaagatgcacgttggccgcgccgagaaagttgttgagtttcttcaggaacggcagggttttgccgaaaccacagtatgcggtcgcctgatacaccatttccttgatggcgatggacgacagtccggtttcgtaggccaccggcagcatcatttcgaaagcatccaagccttggcatccgaccagcacggcaagaatggccaaagagcgggttttgtcatccaaatcaggatggttcgctcccggttcgttcaccacttcgtcataagcgaaattcgagaagaattcaatgaattccggatcggtttgcgacaatgtcctgtcattgttccagaacgaattcatccgtttgtgcagctcttcaaacaagatttgcttcctttcgtttgatttgcgcttattctatcgtcggtatattgctcagacctcactgatgcgcagcagcgactttacggtgcggcgctcgtccatggccgcgtacgcttcctgaatatcgtcgagcgtgtattcggaggtgtagacgatgccgggattgatgttgccgtcgagcacttccttgagcagtcgctgcagatcgtacgtgcgcaccggtgccggaccgccgcgcagaccaacgttgcggtagaacagtcctggaatatcggcttccacgccgtgcggcaagccaacgcgcccgactacagcgcccgcacgcgcaaccttcatggcagtgtcgttcgacaatgcggaccctacgcattcaagcacggcgtcggcaccgtaaccatcagtcatttccagtaccttggctacagcctcgtcgccacgttcctccacgaaatcggtggcaccgaattcgcgtgcgatacgttggcggtcggcatggcggctcatggaaatgatgcgggtggcgcccatcagcttggcggacagcactccgcacaggccgaccgcaccgtcgccgaacacgactgcggtgtctcccggcttgatttcggcggaagcagccgcatggtaaccggtcgacatcacgtcagagagggtgagcagcgatgcgagcatttcgtcggagaagctcttcgcgtcgcccggaacgaccaccagcgtgccatcggcctcgggaacgcgcaggtattccgcctgacagcccaatccctcgtctccgaaatatccgccgtgggggcagctggattcgaaaccggccttgcataccgggcacttgccgcagctgaacgggaacggtacgatcacgaaatcgcccggcttggccacggtcacgtcgtcgccgatctgctcgaccacgccgatggcctcatgtccggcctgagtgttgggttccttgctgccgtcgcggtagaaccacaggtcggatccgcacacgcatgcgcgtaccacgcggatgatggcatctcccccatcgatgatggtcggttcggcatgctcttcgcatgccatctgcttgactcccttgaagatcgctgccttcatgagttgctcctttgttatacgaattgaattaaggtaacgtctgcgatgacgcctcgacttatgcgtcagccttgctacgaatctgttttttcactgtttcgatgacatcgtggttttcctccagaagtcgttgcgcttcgtcgtcatggccttccgccacggcacgccaatacaatgttttaagggaaacataggcttgctgcatgcggatgctttcggcttttgcggccaaacgcaacgcctgcgcgtccagtagcgccatttgcctgcgcgcaccttcggttccgtcgaaacggtttttcagatactcgcgcatggcgtcaagcggcatgccagtcgcagacaagcaggaaatagtgaccaacgattgaatgtcttcgtcggtgtaggcgcgatggccagaacttgggtcacgtgcgatcggggcaatgataccgatttgctcgtagtagcgcaaagtggattcgggaagtccggaaatcatggatgcttcacgaatcgtatgccatgttgtagtgctcataccctgcactgtaaaaacttaaagtgcttgaagtctaattggcgtgttgcatgctatctcatagcaaaagaacatgtaatcctgacaattagctaagttgcgtctgcaaagcgtaacttacgtgttcatcgtaaggaacatcagaccacgctgttttggacgaatgccacctcacaacaaaaagctcttatgctgctgagttgaacgaaatcgtgcggattagatgtactggactggaccgtacgcccggatttggaatatttgtaacgatattttgggtacagggaaatccatgatgcggatttggaatatttgtaacgatattttggatacagggaaatccatgatgcgtattcggcaaacaacacgtcgtataatacctttcgtcgttcctgcccgagccgcgcaggtcgaggaacggcccacggcgactgccgcgatctccgactcacggtgcacggcatcgaccaacgcaaggattcattatcattatggcgaagccattctctaaaaccgttattcataatacagacgcgaagctgtcgaagcaggtaaggcagcctttgaaaacaaaccaaggaatacacaaggccctcacatggcgtgtggtcgatatcgcggtcggcgcggcggtcggcgtgatgtcgggagtgatgttttgggtgttcgacggcctgtcgtatggtctttttccgttgatgactttgattcttcctggttcagcggcgctacttcatgctttgttctacttccccgccacgctgggctctctgatcgtgcgcaagccgggagcttcggcctacgtgcttttggtcgcatcgttcgtcgaggtggtactcggcacgaaatacagtgtgagcctggtggtaatcgcattgctgcaggcggcagccgcagaagcggtattcgcactgttccgctaccgtcgttggacgctcggcgtcaccattctgtctgctttggcgattggaatcgtctacaacttctacctgctgttcttctactatcaggcattcacgttcttcagcccgcgaggcatcatcggcactatttgcgagctgcttagcgcggtggcattcgccggtttcggttcctggggaatgtattgcgctttacgtaagtcaggtgttctgtcgcgattcgcttcctcgcataaggaacataacgaagaaaacgcctgaaagtacgtttggaagcatgcctcgaccattttaattttttaatcaaatctcatcagttttactgattaaaaggacgcaacgccgactgcgacgttgcgtccttttatgccatcgcacatagtgcgattactgcggaatcttcgaactcgaaattccggaatcaatcggcggtgatcagctcgctcgaatccatgtcgaagtcggacatggcaaacgagcggatcgccggatcctcatacgtgttcatgtaatacgtgttagtctttccggaataaccgctggtgaacagcgtgcgctcgaactggccgttgcccatcttggacatgccttcaaccatctgtacggaggccagcgtgtggaacagacgagacacattggcggactcgttgttctgctgtggatagtgcgtgttggtgtaggcgacacgtacgaaacgcgacggcgaactcacgtcaccgggaatgccgtgcatgctcacgccggcgccccatgcgctcagttccgccttgccccaagtggtcggctccgccatttcgttgctcacgcacatgtagttgcgcaggttttccatatggaagtcgaaggtcggttgattggtgagcacatccacatcgtcatgatgaacatgcatgccatcagccatctgctcgatgacgatgctacgggtgccatcgccaatgaaccagtgcagcaaggactcctgctggccgggcacgacctgcgaaacgagcgtcacgtccttcaacgcctcttcgacttcgtcgacactgtcgaaattgcgtgccacccacagcgggaattcgaaagtggcgacgttttcggttccctcgaccggttcgtgcgcgaaggaggcgtatccggggaagttcaatccggcgatggccaagccgtgctcgttggcgcaatcgaaatacatggggcgatcggccataaccacgcccacgccgatcaccgcattcggctcgctcttgcctttggccccatacgcatagtcataccggtagcctcgcggagtgaccagaatggtctcgccgtaggagaagctccagtcgagattacggccgaaatatgtgtttccctcatcgtcggagaaacgaacaccagtgcacatatggactcccttccatgatttgccgtgtttttcttgcttgcgtgttcatggtaaacgccgtttgctgggaaaatcttaagttttgcccgtggaagaacctagtctggatatctacgcattctacgacgaccgtgatccgctggatcctcgcaaccgatagcagagtctccgtcaaacgcgcaaattcgaggtctcctgcatgcgtgttagagaatagcccgcctcccgagtccccaaaacacccacccgctggaacaatccgtacgccaactgccttcttggcgggaaggttccccagtgggtggaagattcaggacgttacaagccggccaatgccagaaactttttgtcggactggatgccttgggtgaggaatttgccgtccctaaacaacgcatacgtggtgaccggcgcgggcgtacgttgggcggtctctttatcggtgatatgaatcgttttgaatggaatattgtgctcttccgccgtttgccgcacccgcggaacccaatagcatgtaaacgggcattgatcggtgtagtagagcacgaacccgtcttcgtccaccgcgggatgcttggcgcattccttgaatttcggcagctccgcattctcttcaaaaggcagggccatgagattgatgccgcaatcagatatgtcggtcacttcgaaacccttgtaggacagaaacttcggatcggcaaggaactctcgtttgcgaccctcggctgagagaatgcaaatgcctttgcgcccctgctctttggcgtctcggatgcattcgctcagcagattaccggaatgtccatgacctttcaaagaaccggccacccatagacagttgatatagatccacccgtccgcatcgatcggcacccatgcgttttccgccggaatatattcgatgaagcatttgcctcgttcctcgctacgatagaagacgagaccttcgttgaaacgctgcttgagccactcttttttcgcaaggctttgcttgccggacatggcacagcagatatgttccttgtcgatgttctcttcagtgatgtggatgtagctcatttttcctgcacctctgagtcggggatgctgtatgggcatcttcgttgattcctcgaatatgacaatagcccttgatttccaagggctttcaaatggctcctgcgactgggcttgaaccagtgaccgtccgattaacagtcggatgctcacgtagatcgcggtggccatgccgtggaacgtgatgctgacggtgccgccattttgacgggccgtatcaagacgctcggcgacggtgaacgtgcggcgatacagtgccacatggttggtttcgggaacgttcggctcctgcggattctcatggccgtcccacgggtactgaatattcacgtacttgtggttcatgtatcccgcgttctgcaggtgggagggcacgtcgatgcggccgaaagcggaatcgtcgaaatcctcggctgcgaacggctcttcctcaagatcgatgtcggaggcctgcaccatttccacgcgccattcgccgtcgaggctttgcttcaaatcgctcggctcgccgatcgcgggaatgtgagaaaaggttacgtgattggaatgtgccggcgtgcgattcactgcgaacaccgtggggtcggtgagccacgcggcggatgcggtggtgatcttatctgccatgatttcctcgtttccgaaacataacttcgttgttgatgtaggtttagttggtgtgtacttttgtgtactcagagtaataaactcttttactagcatggtaaacgttgtttacttaaattgcaaatctgcgtgttgcgttatttgcaactgaatttacttatatggcgataggtgacggcaaatggcggtagtaatcatgattgcagatgtcggtatttgataagcgtaagaactgcgattgtgacacgccgtttggaggctttgtttactaaggaattttacttttgatagtaaacaacgtatactcaattttcgaggtcaacgggtgatctcatcaaaatcttctaaggagaagagataatgagcaatacgaccactactgcgaacggcacggctcgtcgcggcaaccttggccagcgcgtagcgtacgcgtgcggcaaccttggccagtccgcgttctataacgcactgagcacctacttcgtcgtctatgtgacgagctccttgttcgctggtgttgataaaggcgtcgccaccaagctgatcggcatcatcaccggcctggtcgtggtgatccgtatcgcggagatcttcatcgacccgctgctgggcaacatcatcgacaacaccaccaccaagtggggccgtttccgcccatggcagttcctcgccggcgcgatttcgtccgtgctgatcgtgctagtgtacaccggcctgttcggcttggtgaacgtgaacaccacgtggttcatcgtactgttcgtcatcaccttcatcgtgctcgacgtgttctactccctgcgtgacatctcctactggggtatgatccctgcattgagctccgactcccacgagcgctccacctacaccgcactcggctccttcaccggctccatcggctacaacggcatcaccgtcgtggtcatcccgatcgtcacctacttcagctgggtgttcaccggtgagctcgccgaaagccagtccggctggacctgcttcggtattatcgtcggcctgctcggcctcttgaccgcatggaccgttgccttcggcaccaaggagaacgagagcgccctgcgctccaaggcccagaagaacggcaacccgatcgaagccttcaaggccatcttccagaacgaccagctgctgtgggttgccttgagctacctgctgtacgccatcgccaacgtggccacttccgatctgcaaggccgtttctccacgcctattcttattggcgccgaaaacgagctgcgcgcacaatcgacatcggtactactcgccaatgctcgcggtgacgatgcgctggaacgcagccatgtagagaaactgctgtcgctgaaagtggacggcctgctgattgtgcagtgcgagacgaatccgcgcccgtcgctggggcgtgattggggcgtgccgctggtgtatgtgtatggtccttccaccgacaccaacgattgttcggtgacgtgtgacaatgtggacgccgggcgcatggccgtgaatcatttgatttcgtgcggacgcaaccgtatcgccattattggcggcgatgaaacgtatacggcctccaccgaccgcaccaagggcgcgttggaagcgttggccgaggttggtttggaaccggctggcccgattcgctatggccgttgggacgagaattgggggcgtgccgccaccagactgctgctcgaccaaggcgtgaagttcgacgccgtggtatgccagagcgatcagctggcacgaggatgcattgacgcgttgaagtcgcagcatctacgcattcctgaggatgtggcggtgatcggccacgataattgggacgtgctcaccaagagctcccgcccgccgctgaccagcatcgacaatgaaacggaactcatcggccgcaaagccgcccgctacctgatggacgccatcaacggccagccccaccacggcacggaatacctcccctgccgcctcatccaacgcgaatccactctccccctagcctagcgtcatcgctttttgttggaacgtcccttgaagtaaatgtcgaacacgatccagacggacaaaacgaacgcgatcacatagccgaggaaaccaacgatcggaataccgaaaatcaccggtttgatgcccgcatagtacacgatcgacgagccgatgaacaatccgacgacgatcagcgccatcgtaagcctgttcaccatgttggcaagcagatggatcggttcctgcgaaccgaccatctccatattcacgcgcaactggccgcgcgtaagcatacgggaggccactttcagctcattggcggcagcgagcaggctgtgcagcgcctgatgaccttcgataaccagcgatttcgcctcatccttggcgaaatccttcttcgacgtgcttgcggcgatatggtcggagatgatctgaatcatattcacgtctggaatgaactcgtcgagcaggccttccaaagtgaccagcgcacgcccgacggtggtgacggtgctcggcacttcaatgccgtgtcgttgcgccatttgcgtcaacgcggtgagcatggcggcgatatccagctcggccaaatccactgtgccgaattccttgacgatcacatccaagtcggccaataacgccggataatcctccggatcggcctcggcaccggcgaaacgcagcagaccgtcggcaagcgcgggcgaatcctgtttggcgaccgcgaaaatcatgtctttcaagacggaacgggttttggcattaagccggcccgtcatgcctaggtcgagcagcacgatctgcccgccgcgcaccatgatgttgcccgggtgcggatccgcgtggaagaagccttcgtcaagcacttgcgtggcgtaattgtcgaccagtttggtgccgatttccttcagatcgtagcccgcttcgatgagctcatcaggatgcgagacggaaatgccttcgacgtagtccatgaccaccacgtgttcggtgcacaggtcggagtatggcttcgggcagtccatgtatttgtagtgttcgcagaatcgtttgaattccgccagatttcgcgcttcgatcatgaagtcggtttcggcttcgaaggtgtcccacagttcttcgaccacgccggagagatcgaccacttgggcgctgggcatggttttggcggctattcgtgcgatggtgcgcatgatggacacatcctgtgccatggtttcgcgcacgcccgggcgttgcactttgacggccacatcttctccggtagtgagtttcgcacgatgcacttgcgcgaggcttgccgatccgagcggtgtggcgtcgatatggtcgaagatttcgcctgccgggcgtccgtattcgtcttccagcacttgcaggacggtgccgtacggcatggggtcggcgtcggcgcgcagtttggcgagttcgtcgcagaacgattggggcaggatttcggatcgcatggataggatctgcccgactttcacgaaagttgggccaagcgcttcgaacatgagccgcattttgacgggggtcaggccgtgcacaatgtcgaattggttgacgatttgcgcgatttgcgcaagtcgcttcagtttgcctcgacgagtcaggtggtagcgctgcgagaatgagtctttacgcgggccgaacagtccgatggtttcggattgcgtaaaggttgcgtcgttctgcttgccttgcgattgcgggattcccgtttttcccgcggatttggctgccgttgccgcagccgcgtcggacgaggggttcgccgtcggattgatcaccgcgttgactcggtcggaaagtgtgaccggctccacgctttcggggcgggccgcatccggctcgatcggagaattcaaagacatatcgctgctcgcaaacgttggtcggattacgatgagtgggattcatgaggagacttgcgtcccgcgtatttcatgcgattcgcacgtttcttacgttccgcacacggccgttcgcatgtttcgcaagttccgcataacaaatcgccgtctgaacgtgatgcgacgagcagacggcgatgtgaacgattgaacgttactcggctttggcttcaggttcggcttccttggtttcctctgcagccttggcttcagaggattccttgacctccgcgaccttgtgcttgagttcggcgttgagggccttgccctgttcgacggtcagctcgcccttcttgacgagatcgtcaacgatttcctggctcttctcaaccgtggtcgccaaagcgccaacgccggcgaggaagaccttacgcaggccgtcaccaaaatcaaaatcagccatgattacctccttaggtgatggtggtacccactctatcgcattttcttcacaaataacgtcaacgaaactagtcaatcgttacaattctgcggaagactcgctgccgtatgctcacagcgtacgaaaacgcgaaaactacgaaacagcgcgaaaacaatcagcgcgggcgtgacatggccacgcgacgcgcgttgctggcaatcgtgttgatgcgatcaagttccgcacgctgcgcttccgtctgccctgcagcggccggatcgaacgaaccataccggcgttctgcggcggtgcggatcagaaaatcggcgatcgcggggttttttggcagcagcgagccgtgcatgtatgtgccgatcacattgttgacgcgggcgccttccgtatgatcctcgccattattgccggtgctatccgcgtcgacggtgccgagcggctgcacgccttcgcgcaggaaggtttggccggaatggttttcgtagccgatgatgtcaccgaaatcggcggaatgctcggtcagattgccgatcatgcgcacttcctgcccgaccgtgtacgcgccgatcacgccgatgccgtcgagccgggagccatccaccgtttcgaaatattcgccgaacagctggtacagaccgcaaatcatgagcatgggggtgccgccggcggccagcgatcgcagcaggtcggcgcgtttgaagaagtcgtcgatgattttcttctggccggtgtcttggccgccgccgcccagaatcatgtcgacgtgttcgggccacgcgtcgccctgattgtaggcgtgcacgcgcggctcgtagccgtatagggcgagacggcgctggatggtgagcacgttgccggagtcgccgtagatgttcatgtctttcggatatagcgacacgatgtcgattacctggctcatatcgtctccctcatgcggttcatacgttcttcatgcgttttcatgcgttgcgcggattcgcgctgttatttgcccacgccagcgtcggcgacttcggcgattttgccgagcgcggctcgcgttttgagcattgccgtgtatgtgcagtaaatgtgcttgggggcgcccggattcgcgttcacgaacgttgagacggcctcttcaagttccgtgttgacgctattcaccggcacctgatcgtattcgagacgcaacgccatgtcccatgcgcgcacgcctgaaaccatggccacaccggtgtctcgcagcgaggagaagtccacgtcccacagccagctcatgtcacgcccgtcggcgtattcgtcgttgatggcgatcatggtgtcgcagccttcaggggtgaaggatgcgagcgacagacggaatcccatggggtttttgacgagcagcagctccaccggcgagccgttcacgtcgatgacctcgccgcgtccgaacgccggagtgacttcggctgccgcgtcgatcatggcttgcgtggtggagtgcgcgaagtcgatcatgcgctgtgagattcccacttgtcgcaatagttcgtcggttacgttctgctcgaacggcaggaacattgcttgcgcatcggccacgaccgctcgcacgacggccagcgcggccgccgcgttgtacaggttgtacacgccttccagtctcacaccggtttcgtacgtttcaccgtcgatgccgaaactggcacgatggtcgcccacggcaagcaaggtcacgtcagctggtagctgttccgcaattgccgcatctcccgatttttctgcattttccccagttttcgcaatcgctgcagcatcgtcaatctcaatatttgcggacgatgcagtatcgactgtcgtgcgcatgtcgtcgtcggacgggaagaagctgcgcaacgacccgtcaagaccgaaatagcgcacttccacaccatcttcagtatgtgcgacgtcagcaagtcgtgcgatgcgtggatcctcacgattgagcactacggttccggtggtcgcttcggcggctttgctcagcagtcgtgcggtattgtcgatttcgccgaaacggtcgagctggtcgcgcatcacgttgagcagcaggcagtagtcgggttgcacttgtttgacgaaatgcaccgcgtacgcttcgtcgagttccagtacggcgatgtcggcgtccagtttgccgccgagcgagacttcggccagcagcgacgagaccacgccgcgggtgaaattcgatccggtcggattggtgaataccttcaatcccaacgattccagcatgcttgccaccatgcgcgtggtggtggttttgccgttcgtgccggatacgagcaccacgccaagcggtagctgctgcagggtgcgtgcgaggaattgcgggtcgatccgttccacgattttgccggggaacgcgctgccgccgccatgtgccaggcgggaggccgcacgcacggccttgccgatcaacggcgttgcgaatgagttccacgccatgctatacctcctgttggctctggtagtcctgcggcatatctttgaacttggagtatgcgccaaggaacgcgagattgaacgtctgcgtcggaccgttacgatgcttcgccatgatgatatcggcctcgcccgggcgatcttccttgtcgtaggcgtccggcctgtgcacgaggaacaccacgtcggcgtcctgttcgatagaaccggattcgcgcaaatccgaaagctgcggctttttatcctgacgcatttcggggccacggttcagctggctcagcgccaccaccggcacttccaattccttggcaagcagcttcaatgcacgcgagaaatcagacacttcctgctggcggctttccacggccttgccggaagtcatgagctgcaggtagtcgatcaccactaatttcagatcgttcgtctgcttcaatcggcggcatttcgcacggatctccatcaaactcatgttcggactatcgtcgatgaataatggtgcgttctgcagtttatcctgcagattattgaggatattccaacgttcctgcgtgatttcttccgctcggcgcatggctgacagcggaatattcgcttccgccgaaatgattcgttgcgcaagttcggttttgctcatttccaagctgaagatcacggacgtcatattgtggtgcagcgccgcagctcgcgcgaaatcaacgccaagtgtggacttacccatggccggtcggcctgcaacgacgatcatctggcccggctgcaggccttgcgtcacgtcgtcgatgtcacggaatccggttggcacgcctttggaaacctcgccgttttgcagtcggtcgatttggtcgagggtgtcggtgatgacggtgccgatcggcgcgtaatcctgcctcactttgccggtcgacatttcgtagacttcggcctgtgccaggttgacgacgtcttcggcttgggatccttcggcggtgtagccgagctgtgcgattttggtgccggctgcgatcacattgcgcaggatggcacgctggtggatgatgtcggcatagaaggttgcgttggctgcggtcggcacggatgcgacgaggctgtgcagatagtcggatccccccactttttcgaggtcgccgtctttgagcagctggttggccaccagcaccgcgtcgacgggctgcgatgcggagaacaggttgatgatggcttcgtacacggtttggttgcgcggctggtagaagtcggtgatgtcaatcatctgcgagacttcgccgatggcgtctttgctcatgagcatgccgccgagcaccgccatttcggcggcgtcgtcatgtggcggcacacggtcgaagatggcgtcgcgaatagccgttcccgacgcgccggaaatgctgccattgcctgaaaaaccgcggttttgcccttgatccaggccattgttccaagaattgctctccgccatgcttctccagctcttcgatgtgtggtgtaccgggaaaaaccataatacctgtgccacttcacgaatgatgttgcgatgagattctggaggaatctccgcattggcaggatcggaatcacccgacacgcgcgaatcggttcgctgtggataagaaagccgaaaaaacccgagttatccacatactggggataactatgtggaaaacataccgagttatccaccaaatggggataaccaagtggacaacttggggacatcttccgtacgggtgcccattcccctggttgtgacttgcttaagtgaaccgaaggtgatatgttccccactttttcttaaacgatgggtttccgccgacgcggcgggtaccgcatcggcagccatgtcgctttgccgggcattcgctcacagcctacgcggcctcacatgtggtagcgggtggcgttgtacatggttcggacaagggtttcgcgccatttactccagccgtactgtttggaaatggtctcgccggccgtggcacccaacgacgaaccgtcagcacgagtcagatcgaacagcatgtcaagcagcagcggatcatgatcaagacgagaggccaattcgtcgccaacattcggatcattaggattctggccagtcgcaaactccgacaacgtaagatgctcacgcaccagcaacgtgacccaccaaataatgtcacggtcaaaacccatacgtttcaacaccgtagacgcatggcgggcaccctccgcagcatgatcggcaatccccggacgcttgccgatatcatgcaaaataccagccaacagcaacgcctgataatgccgatcatcataacggtttccacgaggtgtttcacggccaagccgcgtgaccacctcaaccgaatgacggtcaatcgtataccgatgcgcagccgaagcactcgggcgattacgaatcgccaaccattccggaatcaaacgacccggaatatcgacaaaatcaatctcctcccacacctgcaacaacgcgggaccgctcgcaagcaaacgcaagaacagactacgcgactcatcattccacgtgcgatcatcgatcggacacgacttcagattctgcaacgtgccgggcgcgatcggcagaccaaactcagccgcagcaacagcagcccgcaacgcaaggcacggatcggacttcggatcggcacccggcgcaagcacgatctcctcctcatgcttggcgataccgggcgcgaccacatcaaacgtaggcgcctgacgcttaccgccgccacgaggctggaacacctggaaaaacgcaaaacgaggcttctcatgagtcaacgaatgctcagcgcgagaagccgtggaatcaagcgaaaacgcgatctggcgaccaacacgcgcaagcaacgtctgcaaatcatcaatcgacttcgcctcacgctcgccgctcggcaacgtcggatcagccaaacccagcatcgccgaaaccttcgcctgataaggagcgagcaacatattcgtgtctttattggccaccaaatgaatgcaatcgcgcacatccaacaaccgttcgacggcatcgtcatactggccgtgcgggcggtcggcaagccaagaagcggcaagcgcggagaccagcacggaatcacgcaaaccaccgcgagactccttaatatcaggctgattgctatacgccatacggccgaactcatccaaacgagacttggcggaacccaacaattcgggcaagcgcttacgggcggccctacgccaacgctccaaaatggagacggccgtggattcaatcagctgcgtatcgcccgcgatcggcaccacatccagccaacccatcgcggcaggcaaatcatggtcggtgaccgcctcgcactgcacgcgggtacgcaccgactggtcaagatcaagacccgaatcccaaatcggataccacaatttgttggcaagctcattgagctgccggtcagtgagcgcgtgaggctcataaatgaccaccaaatcaagatcggaactcggtcccacttggccgcgggccaacgaacccaccgcgccaagaccaataccagcttgcggaacgtcaaaagaaaccgtctggcaggcctcctgccacaacttcgtcaggcaatccatggccagatccgtacgagccttacgtttcgccgcaccattgcggtacacgccgtcgacatccggctgactcatatccatgaaacgttgtttaagaccatcaaccgctgaagtcatagcaaatccttatgaatcttcgcaaaaacaatcaaatctgagcagataaaagcgaaagcggggaaatccgaagcagacaatctgacgcgaaaatcgtatgaaaatccccgcacggcgcgaagcacgtacggggatctgtctattgataacccgaacccaagcccggggcccttaatatctatccgaatgaattatcagatagcggcagagccggtctcgccggtacgcacgcgggtcaccgaatcaagcggggcaacccagaccttgccgtcgccgatggtgccggagccggcggacttgacgatcacaccgaccagagtctcggcatcggcgtcatcggacagcacctcgacgcgaatcttcggaatgagatccacggtgtattcggcgccacggtaaacctcggtgtggccacgctggcggccgtaaccgttagcctcagacacggtcagaccgtgaacacctgcggcagcgagagcttccttgacatcgtcaagcttatgcggctgaatgatagcggtaatgagcttcatctcacttcacctccttgagaacagagctggcggtaccagcaaaatcgtaagcacgttcgccctgatcggcaagatcgataccgccgacttcctgagcttcggtgacacgccaaccaatcgtcttctccagagcgaaggcgatgatgccggtgacaacagcggaccagatgatggcaacgagggcaacgatgagctgcacaaccagctgcttccagtcgccgcccgcgaacagaccggtaccttcgccgaagaagccgataagcacagtgccggtgaagccgccgacgccgtggacgccgacaacgtcgagagaatcatcgtagccgagcttgaacttcaggccgcaagcgaggcaggtgagcacgccggcgatggcaccgagcacgatggcccacagcggggaaaccacatcggcggccggagtgatggcaaccagacctgcgacgatgccggaagcggcacccatggcggtgtagtggccggtgcggatcttctcagtgaagccccaagagagcattgcggcggcggttgcagcggaagtggaaacccaagcgtagcctgcggtgccattggcggcaaacgcggaaccagcgttgaagccgaaccatccgaaccacagcaggaaagcgccaagcatcacgaacggaacattgtgcggacggaacggctgggtgccgaagcccttgcgcttgccgatgatcaacacgatcaccagagcggcgactgcagcattgatgtgcacgaccgtaccacctgcgaaatcgtgggcggcagcgccgatagcctgggagatcgcgccgtcagcgctcagcagaccgccattccacaccatgtgggcgagcggagcgtaatcgaaggtaatccacagcgcgacgaaaatcatccacgtggagtacttgacacgttcagcgatagcgccgcaaatcagagcgacggtaatcatggcgaatgcggactggaacgccacatcgacgctgaccgggtagttgttggagttcagcgaagccgacgtgaagacaccgccgtcggaaaccatggaatccttcagcaggaagcctgtggccggatcaccgaagacaccgccgaccgaagtgcctgcgtaggcgatggaccagccccacagcacccagatcaccattgtgacggacagagcggccgcctccataatcatcatgttcagcacggcctttgcgcggaccatgccaccgtagaagaacgccacacccggcgtcatgaggaacacaagggacgcggacgtcaaaatccacgcggcatttccagaatcaagctgacccatgtcaccctcctctttctttctttttgagttcacatttccggccccatcgtatggggctgacaaaacggtatggaacgccgcccgcgttttgaaaacgttacgacgtgttacagcaaggtaacgccatctcgccattacgtcaaccgaaaacggcggaataaagcggctggcacgttttgtttcagattgcgcaccgctctcaggccaaaccactatcagcccatttttcagcgtatctgccttatgtatggcagatttggaggactgacacgagacatttcgcctatatatggcactctcactcgcaaaaaaggtgctttcgggggtaaacatataccttctaagtcgactttctccaaaagcatctgccatatataagcgagaaaccagcggacgaaccggcaaatctgccatatataggcgaaataggactggtcgggggtaaaaagaaagcctcccacgcggggaggctttctcgggagcgcaatcagctcaggcgaggatgccgtcgacgaagccttccggatcgaacggggcgagatcgtccgggccttcgccgaggccgacaagcttgacgggcacgccaagctccttctgcacggaaatcacgatgccaccctttgcggagccgtcgagcttggagagcaccacaccggtaatgccgatggcttcggcgaacaccttggcctgggtcatgccattctggccagtggtggcgtcgagcacgagcagcacctcgtcgaccggaaggttcttttcggtaacgcggcggatcttgccgagctcgtccatgaggttcgccttgttctgcaggcggcccgcagtgtcgatgatgagcacgtcggcgttctcttccttggccttggcactggcctcgaatgcgacggacgccggatcggcgccgtccttgtcggaacgcacgaccgggacaccgaccttggcaccccaagtttccaactggtcggcggccgccgcgcggaaggtatcggcagcgcccaacatgacctgcttgccttcggaaacaagcaggcgggaaagcttgcccgcagtggtggttttgcccgtgccgttcacaccgaccatgatgatgacgcttggtttgttcgcgtcttccttattggcattgaggcggcgatccgtgtcagtgcctacgagcttcaacagcttgtccttcagcgcggcacgcacttcggccggatcggactggcctgcgattcgggcgtcgttgcgcagttcctcgacgagctgttcgctggcttccgcgccaacatcggcaagcagaagggtgtcttcgacgtcttcccagtcggcttcggaaagctgatccttcgcaagaatgttgaacagagccttgccgaacggattgccggatttcgacaggcgcgccttaagacgctgcatgcgcgtgccggcggattcgggggtttcatgaaccggttcgggcttggcttcggtggctggtgcaggagctgccgtttcggaagaggaagcttgagctgaggacttctgctgactttcagccggagctttttcagctgcatcaacattggaatcaacggacggcttcaccgtggaagaatcagccgcagccgactttgcttccgcggcaagacgggcgtcagccttggctttcgcatcctccgtggacttatcgacggcgttcttgcgggtcttaccgagccaccaaccgccaatcaccagaattgccgcgatgacgacaacggcgacaatcgcaataatcacattcgtatccatgactccagcctaaaaagcgcaacggacacaccggctccgccccgcggacgcaccacgaatgtccgattctgcagaatcggacaacaaaccatccgaatccgacgttcagatgaccgattcgggagaaacggacaagtagacaacgtcatacgcaccacagttgtccgattcaccagaatcggacagactatccacggggcatgaaaaactggacggcatggccaatacatccagaatgacgtcgtatcagcggcgcgagcagctcatcgaaatcggtcgttcgctgttcgcgtcgaaggggttcgaagcagtgagcgtggaggagatcgccgccaccgcgaaagtgtcgaaacccattgtgtacgagcatttcggaggcaaagagggcctgtacgctgtggtggtggaccgtgagatgcgcgcgcttaccgacacgctcgtcaacgcgctctccgacccacaagcgcacccccgtcaaatcgtggaacgcacggcgctggcactgctcacctatgttgaggagaatgccgaaggattccgcgtgctcacccgcgattcgccgaaaaccgatccggccagctcgttcaattcgcttttgggagacatcgccctgcgcgtggaagacattctcgccgaagcgttcaaacgccagcatctgccggccaagggcgtgccatactacgcgcagatgctcatcggcatgaccgtatatacctgccagtattgggcggaccagcgcaaactcagtaaagagcagattgccgcgcacatcgtgaatctagcctggcatggcttgagccgcatggaagccaagccggaactgcgtttcgaaagcgacaaagccacaaaagaggcggaaaagcaggaaaggcgcgaaatcaaggaaatcgcgaaacgcgagcgcaaggccgcaaaagaggcacaatcacaaaacaatacggaaagcccagccgagcagaacgctgaacagaataccgaacaagacgcagccggaagccaaggcacgcaagccgaacagcagtcgtaacaacccagccgcccccagtcatcgcaagcatcgcagcccacgccaacaggcgccagacgcaagaatcgaacagtaccagcaacaggggaatcgcaagcatcgcacaagccaacaagcatcgacgaaaacttacaaattgtcaacaatggtacccttaagggaaatttcaggtgcagattgcgctattcagggtgcctattgcgtacaaaccgttcccctgaagcaaacaaggtgctacgttagtttcgttacgcagtgaccacgcgccgcgcgcggcaggtcacctcgtcctaccaaggaagactatgcaggagaagaagacgctcaccttcgtggtgcccgcgtacaacatgaccgaatatttggaacgatgcgtcatgtcgttaatcgcagcgaagcgcaacgacgacatcgaagtgctgatcgtggatgatggctcgtccgacggcacgctggaaatggcacagaaattcgaagcccgctatccaggcatcgtgcgcgccatccaccaagagaacaaggggcatggcggagccgtcaacaccggcatcgcggcggcaagcggcatgtacgtgaaggttgttgacgccgacgattgggttggccccgaatcgctcgaacaggtcatggccgtgctgcgcgaagaggccgattccaccgagccgatcgacatgctcgtcactaattatgtgtatgacaaggttggcaaacgcaacaagcatgtggtgaacttccgccatgccatgaaggccggcgagcgcctgacctggaacgatcttgggcatttcggcttggctgaatacattctcatgcacgcgctgacgtaccgcaccgccgtggtgcgagagtccggcatgcagctgccggagcacacgttctacgtggacttcatttacgcgtaccaaccgttcccgtgggtgaagaccatgaagtatttggatacgccgttctaccactatttcatcgggcgcgacgggcagagcgtgcagaccgatgtgatgatccgccgcgtcgaccagctgcgcctcgtcaaccagtgcatggtgcgtgcaactccggaacgcggcacggtgccggacggcctgtaccgttatatgatccacttcctggcgattgaaagttccgtggcaagtgtgttcatgattttgtctcgcgatccggaaaattatgagaagaaaaaggatatgtgggatgacattaaggcgtactcccccactatttacaaggatgtgcgcaagaaggccatgtctcgtgcgttgaatttgcgcgggtcgatcggtcgtttcgtgattcgcaaggggtatttcgtggcggaacacgtcgtcgggttcaactgatcgcgatttccgacgatttgatggtcaatcgacggtctagatagcactatctgccttatatatggcagatgcccttgatagcaaggtgacttagagggtatatttacccccgaaatcgccttgcctacaagcacgagtgccatatatataagcgaaatgcctcgtgtcagctctcgaaatctgccatatataagcgagatatgggcaaaaactgacgtacgaggatgcggatgcagccgtgaggctgtcgggagcagtactgacgcttccaacagcctgcgttcatgcggaatgctccgagcgcggaaaccttggctcattgggacgggttttgccggatttcggggctttatgcttagttccagcggtcggacatggcgaaactgttatgcatgagattgctggacgtgtagagcacgtcgttgagcagtttcgtaacgtgagtgcgcaagtattccgccatttcttcgttggactgctgcagtctggcgatggttgcaatacttgcgttttccgtaatctccgcggcccctgcacgctcctgcgattcggacgcgctcgtttgcgcggacatctcacgcaattcggcatcagtgcgttccaccagacgatggccgtaagcgcgggccgattccgcaaatccttcgatcgcattgctggtttcgtagaaatgcgcgtcggcgagcgcggcgatcaaacggttcgcccagtacaggttgccggtcgagacttccggcgtggtgtcacgcaggtaggcgggcgtatcgtcgacgttcgcatagaacggcgtggccgcggtgaaggggccggaaccgtatgagatccacatgatcgaacggcttgcctccggcgcgtacggacgaatctgcatggccaccatatgcccggtgcggttgatgccgatcggacggtagcgatggcggctttccggcgtcccgagcgtaccgtacggatcgtaaggggttccctcgaagtgtgcactcatcaggaagtcgacgtcttcgagcgtcacagcgttctcaggcacacgacaccacggaatatcgtcggacgcgggcgtgtagcgggcggccggcgaatcccaatcctcgcttggattgaggtagcgctgcatgtaccaggcacgcggcgtgttgtagatatggtctttggtggtggcggtaccgaaggctgtgcgcggattgaaatggttgtgacccagcgccgcgccgctactgctattgccgccaccgttcatgccgccgtttccgaaagcgctcgtcgactggaatccgaagccgccacttgctgccgcgctcatagtgcggtcaaggtggtgcgcgtccatgaattcgcgcagatcggcactgcacatgaactcgcgttgggtgctgaaggcgtcgtcgaagtcgaaatcgtcgatgccgagctggttggggatggtcgcatagcagtcgtccggcacgcggcgggcgatccaatggtgcccgccgattgtttcgacgtaccagatttcgtttacgtcggaaatgatgatgccgttcgattcgtaggtgccgtatgtttcaagcagttcggcgagacgtgcgacgccttcgcgcgccgtggttacgtaaggcagcacaagggtgatgatgtcttcctctccgattccgcccggaatttcaggggtatcagcggcttcgttcgccggttgcagttcaacgagcggatcagcggctagcacgcgctcgttgactgcgatggtttcagtggcgctcatcgccacattgtgctcgttgacgcccgcttccgcgagaattccgcgattcggcagcacgttcggcacaatgctgtatcggcatggattgtctggaaggtcaatttcgacatgactgagcacactgcggtaatgtctcggctggtcttgcggtgctaccgcaatgaatttcttgggatcgtaacgtccggaaccggaatcatcgtcgcgtgcgatgatggtggagccgtcgtagctggctttcttgcctacaagaatcgtggtacatgacatgcgttccactgtacgagcagatatgcagaaatgatattgcgattcgcgggaattcgatgatgattcggcaatgacttggtgataatccacgtttttcgttacttacaactgatttgtgtggcgttttgcgtaaatatgctgtatactgtctctctgttgcccctctagctcaacggttagagcagcgtccttttaagtcgtgggttgtgggttcgaatcccacggggggcaccgcgaaacccttggaaacattagcttccaagggttttcaattcccgcgattttttggctccagacgcaattagtcgcactcacattgttcgcgccccaaacacggattgtcacatcatcatccgcgccggtaaacaccctgccgtcgccatcatcggattcctcacccttacaggcaagacgccttgccgggatggcgccttgccgattccaaaaggcttccgccaatacagcggcaataggaaagtgggaaatcgagaaaagattgcaattccaacgaacacgccctagactcttaaaaagtcgctagggggcagctatcatggtccttcggaattcttatgagggggaactccacgcattcagggcggtatttcgaaggcatcgctttggggcaactagttacgtaactaagaaagggtttccccaaatgtcttttggcaaaaagattattgcgggcgttgcagctgtagcgactctggccgccttggcaccggcagtagcaatggctgatactgcccagaatcagaattctgcaacttcctcgcaggctaaagaagaatacgccacggtgacgttctacaccgctgacggacacagcatccagggagtcacctggcagaaaggcaccgccttctcccagtacgcactcggcatccaggcaccgaccatcgagggcaagaccttcaccggctgggcttactccgagggcaccatgctcaaggacaccgatcaggtgttcgcggacatcgccgtatacgcgacgtacgcggataccccgacacaggatgacaacacccagtacaccgtctccttctacgcaggcgccgaccagctcatccagaccgtcagctactacgccaaggacaaggcaaagttctcccagtacgcactcggcatccaggcaccggccgtcgaaggcaagaccttcaccggctggggcttcgcctccaacgacggcaacgtcgcagtcaacccggacgcagaagtgaccggcaactgggccgtctacccgatgtacaaggacactccgacttcggaagataagactctgaacacggtctccttctacaacaccaagaacgagctgatccagaccgtcagctactacgccaaggacaaggtcaagttctccacctacgccgcaggcatccaggcaccggccgtcgagggcaagatcgttttcggcgccaataagaataggcgtggagaaacggccttgcagatcggaagtgaccaaaccgatggttccgcttctgccgcttgccaacgattgcgccagcttgttcggggaatagttgagttgccgcgctgcctccatcacgcgctcgcgggtgtcttcgctgacgcgcggtttgccatgcagcgcctttgaagccgttgccaaagacacgttggccagcgctgctacatcttcaagccttgctgttgagtgagtatctgcagttgccatgatgttcccccttttttttacggtgtgacgaaaacgttggctgcgcgtcgatgcgcttcgccgcccttgtgttgcgtaatattatacgacaaaactgcgaaagttttcgcatcgtgtcaaaaagtggacaaaacggctttatatagccgattgctgacattttcacttgcaaattgcgaaactttcgcatttgcgaaaatgaacacatttttctttcgcattttctgcatctcacgtcattttttgctgtcataaacgattcttaaaatgctaagaatcgtttatttataacggttttatcgacatgaatacctttgcattctgatgtgcgaaagcgattttgcaaaatctggagaaaaccatatactgagaaaaggctttcgcactacggttcaatcgaaggagaacaaccggaaatcgtgaaggcagacggcggaaggcccgccggatggctcaaagctgagcgatacatagagaaagaagtagacatggtgtctttcaacaaggtcactcgcgttattgccggcatcgcggcaaccgcgttgcttattccgatggctgcatgcggcggtggttccagcagtggtggatccgcggctccggccgatattccggcagccggcactgatgacggcactgagatcactctgtggacccgttctccgctggagcgtcaggccaagaacgcggtgaaggcctacaacgcctcccacaagaaccaggtcaagctggaaatcattccgaacgacgatatggaaggcaaggttggtggtgcttcccagaccgattcccttccggacattctcgccggtgacgtggtgcgtattccgtactgggcttctgaaggcatcttcaccgacatcaccaagcagatcgacggactcgacaacaagtccgacctgcagcagggccacattgaagccggtaccgtggatggcaaggaatacacgctgccgttcatcaccgacgtttccgtgatggtatggaacaagaatctgtacaaggaagcaggtcttgacccggagaagggtccgagcagcatcgacgagttcgttgagcaggccaaggcggtcgcggccctcaacaaggacggcgtggcaggctcctacttggccggccagtccggtggcgctctcgtgttcgacctgttcccgtccgtgtgggctgacggcgaatccgtgatgaacgcagatggcaccgaagccaccctcgacaacgattccatgaaggccgtgctcgacgcctacaaggaactcgccaacaccaccaacggcttgggcgcaggctccaaggaagaaaccggtgccacctggaccgctccgttcgccaacggcaacatcggtgtgatgccgtatccgaacacctcttccaccgcactgttcgaagctgagaaggacggcggcttcgaagtgggtgtcaccccgatcccgggcaccaaggaaggcaagacctccacgttcctcggcggcgatgccatgggcatctccaaggactgcaagcacgtcgctcaggcttggaacttcctcgcatggctcatgagcgatgacgcccagaaggaagtcttcgcagccaacggcgacaccgcatccaacatccagaccctgaagaccgcctacgacgatgccgatcctcgcgtccagaccatcaactccgtaatcatcgacggcaatggccagaccccgaagtccgcagctttcaatgaggccttcaacgcagccggttccccgtggcagctgctcatccagaacgcagtctggggcgatggcgatctcaaggccgacaaccaggccatcaccgacgtgctgggtcagtgaggtgagccactgaaaacgaacttctcctcctttttctcctttccccgatttacataacttaagaacaactgaatatcgaataactgaatatcgaaaacaaaaatagacagaccacagttgtggtctgccatgaagatcgacaataattcaaaaacaatgtcggtcttcatggcggatttcaacggccgcacgagacggaatcgcacttccaaacgcatatccaatcgcttggccatttatgtcgaaaaccccgaacgattcaagagagagtcgccaaaagtgttccaaggagggaatatgactactgtttccaagaacgctgcgccagtgaagacgcatcgttccaaggccaaggcggaggcaacccgtcgtggcctgctgtatgcgctgcctgattggctgatgatcatcatgctgttcttcgtgccaatcgtgctgctcgtcatcatggccggttcccgctggtcgttgatgggcggtaaccgtggttggaatttccctgagaatttcgtcaaggttttcgaaaataaactgctcggacagtcggtgttgttcacacttgaatacaccgtgatcgtcacgattttcctgctggtgctcggccttggcctggcgctgatcgtgcaggaaagcaccaagtggaacaatatgctgcgcacgtgcttcctgctgccgtccgcaaccggtctcgcctctgcttcgctgctgttctacgcgctgtactccccgcaggtgggccccgtcaccaagatcctgagcttcttcggattgatggatgagggcggctccgtgctcgccaccggccagagcgcgctgtgggccaccattattgtgatcgtctggcgtttctccggctactacatgctgctcatgatgatcggcctgcaggccattccgggcgacctgtatgaggccgcgcgcatggacggtgctggcacgtggcgcattttccgttccatcaccctgccgctgatgaagccgaccatcgtgatgtgcctgatctactgcgtcaccggttccatcctcgcgttcgaccagttcttcattctgaccaagggcggtccgaacaattccaccatgaccgtggtgcagctcatctacaacttcgcattcgattccaagaaggatctgggcatggcggccgcactgtcgctgatcgtgcttgcggccctcgtggtgatcaattccatccagatgcgcggtatgcgcgacaacaccaagtgagcaaggggagggaactcacatgactactccattgtggaagcgcgtaatcgtctatattctcgaaggtctgctggctctggtcttcatttcgccgctgatctgggtggtggtctgctcgttcagtccgcagcctggttccgcacaatccaagggctggggtgtgaacaactatctgacgttgttcggctaccaggaaggcctgccgaagtacctgttcaactcggtggtggtgacgttggtcgccgtggtgttctccgtggtggtgtgcacgctcgcaggctattcgttctcccgtttcgactatccgggccgcaatctcggattcatggtgacgctgtccattttgatggtaccgtatgcgtctctgctgattccgctgatggtgtggtacaaggatattggtctgaacgattccttgctgggtgtcggtttggttattaccttgttccagctgccgatgagcacgttcatcatgcgtaatgctttcgatgcgattccgaaggatatggaagaggccgccatggtcgatggctgcaactccctgcagtcgttgattaagattctggtgccggtcgtcaagccgtcgatggtcactgtcggtctgcttgctttccttgaggcttggaacaatttcatgattccgctgtacctgtcgagttcgtcgaacgccacgctgccgctcgctttggtgaacatgcgtcagcagactatgggcgtcattgattacggtgccaccgaagctggcgtcgtaattctgatgatccccgcagccatcctcttcctagccctccagaagtactacgtcaaagggtttatggctggagccgtcaagggctgacacctggcgatgtcagcccttgggagacagcccagtggactgtttccaggctccggcctgagcagaaccgaaggcggagtagccaagagccgtcaagggctggcgaagtccttaatcttaaggaaatatcatgaatgtaactattacttctcctttctggaagcagcgtcgcgaccagatcgttgaatccgtcattccctatcagtggggtgtgatgaatgatgagattgccactgaagttccggatgatccggctggcaatcagcttgccgataataaaagtcatgccgtggagaatctgcgtatcgcagccggtgatgagaccggtgaatttcatggcatggtcttccaggattctgacatatataagtggttggaggaagcggcttacgcactgtcgtatcatcctgatccgcaattgcgggaactgtgcgatgaaaccgtcgacctcatcgcacgtgcgcaacaatcggacggatatttggacactccgtaccaaatcaaaaccggtgaatgggcgcatcgtgagcgtttcacactgattcagcaaagccatgaaatgtatgtcatgggccactatattgaggctgctgtcgcctatcatgaggtgaccggtaaccagcaggcgcttgacgtggcgtgccgtatggcggattgcatcgatgccaatttcggcccggaggacggcaagatccacggtgctgatgggcatccggaaatcgaattggcgttggcgaagctgtatgatgcgaccggtgaggagtgctatctgaatctggcgcggtatctcatcgacgtgcgtggtcaggatccgcagttctacgccaagcagatcgccgctgtcgacaacgactacattttccgggatctgggattctacaagcccacgtacttccaagccgcgcagccggtgcgcgagcagcagaccgctgacggccatgctgtgcgcgtggcctatttatgcactggaatcgcacatgtggcgcgtattaccggcgatcagggcttgctggatgcggcgcatcgtttttggaacaacatcgtgtcgaaacgcatgtatgtaacgggtgcgatcggttccacacatgtgggggagtcgttcacgtacgattacgatctgccgaacgacaccatgtatggcgaaacgtgcgcttctgtggcgatgagcatgtttgcccgccaaatgcttctgttggaaccgaatggtgaatatgccgacgtgcttgagcgtgagctgttcaatggtgccatcgcgggcatcagccttgatggcaagcagtattactatgtgaatgcgttggagacttcgccggacggtttggacaatccggatcggcatcatgtgctttcgcatcgtgtcgattggtttggctgcgcatgctgcccagctaatgtcgcgcgattgatcgcgtcggtggaccgttatgtgtataccgaacgtgacggcggtcgcacggtgctcgctcaccagttcattgcgaatcaggcaagttttgattccgggttgcatgtggagcagcgttccgattttccgtggaacggtcatattgagtacatgctggaattgcccgctgaggcggctgattcggtacgtttcggcgtgcgtattcccacatggtcggctgattcctatgcgctgacatgcgatggtgttgctgtgaagacggctccggaaaacggtttcgtatatttcgcagttgctccgggaactgcattgcatgtggtgctggatcttgatatggcagtgcgattggtgcgtgccaactctcatgtgcgttgcgatgcaggtcgtgttgcggtgatgcgcggtccgctcgtctattgcgcggagcaagccgataatgccggcgatctgtggacgtaccgtcttgctgatggcgtggatgccgcggatgccacggttactttcgagagtgatttgcttggaggtgttgacgcggtgacgttgcctgccgttcgtgaggctgcggatgccgtggacgccccgttgtacatgtccgctcagcgtgacgcctcagatgagcggacgtcgctcaagctggtgccctactacgcatgggccaaccgcgaactcggccaaatgaacgtgtggttgcgcagctaaacaaaagaaagacttgctacccggcgctatgagtgccatggtgccgggaagcgggtgagcgcggcgtgatcgattggagccgaatgcgccgcgctgactggaatgagagaccggctgccccttatggggtggccggttttgtcatagcccctagtataagacgggaaaatgcgaaaactttccttttcgcataaaagccatcgtatggcagttcacttagaaagcattggagaaaactgaaagaaaatttgcgaaaccgtattcgcgtcatgtattcttgaaatgtcggtggacgctccaatctcatgtccatcgcacgactctcattcctacagaaagaaagttggatgccagggaacgagccttggcaaccaagggccaacgatggtccatgtaggaggaattgatgacaccatcaacaaggaagaaagggattgtcacgtcattgggcgtgctgacggcagtggccacactgttgtctggcggtgtgatgaccgcatacgccaatgacgcgctggccaatccgaactctgccatggggtatccgagtttcaagggggccgccgacccgattccgggcaccggcgtcgctttcgatccctcgacaagctacctcaagcaggtgttcgatgcggatgttgccaacggtgccggaaccgacaccgcacacgacttctggatcgacaagatgctgacgcgcacaggcaccgcaccaaacggtaccggcaccaacgatgctggcgactacaactatgcgggcgcagacaagaacgaatacctgttctcacgtggccgtgccgcattcatgtacacgcatacgccggaagcacttggtttcgtaggagatgtcgcatactgggatcagaccggcaacgacggctttaccgttgaggtaagcattggcggttccaagcagaccctgcgcgagaacaccgacaagcgcaagcagacgccaagctacttcaccacggaattcaccaacggcgacaagaccattaccgtcaccgaagtcaagtacatcacctacaccaatgtgatggtcgcgaatttcaccatcaccagcaccaccggcggtgacgtaacgctgacagcagcctcgccattcgcacaagacggcaatgacggcgacactgaactgaccggtcgcttcaatgtgaagaacgatctgaccaccatctatccacggttctccggcaacggtttcaccgtaaaggacggcaaactcgcttccaccctcaccttggaagcgaacgtgccacaaaccaccaagctgcagcttggcctgatcgccaacgagttgccggactccaccgcggaatacgaagcccgattcaacggcgatctcaccgatccggccgcttcctacaaggattccgtgaccacctacaaccagtggtgggtcgataacattccttacgtggaaacccaggaacacaatatcgacaaaactgtgttctaccgctggtggctgagccgtttcaacatgttggacgccaatatgccgggcaatacgttccagtatccgacctccatcgaaggcgtgctcggatacaacaaccagatcgtgctgacatccggcatgttcatcaacgacaccaagtggttccgtaacgccgaatactcgtacggcacttgggtgtcggccgggcagacagccaagaaaggccagtccgggtattactactaccacgacaatccgggcgatccagccaattggaaccacagctacacgcagtacatcaccaaggccggttgggactcctacaaggtgcacggcggcccgtcatcattggctgaagcgttgggtgattacggttccgaagatgtcaaaggtctgctcaattcgcaaagcgagccagacagcaacgacaaccagaatagcaacggcaacaagctgatcgactggtcgtggtggtccatgaccggcaacgatgccgacgcggtgtcgttctccgaacccggtcgttccggccagcgtatggaccgtgccgacggttccgccaacatgtgggccaacgccaatgccgccgcgcaagcatacaaggctgccggagacaccgaaaaagccgctgaaatgcagcagatcgccgacgccatcaagcaggatgtgctcgacaacctgtgggattccgacagcaaactgctgctgcacaagtggctgaacgacggtcaattcgcgaaatacaaggaactcaacaactactatccgtattccgaaggtctgatgccgaccggcaatgatgattacgatagtgcgttgcgcttgttcgaagatgccgacgaattcccgattttcccgttcttcaccgcgaatcaggcagacaagaaggcgctgaatttcccaggatcaaacaatttctccattatcaatgcaactccgctgctgcaaatctattctgcgggaatccgtgattataatgctgcagacaacggatatatcacgaacgaatcgttcaagaaactgctgtattgggtggcgttctcgcattatcaaggaggcgacaaccagtatccggaccagaacgaattctggaatatggataataattccgcaggaagcacgattccggagaagaacgccgacgccagcaagaacggtggaaagatcacctaccgttcctggattcaccacacccagcttggcaccaccaactggacgattgtggaagacgtggcaggtatggttccgcgtgaagacaacaagattgaactcaatccgatcgagattcccggttggaaccacttcaccgtcaacaacctgagctaccacgggcaggatctgtcgatcgtatggaacaacgacggcgcctacaacgctccgaagggatacaccctgtatgtggacggcaacgccgtgctcacctccgataagctcgcccacctcatctacgatccggccagtggaaccgttgaggttgccgatgattccggagcggtgatcaccggtgcgaccaccgccaccatgccgaacgccaacgaagtgacctacgcatcgaacagcagggttacgcagatcttcgcgcagtccggacagaacgtggacgaagcgtccaagagccagcccaacgtggccaaggacggcgatgtggaagccacttacgaaaccaagggctacccggcaaccaatgcagtggacggcaagaacgtgatggaatccttctggggcaccaagggatccaagaacgccaaggattcgctgaccgtaacgttcaagaacggcgtgcagaacatcgacgacgtgcgtttgtacttctaccagacctcgtccagccagacgattgccggctacagtgagccgtcggtgtacacgcttgaatatcaggatgaggccggcgcatggcatgtcctgccgaaccaggtgcgtacgcctacttacgcgggagccaactacaaccgcgtgcagttctccaaggtcgtggccaaagccattcgtgccaccttcactccgcaagcaggtcaggccattggcttgaaggagattcaggcctacgaaaccgacattgtgccggaaggcgaacctacgaaccaggcgccaagcgttgacgcctacattgccagcagcacctcgtccggtgcgcagctggtgggcacggtgaaggacgacggcctgccgtctgacacgctcaccaccacatgggagcaggtgtctggccctgaaaacggcgaagcgaagttcgtcgacgcaaccgctgccaacactacggtcacgttcaaccgtgagggtgactatgtgctcaaactcaccgcattcgacggtgagaagaccggtttcaaggaagtcaccgttcacggcattccttccgacggcacggtgaatgtggcttcacagtccactgcgagcgccagcttcaccaatccatatcaggcgaaggacaatgccaagaaggttatcgacggtcaggtgttgtataccaatactccgaatgagacttggaataattggggtgacaataccggtaccgagccgtggctgcagcttgcctgggatggcactgttccgttgaagaaggcgaagctgttcttctggactgacggtggcggtgtgccgatggtcaagtcgtggaagttgcagtatgcggatgagaatggcgattggcaggatgtgaagcttgccgccggccagtcttataccacgatgcagggtgaaggcaatgaggttcgttttgccgaaacggtggagacgaacaagttgcgtgtgctgttcccgaagggtgccattgttggtgctaccgaatttgaggcgtatgcgcttgatccggtgagcgtggatggcgtgaatcgtatggtgcagactggcagcaaggctgccgatgtgaatctgccgaagacggtgagtgccagctatacggacggttcccgtcgtgacttgagtgttgcgtgggatgccatcactgacgatcagcttgcttccgatagcgagtttgcggtttccggaacggttattggcgcgctcgctggaaccaaggccactattggcgtgcgttccgacgcgcagtctcagactgctggtgcggctcagccgatcgaacagacggtgtaccagaattccaagtcggtggctttgccgtctgtggttccggtgcgattccccaacggcatgcttgacgatcgcacggttatgtgggatgaggcaagtgttgccggcgtcaagttggacaccatcggcgattatgaggtgtccggcacggctgagggttcaagctcgcaggccaagattacagtgcatgtggtcgccgatccgaatggtggtgccgatcctgatcctgagccgacgccggatcccaagccggagcccgatactccgttgactggttggattgaaggcagggccattgacaccacggtgagtgccgaggcgagctggtctccggcttccggcaagctcaacgatggtgtgctggttgacgatacgtggccgtctgatgatgacgccgatgtgaatggccgcgtgtggggcagctggggtcaagcttccgctggcatgtacgcgcagtacacctggagcaaggaagccaccgtcgattccagccgtgtgcagttctgggccaacttcgcggagcgtaatgatgccaagggtggtttggatgttccggacagctggaagattcagtacttggcttctgatggtatatggaaggatgtggagaatgcgcaatactccaccgtgcgtaattccccggcctcacgtgcctctgacgatgctcaaggctggagcgtggccacgttcactccggtgaagaccacgtcgttgcgcttggtgcttgatccgccgaccgccgagggcgtcaccttcggtctggcggttgccgagtggggcgtgcatgctgcggaaagcactcctgatccagaaccgactcctgacccggatccaacccctgatccggaaccaagcgtggacaagagcaggctcgaatccaccatcaacgcagccggttccgtgcaacaagctaatttcacgccgaacagctggaaggcattctccgaagccatgggtaacgctcaaaaggtgtatgcggacgagagcgccacccaggatcaggtggatgcggccatcaagcagcttgaagaagcccagcagacactggtgaagaaagccgacaccactgagttgaagacggttcttgaccaggcacagggcgtcaacggtgacctctacaccgaagccagcgccaagaagttggctgaagcagtggatgccgcctccaaggtgctgaacgatgagaacgccacccaagctgatgcggatgccgcagtcaagcagctgaccgaggccatcgccggacttgaactcaagccagcaccgaagccggacgacgacaagaccgaccccaagccgaatgccaagcctggaaacaagccggtttccaagtctgaagtcagtgccgcaatcagcagcaccggcagcaatgtcatcggcatcgccgtcgtaggaatgatcgtcctgctgacgggagccgccatcatgctgacgcgccgcaaccgcgactagcgctagcaattgctcaagtcctcttacggatcgcacgaggaataccaacgtagcctaagcaatccgtaagaggacttttcaatatccaatcgtgaaaacaggaatattcatgagcttttcgcacatctcacatgcgtcgatgaagacgctggtggcaggcatcgcagccgcagccaccttatgcacgggagcaatcgcaaccatgcagacagccaacgcggccgacgcaagtaccgcgcccagcatcgccggacacgcctacaacgatctgccggtcggcaatcccgacgtcaccgtcacacaaatcgacaacagtgcgttgccggcaacccttcgcaaccccatcgggcagaacgaaggaaccaatacccccaacgacctgtcgcaaaactactattccgcagacgcatccacccttgaatacgatggcaaactcttcgtattcaccggacacgacgaggccgaaccaacctacgggtccttcaatatgaaagactggggcgtctacgtaaccgacaatccggaatccggcaaatggacgcactacaagaccatcgccaaagccgacctgttcgactgggcaaccggcgacggagcctacgcaggacaagtagtagtcgacgatgctggcaccgcagacacggccgacgactggttttactactacgttccagtcaaagacaggaacgcagccgcgggagccgacccgttctccatcggcgtggccaaatcaaaaagccccctcggaccatgggtcgacgccatcggagcgccgttgctgactaccacgcagacgcaaatcgaaaccatcgatcccgcattcttcgtggacaatgacggtaccggatatctgcacttcggcaccttcaacagcgaactcgccgtaaaaatgcagcgggacgccaacactggccgcacctcatatgttgccgtggaaaccatggacggaacggcggacggagcgccgaaaatctacaatatgcgtgacgccgacgcgctcgccaacatacccgactacgatgccagcaaagacgtgcttggcagcgactatgcgaaccaagtgaacgcgtcgctgaccttgggcaacaacggcggcgcttatgccaacgggcccaaaggcttctttgaggcggcatgggtgttccgtgaaggagacacctactacaacgtgtacgacggtggcaaacccgggtcgggagtggcgacctgcgtggaatccaactatcaggcgtgcgtgcaatactccacgtcggcaagccctcttgggccgtggacgtaccaaggcgtaatcgtcgaatcgggatcgtccaccaccatgcatccgtcgattcaacgattcggcggcaaatggtgggtcacctaccacactggagacaagactggtggtactgacttccgccgtgcagtctgcatcgatgaagtgacgtggaatggcgggcgcataaacgccgtttcgcatccgaccaaagccgaacggttgcaaccctcacgcaacgtggccccctatgcgtcagtggacgcgacctacaccgaaacacccgcctacaagggttccgtgaacgacgggcgagtgctggaaactgctgtagtaccgccgaaccattggacgaactatcgaaagatgccacaaacacaatcctccgattcactgatctaccagtggaatggcgctgtacgtgtgaatggatcgaaagtctggttcgataccgatgcgaacgcattgcgtgcccctgcctcatggaaactgcaatatcttgacgcagacggttcctggaaggacgtgcccaattccagcgaatacggcgtggatacaggcaagaacgcgcctaatgaagtgacattcgacgcagtgaccaccactgcgctcaaacttgacatgaccgcgcaagccgttgacgggggctatgcttccgttggcgttcctgaatgggaagtatacgcgcaacagggagcagttgtggctgaacggccagccgacgtctacgccaagaccggagacgcgccggaattgtcgaacacggtgaaagtcgcgtacggctcggaaacagtggaaactccggttttgtggcgcacggtgtctgcttcttcgtatgcgcaggcgggtgagttcaccgtgcaaggtgtggttgctggcattgaaaccaagcagcaggctgatgatctgacagccggcaacgtagccgtgaccgtacatgtttccgacgattacgtaaaaccggctgataccattgctcctgccgtgcgtgtggcattggctggcacggctggcaatgatggttggctggtcacttcaccgatcgctcttattacggcttccgacaatgcggctgcgccgatcgcaaaactcgaacttgcggtcggggatggcgcatgggtgaccgtcggaacgaatgtgaacactgcggtacaggctgtgactggcgagggtatagtgagtgtgcgtgcgcgtgccactgatgcggccggcaatgtgagcgaaatcgctgctgcagaagcgcgtgtggatgctacggctcctacggtagccgcctcggtagatacggcttcccgcactatgacattgaccgcctcagatggtgctggatccggtgtgaaaacggtggaataccgggttggaaacggcgaatggcagcaatatgaagaaggcgcggcgattactgcttcttcgtcgaagcgcgaaacggtgagctatcgggcttcggacattgctggcaatatgtcggctgcgggcgtcaaagatattccatccgatacgtcggtgccgttggccggctatatcgagcaagatgccgttgctactgacgtggacaaaaaagcgtcttcttggacagctggtgttgccgcgcttaacgacggcaaaaccattccgggcgattgcacggttgataacgcctgcatttggggtacgtggccgaataccggtgaaatgaagctcgactacgaatgggatcgcgaagtcaccatcgattccagccgtgtgcaattcacctccgatggagggggcttgggaatgccggcgtcgtggaaactgcagtattgggatgctgaaacgaatgcgtttgtggatattcccgatgccacatatacattggtcaccaatgctcccggcgcttacggtaccgataacggcggatggagcgaggcaacctggactgacgcggtgaagaccactaagctgcgcatggtgattcaatccggcagtgcatcgccggctgccgccgaatggcaggttcatgcacctgaaccgactccggacccgacccccgatccgacgcctgagcccgagccggaaccaacgccaactccaaagccgactccggatatcgataacaacggcaagcaggacggtaataatgtcaagccttccgcgaaaccgcaatcatcgcagcaatctcagtctcaacgtaagaagaagctaagctctacaggcgtcgctactacggcaatcgtcattgccatgacggtgctggccacggcggggtgctgcatcttcgtagccaagcggggcaagctgcgtaactgaatccaacataaaagtggtaagttctcagcctcggcctctggactgaatatgtgtgcttgacgcactcaaggtaccgttacgcggtcttcgcggcaagccgctcacttcgcctgaggaaaacccactgggctttcctcttcacggctcagtggccaagcctacgatcaagcacacgtattcagccgccgacctttggggtccgacccctacgtttgtgtgaactcggacgtcatcggaccccattttgctcataactcgcctatgtatggcagatttgcgggtctgtcaggaagcatctcgcctatatatggcagaagacttcgctaaaaagccatatagggggtatgaaaacgcatgttttctgactccagtctgccatatataagtgagatgcctcgtgacgagactcaaaatctgccatatatagtcgaggtatggctcggctgttggtggcttgagacggcgacatacgatcgcggatcgcgtaggtggtcgccgtttttgtgatttatgggctaatctcagaagagacagattcgatggccgcgaacggtgagaaccaacgcgagagaatgcgcgagcggccgcgtaagggaggaaagcccatgtccaaatcattcgtcaacaaggcgctgctcggcggcgcagtcgctgcaggcgccgcagtgtgggcgatcgcgccgcgtaccttctccgataagcgccgcaattatgtgccgtccattcccgacgtgtggtatgcgcatcgcggcctgcatgacgcgggttccggtctgaccgcgcagtatgccaacgagagcggcgagtatgtggcgctggcacgtcgcatggccatgaaggccggctatggcagccccagcgtgactggtgcgatcgctccggagaactcgcttgcggcattcgcagcggcttgcgaagccggctatggcatcgagcttgacctgcagatgaccgccgacggcgaaatcgtggtggtgcatgacggcgatctgatgcgcgtcgccggagatccacgccgtatcgccgatctcacgtacgatgagctgacccgcatcccgctgttcccgaccgacgcccccggtgccgctgtggcagcgccgttgccgggttcgcttgaaaatccgccgctggtcaccacacctgacagcgctccggaagggtatttccagcatgtgccactgttcgccgacgtgctcaaggtagtggcgggtcgtgtgccgctgatcgtcgaatacaagttcgacgacaattccaagtgggatccgcgcgatgtcgagctcatggaaaagggcgacgcgctgctgcaggcctattccggcgcgtatgtgatcgaatcgttcaatccggcagccgtcaactggtacaaggagaaccgtccggaagtgtgccgtggccagctttcctggtggccgcaaggggaggagaagccgtctgatccggccgcgctcgccaaggaatatgcggccggtgcgctgattttcgactggatttcccgccctgatttcgtcgcctacgattggcatggcggcaacagtccgcaggtacggttggctcgtttcatgggtgccgttcccgtgtcgtggacggtgcgcagccgcgacgagctcgcccagtgcgatgactggttcgaccatcatattttcgaagcgttcgtccccgacgagcagtagaggttttacatatgatttcggcctgccgccgcatgatttgcgttgtggcaggccgtttttattcgatttacttgattgactgattgggttgattcggttgagctctgatgcggtcagtcgatcacgccatatagacggtcgccggcatcgcccaagcctggcacgatgtagcacttgtcgttgagcttctcatcgacggcgcacagcaccagcttgaacttaatggatgggtcgaggttctcctcaacgaacttcaggccttccggagcgcccagaatacacacggcggtaacatcctttgcgccgcgctcggccaggtaatgtgttgctgcgaccagcgtgccgccagtggcgagcatcgggtcgatcaggaagcactgacggccgctcagatcgtcgggcagacggttcgcgtacgtgatctgctgggttgggttctcctcgtcgcgcttcatgccaaggaagccgacctcagcggacgggatcatcttggtcatgccgtcaagcatgcccaggccagcgcgcagcacaggcacaatgatcggcgccggggaagcgatgtgcttgcctaccatcggagcgacgggggtctcgatcggcttgtccacgacttcgacgtcgcgggtggcctcgtaggcctcaagcatcacgagttcggaaacgagctcgcggaacgtggaggacggggtgttcttgtcgcgaagaacggtgagcttgtggtccaccagcgggtggttcaaaacatgaatatccatgtcttctaagcgtagtccataatcgcgaggaaaagcgcgggaactgggaaaggagccaagaaagaaactgaaaatcgtatgaaaaaagcaacgaaacttaagaagagggaaagcgccgaaccacgaaagcgcctgtcggcgcaaaggccgctcgcagcggcaaaaaatggagcccggggctatgcatggcccgacgcggattcctattctacagatgctgcagaccgtacgctacgtcgtgtcgcgaattgatggtgcgagcgccgtaaaacacttccggtagcggtacagaggtgggtgcagaggcaggtgcaggggacaggtacggaacgcgcgttactccagttttccgcgacgccacagattcgccccatggcgaaaatccttggccgtgacgaacagattgccggccgtgtgcatcaaacgggacgatttcgtacgtacctgcttttccatggcggaaatgccggaatcgctgctatcggaaccttccgcagctttcaatcgtgcgatcatattgcgtgcctcgatgcgcaatcccaacgcaaccacgtcggtgaacgcggccgcacgttccagcgcaaccgcaaaatcgccggtgaacgcgcctgcgagaatcgaatcggcaatatgcgcaatgtcatcttccgtgggcgcctgatcgacgccggcaatcgccgaggcggtagtggcaaccggctctccagcgcgccacaaccgcgcgatcgactcgcgattcttccgcatccacgtgcgcagcagatacagccgccacagaatgcccggcagcgaatccggctcggcgctgctccacagttcggcgatcacgtcaacgccctcgcggtccaccagcgtgagcacgcgctccaccagttcggcatcctgcgtatgatgcacgcggtccaacagtgcggccgccgaagcgtggctcatctcgttgatttgcgccggatcggcacctcccgcgatattgtcggccatcatctggtcgagttgccccgggcgggccggacgcggcgatccggtgttggtgaaaccggcggaacggcttggtacaaccgatccggaaccgtaatgcatgctagtagacaatgggcgaaaccttttgaatatcgataatgctgggaccttgcggcgtatcgattataaacagcgctacggcggtgccggtaggcatgaacggcgttttggcgatgagctgcttggagagcgctttgcgggcgcatagtccgcgcaagtgatcgaacatgcctccgataaccggtcggtgcatgcagatcgccgtggtttcgcgggtctcgagcgtgagctggatctgcttgaggaacgccagccatgcgatggtcgggtgctcggcgaaggcgtcttcggtgagcgcgtcgatgtgttccatcgggcgttcggtctgccagctaagcacctgcagtgtttcctggcagcgcagccatggtgaggttgcgaggcgggttgggttgtagcaggcgagttcgcggttgagtgcgaatgccgcggccgcgcctttcggagtgatcggccggttcgcgtcggtgcctttccaggatttgcgcgattcggctttggcgtgacgcacgatcatcagattctgcgcggtcgcggcaccctcctgtacgcggtccacaaaaatggcgagggtgtctttatcggtggaatgcgtgaggattttacgtgcttcacgtacggaaacccacacgatatcgttgatttcgcctacatccgcgcgatgcacggggccgaatgcgtcaagcagatgttccgcatcatctccggaaatcggttgcgccatccaatacaacgtgtgcttggtgtcgacggcgcgatcgtgtgaatgccgggttttcttgccttcttcggacagtggatattcgacttcgcacagatacgggccgagtgcgatggaaacgcctgtctcctcgccgatttctcgcactgcggcatgacgatgcgattcgccctgctcgagtttgcctttcggccagctccagtcatcgtactttggtcgatgcacgatgcacacttcaatgctgttgagttgttcctttggagttttctgcgctgcgattgctggattttccgcgatttcgctaccggttttccaccgccatacaatgcccccggcggcttctacgacacgtctcatgctctcgctcatatctttcattgtaagtggttgggcacgggtttccccatgattgcgcgacggcaatcgtgccatccgagttttcctgcgttttcccacgatggtgatcgcgtatgccgcaacataggaaatggccgattctgcaacagcagaatcggccatttcctatggtttagtgccttgccggtcggcgcgtatgcttcttgatgagatattcctgggaatcgaccagcgggcgaccctcctcatccttcgcatgacgcacgtaggttccgtcggctgccatatgccacgaggtggtggaatcggccatttgcagatccacgtacttgatcagctcgtcgatctgctccggagcggtgatgcgtaccagcgcttcgactcgacggtcgagattgcggtgcatcagatcggcggaaccgatccacacttccggacctgcggccggaccttcaccgatctgcgggccatcggagttcgcgaatgcgtagatacggctgtgctcgaggaaacgacccagaatggaacgcacgcgaatgttctcggaaagtcctggaacacccggcttgagcgcgcagatgccgcgttccacgatgtcgatcttcacgccggcctggcttgcacggtatagcgcgtcgatggtcttctcgtccacgatggagttgaccttgatcttaatccatgcttccttgcctgcgcgtgccgcatcctcttcgcggcggatgcgctgaatcagaccggaacgtacggtacgcggcgctaccagcagacggtggaagctcgacttcggcgcataaccggacagctggttgaacaggcgggtcatatcctggccgaccaccggatcgcaggtcagcaggccgagatcggtgtagatgcgggcggtcttcggattgtagttaccggtgcccacatggcagtagcggcgcaggccgtcggcttcctgacgcaccacaaggctcagcttgcagtgggtcttcaggcccacgatgccgtacaccacgtgcacgccggcgcgttccagcttgcgtgcccatgcgatgttggcgtcttcgtcgaagcgtgccttgatttcgaccagtgccagcacctgcttgcccgcatgcgccgcgtcgatgagcgcgtcgatgatcggggagttgctggacgtacggtacaacgtctgcttgatggcaagcaccttcggatccgccgcagcctgcgctaggaacgcctgaacggaggtagagaacgaatcgtacgggtgatgcaggaggatatcgcgttcgcgaatcgctgcaaaaatgtcttgcgcgcgggacgactccacctcggcaatctgacgattggtggtcggcacgaacgaacggtacttcaagtccggacggtcgatgccgccaagttcgaagagcacggtcgcatcgagcggtgccggcaggcggtacacctcatcggcgctgacgcgcagctggtcggcgagcagctgggaaaggaacgggctggtttcgtcggaaatctcaagacggatcggcggtccgaaacgacggcgcagcagctccttctccatggcgttgagcaggttctctgcatcatcctcttccacgtcgatatcctcgttacgggtaacgcggaaggatcgcgcttccttgatgatcatgcccgggaacagggattccaggtgcgcgatgatcaggttctccatggtgatgaagccgtagcgcacgttggtggcatcgtcatcggtcatgtcgtcgacgggcacgagacggttcaggtttccaggaatcttcacgcgagcgaagtgggacttgccggaagccgggttctccaccagcacggcgaggttgatggaaccgccggaaatgtacgggaacgggtgggccgggtccacggcgagcggcgtcagaacagggaatacctgctgacggtagtagcgtgacaggcgctcctgttcggctgcggtgagcttgtcccagctcagcagcacgatctgttccttcgccaggtcgggaagaatgtgatcgatcatgtagtgcgcgtgctcgtcctgcaggcggtgcgcctgctcgctgatggcgcgcagctgctgccttgggctcaatccggaggcggccgtcacggcgatgccggtgtcgatgcggcgcttcagacctgcgacgcgaaccatgaagaactcgtcgaggttgttcgcgaagatcgcggcgaagcttgcgcgttcgatgatcggcagatcttcgtcttgggcaagttcgaggactcgcttgttgaacttcagccagctcaactcgcggtcgaagaagcggtcgttcggcaacggctcttcgccggcctgaagctcacgcttgtcgtttttatcggtctcggcgatatgctcagctatctggctgcgcaagatcgccttcgagggtgcgtcaaaaatctgtgccatactttcctactttatccttaagtagctggaaatgctgtaaaaagccggcaaaatttagctggagttaacattcgttcgctcattgtgcaaattagggtgtcgacacgccgtgtttttgccgcaaacgcacgcaaacgaacaaacacgccttgcgtttcgcacacgatggagcatttttatgattcttgcgatcgtaaagcaacagttgcgacaaatacggaacatcagccggtttcggtttgcgattgccggattgctgagcataattacgaagtacaagaacaacttaaagagcagagcccacaaagagtgtatggccaagataggtcgttacgttgaacgggcattggatagacttaccgttacgacgatgttgttgtgcagagattctgcccttaaggttcttgcaaggaaggcccgctcggcgggccttcctttttgtttgcctgttctcagggaatttttcgggaaaacgacggacgccgattatcgtcgttgtgtggataacggtgcataacacgccggggtcgtggataactcgcgtcctccgaccacagggccggttcagcttgcaatggtgctcgccgaagcttttcaatcgacggtatgagtaatgcaacgtctttttcgaatgttcctccggtgccgctgccgtcgggcgggctgttgccggtcgccggcgcgatcgcgccgcaagcgtcaccgccgacacaacgcagaaccgtctctgcgcaacggttctatacgccgccgggatcgaatcgcggtggaacgcaactggttggcgctgtgcctggaacgtatggcatggttgcgcaatgcggtcgcgcatcggtggaggaaccctgcgatatgggcaatgtggtggttatcgactccgtggtggcaggagtgggcacgagcactctggccgccttactggcccgcgagctgagcgaacgcggcctcaaatgtgtgctcgtcgacgccgatctgcaaggaggtgggctggatgtgcttcttggcgtggaaaacgaggacggctcacgcttcggggaaatcagcgctccgcttggcaatatcgacggcaaagcgctactgcgggagctgccaatctgggatggtgtgccattgctggcatgcgatccttggaaaaccgaaaatccgcaatcgtgggaagtgcaagcgtgcattcatgcgctatcgcaggtgcgaagcgtggtcgtcgtcgatatggggcaatggaacggactgcaggatttgacggaactgcgcaaggccatccgcattaccgtggtcgaactgacggtacttggtcttgcgcgggccaaagcgaatctgcgggcgcattacggttcgatcggagaacacgatgccgcaacgcaggaacgggagtttctcgtaggcgtgcaaccgcgcggaaccgtacgcgaccatggcacgacggcaatcgaggaagcggcggaatacctcgactgcgatatcaccgcggtcatcaaaccggatgccaagctttgcagcgaactcttggaagggcttggactgcgcaaacccaatcgtacgaacgcgaaagccatcgcaacgttggcggatctcattcaggaagcgttgggagaaaagagcatcagtcatggaactcgggccacttagcgacatcgcatccgagccgggcgtcaccgacatcgcggtaacctgcgacggaacggtgtgggtggatcgcggccaaggtatgcggccacatgcattgcgcgtgccattcagcggtccccaagccatccgcgatttcgccgtgcggctgtgctcgcagcttggcagaaggctcgacgacgcctgcccgatagccgacgcctccaccgtggaaggcgtgcgcgtgcacgcggttatcgcaccgctcgttcctcaaggcgccgccatcagcatacgattgccggacgttgttgcgcccagtctggaatctttggcggaaaacggcatgtttccaagcggatggatgcccttgctggaaggattcgtggaacgaagggccagcgtgctcgtgaccggcggaaccggagcaggcaaaaccacgctgctcaaagcaatgcttatgcgatgcgcgccgggggagcgcgtcatcaccgtggaggaggtgcgcgaacttggcatgctcaaccatgccaaccacgtgtcgctggtgacgcgcggcgccaacatggaaggcaaaggcgccatagggctgtcgcagctgatatgcgcgacgttgcgtatgcggccggaccgcattgtggtgggcgaatgcaggggcggcgaaatcgtggatctgctgcgcgcgctgaattccgggcatcgcggaggcatgaccaccttgcatgccaatcaggtgacggcggttccctcacgcttggtggccttgggattgctctccgggctgaatccgcaagccaccgcggcgctcgcgcaagacgcgttcgacgtagtgctgcatgtgggccgagtgggaggcaggcggcgcatcgcgcaaataggacggcttgaattcgcagagggaaaactgcggggaaacctattggccgggtggaacggcaaccaaatgcgggcttcgcaacagtggcctgatttcgtgcgcgcatggagtcgttgaatcgaggtgggcagatggaaagcctcagcattatttgcgcggtactgtgcggactggccgtatggctgtggcctcgccgaaacgtatgcgatgtgggcgaacgggcgggaaacgtagtggggcgcgcaggcgaaagccttgatgaaaaacctgatggaggattcgatgggcggtctgacggaatcgaagaggcgaacatgccgtcgaaaccattgcccgccatcggatgtgtggcgtgcgtggcttccctccgcgcatccgtgcgcagcggagccacattggtgcaggcgttcgaagaattgggtggaacgccgttcgccacacccgaacttaccaggcttcgcataaccatggtgatccgcagccgatgcccgcccaaagagcaatgcggccaagtcgaacggctgagcggcgagctatatgcggcctgtcagctgagcctgacgctcggatgcgaaaccggccgatgcctgcaggcggtggctgaatcgttgaaacgacaacgattattggatgatctgcgtaccaacgcattcgccatgcccaaagcgacggtgaaactcctgatggcgctgccgcagctcaccgtacttttaggggaaggcatgggagcgcatccgttgaccttcctcttttcaggggtcaggggttgggcatgccttggattcgcttgtgtctgctacgggttcggactcgtatggatacgcgcgttgatgaggcaagacgatatggacggcaagacggcatgaatggtatgacgatatgaaaggaattatgtaatgactggcatatggacgctgacggcggcggtgtgcgcggccgaagcgatgtggctgaagcagtggaggccggtccgtgtgccagccgaccttgcgcccgccggacgagtgcgggaacttccgctgccgctggtattggagatgctcagcgtcgccatacggcagggatcctccattccacgcgcgctgattgccgtgggcgatatcgctgcaggagaattcggcgcgggactacggtcggccggagaacagttgaataggggaattccttggaatgacgcatggccggatgatggcgatcttgcggtggtacgcgatgcgttcgcctcctcatggcacagtggcgcctctccagtggaacgtttggaaacagccgtcgaacaattggattgggatgagcgctcgcagatcgaacaggctgcagcgaaattgtcggttcgtttgttgctgccgaccggattgtgctttcttcccgcatttgttgcggttggaatcattccgtccgtcatgtcgtttgtgggatgacggcgtgtgcgcaacgacaacggaaaagcggggaatgttgggagacgataattcacggagttttgtggataaatgtggatgacacgccgtggttgtggataacccacgtcctccgaccacaaccctgaaaaaacgttccgacgggcacgatgatgcgcaacactgggtgcactcggccatctggccgaggttgttcgaacgaaaggaacgccatgaacaacgaaacgccaatcaacgtcgatggctcgccagacctgatgggcaaggcagggcagctgctgcatgccatgcgtgaacgggccggcaaagcggtatgcctgctggacgcgcgtatgcgcacgctgaccgtcgaaccggaggaaggcgctgccactgccgaatatgcggtggttttggttgccgccaccggattcgcagccgttttggtgggcattatgaaatccgatgccatcaagacgctgctgaccaacatcatcaagaaagcgctgagcgtcgggtgattcatgctgaggcaatggtggaaacgccataccgatgatgccgatgagggagcggccaccgcggaattcgcggtggtgctcccctgcgtggcggcggtggcgattttagtgttgtgcttggggcgtgcgtccgtggtgtctatgaattgccaggatgcggcggcggccggtgccagggctttcgcggttgatgatacgggcggcgaatcgaaggcgaggaccgcggtcatggcggctgcgggaggttcggcgacggtacggttcgagcgtggggcggacttcgtcaccgtcacggtgcaatgccctgtggtgccggatccgaccggtgtgctgcccactcgagttaccggcaaggcgacccgctacttctagcgttgctccgaagcgtgctggtctctgcgcagtgagatgcgggattgttggttgtggcctgtgcatggaggtctgtgaggtttggagcttgcgacatacgacgtgtgaaacatgttgtgaaacactattggcaaccatttgatggatgcgggtcggaaaggaatggataatgtgaaacgccttgtgaaacattggtttgcttggattcgcgggtccgatgagggttcggggaccatatccggtgtggctttgatcgcagtggccgccatcatgctgggcgtggccgcgtcggcgggcaatctgctgctgtgcttgcatcgcgcgcagaatgcggccgacctggcgtcggtagcggcggccaatgcgttgtattcgggatcgtccgatccttgttccgtggcggaacgcactatatccggcaataatgcgacgatcggatcctgcacgatagaaggcgaggatgtgctggtcgaagcgcaggttggcacgcaaatgccattcgtatcgcatgtcggcaaacagtcacgggcggggccgattgtctgcgaataagcgtggtgcggaacggtacattgtgcgggaaatcgcgcttcgtaaaaagggatctttctacgtaaaggaacattcgttccacaaaacacggccatttgtatggaaagccgttcgcatgtggcgtgtggagcgaatcgcggttatcgtactgaagtatgagcgaaacgtcatgtgtgaatgcgaccgttgccgttgtcggcaatccgacgtcaaacaaaggcaagggtgccgaggtcggcaagcaggtggttgagctgctgcaagaggccgggcgcaagcatggcttcaacgtgatcgacgtgaccggcgagagcttcgacgattccttggcgaatgccaggaatcgcaggaacgaatacgactacctggtggcggtcggcggcgacggcatgattgcgcttggagccaatgccgtgggctgttccggtaaaccgttgggtattgtggcgacgggttccggcaatgatttcgcccgcggtcttgagctgccggtcaatcgcgtggaaaccgctgtcgacggcatcgtcggcgcgattgtgcgcggcacgcatattgacgttgatatgggtttggccacgtcgttgcagggcgggtatgccgtcgattccagtaccggcgatgatctggtcggcgattcggacgtgccattgcgtccggcggtcaaccgcttctacgcgggcatgctgtcgtgtggtttggatgcgagtatcaacgaccgtgccaaccattcccgcttgcccaacggttcggtgcgctatttcgtggcggcgattgtggaattgacgcatatgaagcggtacggataccacatcaaagccacgttggccgatggaacggtggaagaaagagacattatttcaccgttgcttacggtggccaattcacggcatattggcggaggtattgagatctcgccgtattcgcggttctctgatggtttgcttgacttggtgtggctcgaccatgtgcccaatgtcgccgaatgcgcggatgcggtggcgcgcgcctacagcggcaagatcctcgggtgcaaggtgtttgggtggaagcgtgtgcgcgatatcgaaatcacccgcgcgcaagagggtgatgagccgccggtcttgatggcggacggtgaatatgttggtcgcctgcctgtcaaggtcgtagttcaagaccgtgcgttgcgtgtgctggtgccgccggccgtggcggaaagccaagctgccaacaccgaagagaaagtgctggaagccatcaagcgtgatcaccgtgatcctgtcaccggcaaaaccgacacctactacgcgaagcgctcgcggtagtgcgtgcacatgccggtcaaaccgcaacattgcatatcgaagatggcacgtatgcaactgattgcgtgatcggcaatcgtaagcaatcgcaaataatttcgcgataataacgaaaaatccagtacccgcaagatctttatcttacgaataccggattttctgtaactagcgaacgccgtaactatcgaacacggattgcggtcaggcggcgacttcctggcgggcgatggcctgctcgtagtcgcgggtgcccttgaagacttcctgcagccacgggttgacgtgctgcttcttcgcgcggtacatgatgtagccgagtgcgagcacgttggccacgagcgcgatgatcgacacggtcaggttcacgttcggattgttcaccgactgcacggcgaacttggactcatcctggaacatggggaacacctgcgcgaacatgcaccagatggcgagcgtgttggcgcggttctgaatccagccgcccttgttccagaagaagttcgccacggtcggggcgagcagcagcgcgaggccgcaataccaggagtgggtcggcaggcagttgtaggtgtagcagaagttccaaatatcgtatgcgacgatgaatacccaagtcatgtcaggccacagcatgtcctgcttcttctttgacacgtaaatgccgaaccagccggtcatgcaggcgatgttgatcaggccggcaacgccgttgaacacattgtgccagccgccatacagcgtcacgccttcggtggaaacccatgtggtgccccaagcgcgaatggccgattcgaagtcggaggccacggcgataagaatgttgatggccacgatcacgaacgggaagcacttgaaccattcggatttgccgatcttgccccacttgtatttgagtgccatgaagccgatgcagcctgcggtggccgcatatagcttggcatagtggaaccagctggtcatatgcacgtaggtcggattgctgagcgcccattcggcacccatcgcggcggccacgtaaatggtgatgaagtagatggtcagaatggccggcacgatcaggaacgcgatcacgccaccggtcttggtgcgacgggccagctcattggcgccgatcaggcagcagaatacgaggatccatccgatccactggtatatggcggtgtcgccatagacttggaacaacatcgctcttcctttctctcaacacgtatgcgcgcggggtgagctgcgtttacatgtattcgttcaggtgcagcgtctgtgccgcgacctgtctgatgacggtgtcttcaatgtcgggatgcagtctgatcagcgaaatcaggccaacgatgagcgtatagaacgtctcatgctcgttggtgatgggcatgccatgcaatttctcgaaatcgcgcactgtcgaattgcagatgtattccgcaatgcgatcggccacgcggtcgatgaatttgatgtacagtcccgcgttgccgtcttcgatcatgcgttggctgaacgggccctcatcggcgatgagggaacgggtcagtcgcaccacgtcatcgagcgctttcgagatgttgccgacttctcgattggcgttccactcctccaattgcgagatgacttcgtcgatgacgtcgtcgagcacggcgtccgcaacttggtctttgtcttggaaatagtggtagaagagagatctggtcatacctacgcgacctgcgatatcgctgatcgtgattttcgaaaagcccttttccaggcagattgcgcgggctgcatgcacgatttgcgcgcggcgtgcgtctccgactgttgttgcggaagcgttgtgctgtccgtccatggctttctctccttcgttcgagtggcgtctctcacctgcgcgacacgttgacactctgtcaatttcttgactgccctcagtctaaaccgtaaattgacacaatgtcaatttcgtagtgtcgatgtcgtcactcccagcttaaacgttgccgcggcgcttgtctttggggacacgcgcttcaccgttacgggcaggctgtgcggccggtctttgagaaaaaacgtgtcgtaattaatcggtagcctagtgacaccacagcggaaggaattgcgatggcactggcactctatagaaggtatcgtcccgacacgttcgacggcgtgatcgggcaggatcaggtcacgattccgctgatgcgagcgcttgatgagaacaaacttacgcacgcttacctgttttccggtccgcgcggctgcggcaaaaccagttccgcacgcattctcgcgcgttgcgtcaactgcgcgaaaggccctacctcgcacccgtgcggcgaatgcgaaagctgcaaggacctcgccacaggcggccccggttccatcgacgtggtggaaatcgacgccgcttcgcacaacggtgtggacgatgcccgcgaactgcgcgaacgtgccggattcgcccccgcccgcgaccgctacaagattttcattctcgacgaagcccacatggtcacgccgcaaggcttcaacgcgctgctgaaaatcgtggaggagccgccggagcatgtgatgttcatcttcgccaccaccgagccagacaaggtgatcggcaccatccgttcgcgcacccaccattacccgttccgcctagtgccgcaggaggttatgggcccgtacctcgagcagatctgcgaagacgagcatatcgaagccgagccgggcgtgctgcgccttgccatgcgtgccggcggcggttccgtgcgagacaccctttccgtgcttgaccagctcatggtcggtgcggtcgatggcagcatcgcatacgattccgcggttgcgttgcttggcttcacgcctgacgctctgatcggcgaggccgtcgacgccgttgtcgacaaaaatggcgaagcactgtatggcgtgattcagaaggtcgtggtcggtggtttcgatccccgtcgatttgttgaggatttgcttgcccgcgtacgcgatttgctggtgctcacgttgggcggagagcgtgcggaaagcgtgctttccgacgatgcggccgccgagaacatggatgatttgcgtcgtcaggcttccgctttgggattgtctgcgctgacgcagatggctgacacgatcaatgcgacgcttgccaatatgaccggtgcgatttcgccgcgcatgcgattggaattgcttgccgcgcgcttgttggccgggcgtgaggaagggatggctgtcgttgcgtcatcttccggtgtacctgattttgccggcgatgccggaacttccgcggctgccgaatcgtcgcgtggatccatggccggctcccgtcgccgtgcggcacgacatgccgcaggaaatgtgcgggcgcaggattctgcgcctgtgatcgataccccttccgcgcctgtgcagccgtccgtggcgccgacgaatcctgccgatgccgtcgcatccggcgtggcttccgtgcttgctgacgtgcagcaggcgatgaatgcgacgacttccgtcgcttccgctgcgcctgccgcaacttccgtaccagctcccattcatgacgatcgcacccccgaccagaagtgggatgcgctggtcgcagcccttccggaagacgtgcaacgttacgtaagccgtggaaaagtgcctcgcgtgctactgagcggcgaccgtctgtggatcaaattcgacaaggcgctcagcaaatacgcgtttgccaaagcggtggcaaaggaatcggtggacggcaataccgaagtggtgaaaatcgtccgcgccgaagtgcataaggcgttcggaccgagcgtcacgctcgcgcctgccaaaaagctggcggacgggtccgaatcggtgccgtggagcaaactcagcccggaagagcagagcaagatcaatgcgcaactcgtgcaggaacagcttaaagcggccacgctgctgacggccaatcttggtactgctgcaggtctcgaatcctccggcaaggagccggccggcacaagcgcgaagagcgccgaagacggtggcaatgccggagattccggcgatgaggagggccatcgagctgctgccggtggatccgaggaagtcgatccatgggcggccccgacgcaggaagtccatcatccggaacggcctgttccggatgatgacccttgggttgcatctgcacagccgatgcaaccgcaatcggtggtcgcaagcggcgtcaacgatgtgaaagcgccggaacaacatgcgaaacatgtggctgttcccgatgtcagcgataacgttgatccttgggcggcaccgatgcctgtaccgcagcaagcgccggtggacgacgatccttggggtaaccccatgccgattcaggcaggaccggtggatcccatgcctgctccaacggaacctgaggtggttccgaagcacgccaatcaccagcatcgcgcaccgcggcaggacgcggcaccgcagcaaggccagccgaatgccgatccgtggagccagcagttctccgcgccggcgcagccaatgccgcaggtcgccgcggaagatgacgaatattccatgagcgacgagtcgatcggggcgtcaaccgcgttaagcgtggacgatctgacccgactgttcgaggtgaaaaaagtcgaggatttcgggccggacgatgcaaaaaacccgcgcaacatgcagcagaagaagaatctcgacgactgatggcggtgcagtcgcaagcaaaaatgcgaaaccgagcaaaatcgacgaatcaacgcaatcgtaagcactgcataatcgcgaatcttatggaaaccaaggagaggtgaaccatggcactggcctatgacggcgccatccaacgactgatcgacgcgttcgcgcacctgcccggcatcgggccgaaaggcgcgcaacgcatcgccttctacctgctcaacgcatccgacgaggaatcacaggggctgatcgacgccatcgccgaagtcaaagagaaaatacgattctgtgacatttgcggcaacgtgtgcgaaaccagcccatgcccggtctgcgccgatccgcgtcgcgaccacagcgtgatctgcgtggtcgaagagccgaaagacgtgatgagcatcgagcgcacgcgcgaataccgcggcctgtaccacgtgctcggcggcgtcatcaacccgatggccaacgtgcagcccagcgacctcaacatcgccaaacttatcgaacggctcaaagacggcgaagtcaccgaagtgatcctcgcgctcaacccgaatgtggaaggcgaagcgaccaccagcttcctgtcgcagctgctttcgcaaaccgacattaaagtcacgcgattggcgagcggcctgccggtcggtggcgaccttgaatatgccgacgaaatcacgctcggacgcgcgttggcggggcgtcgcgcggtctgacatcatattcgccacatccgttacattgccggcatatgctgacgattgcgcaaacgttgcgcgggcgatcatggaagacccgtgcggaacgtatgtacgaaaaaacgcgcggaggatttgcgaggatcccatatattgttccgcatgttgggcgtgcaggggcttgacaaatcggatttttcctataattgaccagcctgcttagtatgttggcgggcaacacattgaagaagattggataagttgtggctctcatcgtgcagaaatttggcggctcttccgtagccgacccagaatcgatcaagcgcgtggcccgacgcatcatcgaaacgaagaacgccggcaatgacgtggccgtcgtggtctccgcaatgggagacaccaccgacgacctgatcgatcaggcgctcagcatcgactccaacccgccggcgcgcgagatggacatgctgatgaccgcaggcgagcgtatttcgatgagtttgctcgcaatggcaattcatgcggccggctctcacgcctactccttcaccggctcccaggctggtttcatgaccgacgcccagttcggtaccgcgcatatcaaggccgtgaagcctgaccgcgtgcgtcgtgcgctcgacaagggttccgtggccatcgtggccggcttccagggcgtgaatgagggtggcgacgccaccacgctcggacgaggtggatccgatacctccgcagtggctttggcagtggcgctggacgccgacgtatgcgagatttacaccgacgtcgatggcgtgttcaccgccgatccgcgcattgtgccgactgcacgccgtatccccgtcatcgactacgagtcgatgctggaaatgtcttcctgcggctccaaggtgcttgccctgcgttgcgtggaatacgcgcagcgattcgacatgccgttgcatgtgcgcagctccttctcccaccgtcgcggcacgctgatcgtgccggaagacgtcgatccgcgcacattgccgaacatctgagatatctgagattcgcattcggcaatcgcgagacatcgcaggcaatcgcaagaaaaccaagactttacgaacaaaggtaagaacatgagcgaaaacaacaaccagtccttgggagatctgttccccgatctggggccggaagtcccgatcatttccggcgtcgcacacgacaacaccgaatcgctggccaccgtgcgccgcgtgccgaacgagccgggcatggccgccaaggtgttcacgctgctggccgaggccggcgtgaacgtcgatatgatcgtgcaggcttccgcttccaccggcaccgccgatatttccttcaccgtgccgggttccgccgctgccaaggtgcgggatgtgttgcaggagaagcaggacgagctgggctaccagtccttcgacatcgacgccaacgtgggcaaggtggccgtggtgggcgtgggtatgaagacccactccggcttggctgccaagttcttcaacgcgctgagcgacgagggcgtgaatgtgctgatgatctccacgtccgaaatccgcatcgccgcgctggtcccgctcgagcagctgcaggacgccgtccgcgcgctgcacactgcctacggcttggatgccgagcaggtggaagccgtggtgtatggcggtactggtcgctgacgcaataccgcgcaataacaatcgaaaaaagacttgactggattgcttgaggtgtctcagccaagtcttttttattcccatatctgttttacagatatttttttcagataatctgcaaatgaaaaagcggaggattgctgaataatcagcaatcctccgcaatattatgttctgcagaaatcagatatcaccatgtgcaatcatgcatgatcatgcgtaactgcagaacatatgcagatcgttatcacttcttggtgatgtagccgagtgccttcagcatttcggcgctttccaaagcgccgccggcagcgccgcgcaaagtgttgtgagcgagccccacgaacttccaatcgaaaatggaatcctcgcgcagacggccgatggaaacacccatgccaccctcgtagtccacgtccttcttgacctgcgggcgatcgtcgtcggtcaggtactggatgaactgcttcggcgcatgcggcaatccaagctcggaagccttgctcgtgtagttgaccaggcgatcgacgagctcttccttggtcgggttcttgccgaagttgatgaacacggtggcggtgtggccgttgagcacaggcacgcgaatacactgcgaggtgatcttcagcgggccgtcgaacggcacgatctcgcccttttcctcatcgacgcggccgaacaccttcagcggttccttctcggacttctcctcttcgccggagatgaacggaatgatgttgcccaccatttccggccagtcgttgaacgtcttgcccgcgccggagatggcctgataggtgctcacgataacctcgcgcggctcgaattccttccaagcggcgagcgccggggtgtaggcctggatggagcagttcggcttgacggcgatgaagccgtgcgtggtgccgaggcgcttgcgctggtgttcaatcacctcataatgctccgggttgatctccggcacgaccatcggcacgtccggagtccaacggtgggcgctgttgttcgacacgaccggcgtttcggtcttcgcgtattcctcttcgatggtgcgaatctcagccttcggcatgttcactgcggagaacacgaaatcgacgtttttgaccacgtcttccacgtcggccacgttcttgacgaccatgttcttcacgaattccggcatcggcgtttccatcttccagcgaccgccgatggcctcttcgtaggtcttgccggcgctgtgcgcggatgcggcaagggtgaccaattcgaaccacggatggttttcgagcagcgtgacgaagcgctgtccgaccatgcccgtagctccgagaatgccgaccttaatcttttcggacataacaacctctcgcttatgctggaacggtttcgtatgatttcacgcttgaggtcgaccagccggccccaaacgacttcgtgggcggccacatgcgttgttcaatcttacgaaaaccgcggaacaagcaggttcccctatccgtatgctggtctgcccgtatgctgactcgcacgacccatgtgtgcgcgttgtcggttcctttgtgttggaatgtctgtcttttcagctgtgcttttatgcaaatccacgaataggatttatgtaaatccacgaataggatttatgtaaatccacgaatagaggcatcgctccttccgacttctttccaagctatatctcaacttatgttgacagagatgtgcgggaggaattgggggtacgtaagatcgctgagtttaatgtttttttggaattggcggcacttcgcgtgggggaggtgcttaatacggaaagcctcgcaaatgattgcggtatctctgtggacacggcaaaaagttggctgtcgattctcggatcaagtttcatcgcttttcgtcttcgaccatatttcaaaaattacggaaagcggattactaaagcgtcaaagctttatttttacgatactggacttgcggcgcatttgcttggcattgaatctactgaacagttaatcttaagcaatcataggggaaacttatttgaaaatttggtggtaacggaaatcatcaaacgttatgaagcgttggagaaacgtccgaggctgtatcactggcgagatagcaatcgcaaggaaatcgatctcatcatagaaaaaggcgggaagccatactatttgatagagattaaatcatctgcgacgttccgtccagaggcgttttccacgattgatagtattgcgccggaaatgggtgtgccctgtgagcgacgttttgtggtgtatggcggatccgacagttttgggaataggcacggtcgcgtaataggatttcggaatcttggagagctggtcgaataacgggtcgtgcaatttcgtaatgcatgacttgaaaacggcggaatcttcaaggaaagatggcatgctgcagatattggcgtgatatcaacttgctgttgttctgcgaagcgccgtcaccaaatgattcaattacgattccgcagggtgattagcctacgcggcagatcgtctgcacaacttgcgttttgcggtcttttcgcgagttgtgcagacgggaaatacgggttgtgcagccgtagaattcaaaatcaaatcggggatcataaccatctcacttttatggcaattgttaagatcgatatcgtcatcaagttttctggatggatttctctgcgcattcaattgactgcggatgcattggtgttttggttgacatcttgcgcgtgtcgttattgtctttttatattttcatgagcgatcggattgtcgttcgtataattatgaaaaatacgtatgataacggtttcaaataaaaaaaccactgaaattacttatatttacagttattgagaaaaacgatttcgtcgtattatgaaggtacatgattcattgaacgtggatgttttgaatcatgtagttcaaaggagaatagatatgagtcaccgaaataaagcgttagttgctattgtggccggtactgcgctactaattagtagcggcgcggcaatagggcaggcggcgatagcggatgagcgtagtggcaaagcgatgcaaacattgaacgtcgactttgctacggagactggaaattttcgaggcggagcttcgggaacgttgtatggattgggcgatgatggttctcctgcggatgccattcttgatggagctcaggtggagaattcatcgcagaagcctccgagtggtactcagcatcctagtggtgatgctcttgcgttggagaaccaattcttttcgaatggaggcaatgaacttgctgtttatatgcaggattattatcccgattggagctataacagtggcaatcgtccatccgatagtcggacttacgtactcgatgtccctgtagacgacccatcgtatggcacttacactaacgggggagatggagtatgggactacgaacaggttacggaaattgtaatcaataaggtcctcgctaacactgagcatcctgaccaatacacctttattcctttcaatgagcctgacggcgggaattggtatgcgtcaggcgacaacgccagtgccaagattttcaggacttttctttcggattgggactccgaatataagcttattcagaagatctggcaacagtacaagaatggtgaaaagcctagtaaggtcaagccaactgctgatcatgcgcgtgtggcaggtccgggtgattgtgtgtaccggcagaataggagcagtgccttcttatctcatgctaagagccaaaatactcttcctgatgtttttgtgtggcatgaactcggtaaggaaagtctttcttccttccgcagtcattatgaaagctataggaaactggaaaagaagtatggaattaatcctattgacgtgaacatcacggaatacggcgagctgcgtgatatgagcgttccggggcagctgattcaatggcagtccatgtttgaagatgagaaggtgcaggctgagacggcatattggaattatgcaggcaacctgtccgacaacatggctcgagccaattccgctaacgcagggtggtggcagttcaaatggtatggtgatttgcgtggggctcagacagtaaaagtgtcttctgattacatgaataaggccgacagccttcagggaattgccgctattgaccgcactaataagaaagcgacggtgctgtatggaggggctaacgatgctaatgccgatcaagttaagaacgacggttccaacattccggtaactgtacatttgacgggattggatcagaatctgttcggcagcacagttgatgtcgaagttagagagaatgcctttactggcccagatggtgttgcagctactcctagagtggtcaatgcgctatccgatgtagatatttcttccggcactttagatgtgaccacaacaagtgttgatcgatatgcctcatatcagctgattgtgactcctcatcaggatcgtgttctttccattgacaatgctgctgcaggtcgtgctctgttggtggaagaggtagaaaataccgtactatcaggaggcgcccagacttacattaagactccgtggggagatggctggaactattttatgacatcgggcaatggtgatgttggaagtttcaagacgggctcgattgcttcttggacggtggatgttccggcggatgggatatatcgtttccaggtgatcagtggtaatactggatttccgggggataatgacgtgtctgttgatggacagtctgctgggactatacactttggcgctgaactggcgatgaagtcggcggcaaaatggttgtatcgaggaagcggtgaggtgctactgcgactcaagcaagggcagcatcaaatccaacttcatggatcatcgatggacaacacactggataagttcttgctttatcaagtatcggcttccgataattccttggatcgaatcgaatatcctgcggatcaattccgtctggaaagtggtgctctgctgacctatgaccaagatggagccagaggattcgcctcgttgaatggaggcgaagcgaagcttttcgcccatgcttgggaaagtgggtatcactcagtgaaagttgtctacactgcatctcggggtgattccatggtgctttcggtgaatggtacatcggtcaccacaattactgctgaatctgacggtttgcggtcttccatggtgaacgttgccctatctgaaggaattaataagctggaattatcaggtgatgctgtttcgattcgtgatatcaccacatgccgtgatgctgcggatgatagcaatgccatcacattggaagccgagtcgttgcagcttgcaggaggtgcgcaaactcgggagaacagtgcatctaatgcttctggatattcgtatgtgaccggtctcggcaagcaattcgtcactgaagagagcggtgccttcggcatgggggatcaaacccgcgtggttactttggatacgaataatacgccgaagatagctgacgctgtgaggggaactgtaacgattccagcgggaaccattcctgcgggaaagtttaatatggttgtacgcttctcgaacgatgcattcattggtaagcatgattacaatccgcagattgtcgatttgggattgcaggtgcgtgatggaactgccaatggtgaggaagtagcgcgaggtgcgttccggtatacctattctgatagtaacttcctagagcgggcgatgactgttgaaaccagtggcagtgctttggttctggggaactgggatgagcctggtgtcggcgctggagcggtatcgtggggcgttggtcctaatcttgactatgtgcagttttatccagtgatggtaggagatgtgtaccaccagtctcttgcgtaatgcgagatgatatggattggccctcgggagtgatttcctgagggtcaatttataataaaaacggtatcagagtgtcttagatactactaatgaagactataggtattgtaaaaacgttggaataaagccattttgtgtatatataaattgtgtctgtgaattctggctataagttgacgtgaaaacgttatcgcgctatagtgaacttatcgacataaaagttcgtagttggtaaagaggccgtatctgctgcgaattgcgaatccgatcgcctgaagttccagtggcatagctgggaggagtgaggtgatctacatttatgggaggtacgtcgtggtgcaggacttttcttggaaaactggtgctgtcacgctttactttgaggttgatgcggcagatcacgttgtgatgaaaagtgtgcggtcgggtgaagtgagtcgtgattttgctcgtccgttaccgctggctgagatcatgtttgctggtactggacactggattgcttgcgatcgtttgattcacactactgttggaaaggaactccggttcgtttcatatgaggaaacagtggtggataaactccaccggttgaatgtgaatatgaaagatgaggagtcttgcgcgtgtgtgcagatgacatatgaaattgtggagggaacatcagtcattcgctcatatgtaagcatcaccaatgaaggcgtatccccgcttgttctcgaatctgtgaccagtttggtgcttcctatgggatctgtgcatagtaacgcatcttggactcacgagtgggtgttgacggaaggtcattttgattggctgggtgaaggacgttggcaagagcgaaagcttgatgactttttcccaatgctccaacaggagatgacgggccatgatccccgtggtgagcatgccgttgtgtcgactggtgcatggtctaccggcagtatggcaccattggcgttccttgaaaacaaagatgccggagctgtatgggctttccaggttgaacataacggagcttggcgctgggaagtgggcaataatacagtagatggctactttgcagtatccggacccactaatataaaccacgcgtggacaaagaagttggatccgaatgaatgcttcaccacagttcctgcttcttttgtgctggcctcaactcaacaggaagcgattgcgaatcttacgcaatataggagggcttgccgtcgagtcgatagtacgacgacgcagccgcgcattatcttcaacgattacatgaataccatcaacggagatcccaccacggagaagctgttgccgctgatttccggtgctgcggaagttggctgtgaaatttttgtcgtagattgtggatggtatgacgattctggagactggtggccaagtgttggtgaatggctcccttcgaagacgagatttcctggttccaaaggcatcgtggaagttatggatgccattaaagatgctggtatgattccagggctttggctagagccagaagttattggcgtcaaatcgccggtcgctcaaaagcttccagattctgctttcttccaacgtaatgggcatcgcgttgtggagcaggaacgatatattcttgatttgcgcgatggtagtgcccgaaagcatttggatgatgtgattgacaggcttgtcaacgattatggcatcggttatttcaagatggattacaatgtttctcctggcagcggaacggattaccaggccgattcagttggtgacggcatgcttgaacataacagggcctatctagattggatcgatggtatacatagaagatatccccatgtaattcttgagaattgttcttctggagggatgcgagaggactatgcacaaacgtcccgattccaggtgcagtccacgtccgatcaacaggattatcggttgtatccagctattgcggcaaccgctccggtgatggtggcgccagaacaggccgcaagctgggcttatcctcagtcgtcaatgaatgcggagcaaaccgcgttcaatatcaacacaacactgttgggtcgcttcttcctatcgggatatatcaatcatatggataagtcgcagaaagcaattctgcggcacggtattcaggcataccgacgtttcgttcagccagttattgaacagtcggtgcctttctggccattgggaatgcctatgtggaatgattcggtgattgcgttgggattgcgcgatgattcgcagtctctgatcacggtatggggcaggaacgtcaatgaagcgcaatcgatagcgaagctacatgtaccgcagtatcaatatcaggatatctgtgtaaagcccattttcccggtgacggatgaattcactccgtggagcatggaatggaattctgagcaggctgtattaacggtgcgtattcctccacatgaatacgtttctagaacttttcaacttacaggggaaggcggtgaaacaacttatacacactgttgactgcagaagttgaataagaaaacgcgacaaataaaaacatataaggaattaataagaaaggtgatatcaatgaagatgttcacaaagtctcgtctgatggcggtgattgcaacgagtgcagcactttccatggctcttgccggctgctcgaatcctactgctgatagcagcagtgaatcggacacgggagcacaggattactggcctactgctacacaaaagcttgatggcgttgaactcacgatgtgggtggcgcagaattctaacaagattccagtcaaggttgtcagtgatttcgagaaggctactggcgctactgtcaaactggaaactattccggatccgtatgagcagaatgtgcagactaaaaccacgacgggggatactccagatttggctttctggcagccaacacagtccatgcttgcgggcttcatagcccaagacaaactgcagaagctggacaatgctccatgggtagataattacactgacggcatcgccgatgcaggtggcgtagtagatggtacgcgatatgcggcattagtttccactccgccagtgatgggtgtgttctataacaagaaagtctttgagaaggcgggaatcacagatattcccaagggttgggatggatacgttgaggcagccaagaaaatcaaggatgccgatatcgatggagtggaatctccactgtttgaaatgggtggctcccagtggggaacccagtactcagtgcagattcagctggctgaagctgctcaagatggtctgtgggatcgtgtgaattccggcaaggagaagttcactgatgatactatccagacggccatcagcaactacaagtctctgttcgatgaaggcctctacaacaaaaaacgctggttccgccaaggataccgatgaagctcaggctctgtgggatggtaagaccggcatgattatctgcgtgaattcgctgtttaatcaaattgccgccctagcaagtaatgacaaggcagcgctggatgaaaccatcggattcttcccgctctcgtccgagggcaatattggtacggtgattccggaacagaataattctgttgttgcttttaagactggtgactccaagaaagaagccgcagctcgtcagttcattaactattggatgaccgaagattacgccactttcgtcaaagatcaaggtattgtgtccgttatcaagggtgtggatactcctgacaacgttcctcaggcactgctcgactccgctgattccattaaggattctgtcggttccatgcagtccttggctgtggccaatccggatctgtacatcaacttggccgacatgatcaacggtacgaagagtcctgaagacgttgccaaggcaacgcaggatcagttcgctcaactggccaaagctcaaggtgttcagggcttctgaacataaatagtggaacaagatatctgattgactgggcgtcgtaaaacaggtaataacggcgcccagcctccaaacaaaaagataagcgtaggggaacaatgtcaacacaatctgcggcacgagtagtgccaaacgcagaaaaagaaggaggaagcaagagcaagaaagcgctaatgcgtcagaactatccgattcgataccttctgcctgcctatatcatgctcctcatcttcttttttgtcccaacaatccttaatctaatctatgcctttactaattggtcggcatattctaaaacaattaatttcgtaggtttcagtaacttcatagagctttttaaatcaggcaacctgttgcgagacttgcgcattacgttaatctatgcgttgctggtcgcaatattccaaaatactttcggactattgttggctgtctttcttgaggaagatacgcgaatcaatagatttgctcgtacgatgttcttcattccggtcatcatgtcggcactcgctgtaggctacatttggcaagcagtacttaagtctgatggcgcattgaaccagattctgtcgtttatcactggacagaatattgacatagcttggcttggatctacaacttggacaatcgttgttgtggcagccattcacggctggaagtggatgggactatcgatgctcatcttcttggctggtctaaaaaccatcgattctgatgtgattgaagcggctgcaatagatggtgctaataggcgtcaaacattctggcgtattaagtttccgctgttggccccagcctttactttcaacgtggcgacatctctgctgggctctatgaatggcttcgacatcgtccaagcgacgactcaaggtggccctggaagtaccactgaaatcatcaacctcttcatttggcgaacctttggccaaggactatattcgcagtccacaacgatgagccttgtgctattcatcatggtcatgatcattgcagtgccgttgatctggtacctgcgtagaagggaagcgaagatcctatgacatctgcaacgtacggtgctgcacctaagaccaacgattcggtcatggtgaataagccatcaaaagttcatggaattattcatgggattctagtggtcattgttatggctgttttgttgggaattccgttctggttgctagtagttactgcaggtaagacgcaggctgaagccatagtgcctaacatgagtttgccaagtaagtggcatcttcttgagaatttcaagacggtgctagtagatggtaaaatgatttccgcattcttcggatctattgtggttacggttccatctgtgttcttggctctgttgtttggatccatggcatcgtggattcttgcacgtcgcacaacgaagactctggctgtggtgtatgccttgggtatctccggtttgattcttcctccggctgtggttactgtcatgatgctgttgaagattatcggtctttcaggaactgcggttggcatggtcggtgtatacatcggcatatacatgtcaacggtaatcttctttgttaccggattcattcgaacaatcccgatctccttggaagaagcggctcgtgtggatggtgctaagccgatgcgtatctttttcacgatcattctcccactgcttgggccgacactagctactgcaacgattcttgtgacactgtatatctggaatgatgtgttctactcattgttcattttgtccggaaagatggatttgctgccgttgaacttgtacaacgtggcaagtgctggactttatctgaataactggcaccttattttcgcatacatcattttgatgagtgctccattgctaattatctttgcgtttacgcagcgaaagattattagcggcattactggaggtgctgtgaagtaattgatactactatccggatgcagtggactgtaaggggttggcatccggatagttcttcgtttttctgaagaaatagatggtttgttccgggtgatttagggaataggattgtattttatatcacttcccgagagagaagtacgcaatcatacgaagaggtgaacaatggccaggagtaggcaggcgaaagctgcttcgattaaggacgttgctgcgctagcgcaagtatcggttcctacggtatctcgataccttaatgatagggaacgagtaagcgctgagaaacgggaaaagatcgctaaggccatcgatatgttagggtatcgtccgaatccgatcgcacgtgccttagtgaaagaccagaccaaagcaattgctgttttgtctacaaacaccactttgtatggtcaatcgcattgcattgagggaatcgaagagaaagcgcgattagcaggctattcgctcacgattggtattcttgctgactccagcagaaataagcttagatccagcgtgcggtcatgtcttgatcagaaccccgctggcgtgattctgttgaatttcgatcaggtcggtaatgatgcttttgcatatcttccgccagaattacctgtggtgatgatcgctggcgatcgggaagaggaaattgctcagatttcattgtgcgagcgagagagtggctatgaggtgaccaaatatttgctttcgcttgggcataaaaccgtataccatgttgccattccagggggtggcggcggctatacgcgattaaacggatggagacaagcatgcgaggaagcgggagttcctgcgccggctcccattgaggctgattggaatcccgaaactggtcgtcaaattggtcaaaagctggggcgggactttaatgtaacagctgtctttgcgggcaatgatgagctggcgatgggtataatccgcggtcttaacgatgttggtcgaagagttcccgaagacgtcagcgtagtgggattcgatgatcatcctatctccaagatttggaatccgggattaacgactattcgccaggatttccgttcagtgggcatgaaggctgttgatcttttgaaggacaagatcgacgatcttgctgagggacgtggacatacagaaaattggactcgatatgttgagattcctggccaactagttgtgcgagaatcgaccatggcagtctgattaatttgggtgtaaccaagtagcagaagtggcatatttaattgccgtctgcacatcccgcgttccgtgtctgcaaatctgaataaaacgaccagaaaatacggatgtgcagacggcttcattccatcaaacacccccgattgctggttttccaagattcagataccccctaatcaaatatcctgtctgcataatccgcaatttccgtctgcatatcccgaagatttcagccctatcgcaagttgtgcagacagtctcaatcgcatgttgcgtgtaaacgaaaagtcacgactttgtattgtcggtattgccagtattgtcgtctttcgcccagttgaaggcgattacggcgatcgcggcaatattgagtacattactgatgatttcgatagggcttccggtgcgcgtgagcgctccgcccaaagtgtgaagccgcctcacgatcttgaaatttcgacctcacgattctgctttttctgcataatccgaaatcgtgcgctcgccaacggcgcacaaatacccccgaacaagtctttttggaataaaaacatccatcattcgagacaaacggcccctatgacctcacgatcttaatctgacgaacaaactgccagacccgggaatctcacggaaaccgaaatgctggtagaaacttcgcgaagcatcatcatacggatcgacgacaagcgcacgggaaccaatttgccggctcaccgcaagagatctcttcacagcatcctgcagcaacatccagcccaagccccgcttctgaaagcgggaatccacgcccagcattcccaatagaatcgcgggaatttttgcagggacatttcgccgaagccaccctccccgcacggtctcgcgatcgatcgaataggcgcttatcgcataaaagcctgcgacatccccgtctgtggtgaagcatacgtacggaaccgcggttccttgctttgccgcgtaagacgcatgtttcgcagcccaatcgtcgatgagctcaacactgcaagagaacgagccgagttcttcacccggttgcagtcgtcggggttcaagaaaacgtgccgcagccgcgccagtgccatcaacaccactcatgcccattgaggttccctctgcatgagctcagccatttcggcgggaacaggctcatcaagcgcgcgcaaaaacgcgtcaaacgcttcattttcgagcttcagcgacgaagcctcttcgatttccctctgcgcggcttccagcaaatgctgcgcggtccactgcgtcaatgtggagccctttagcgaaacggcgcgttcgatcaacgcgcgctgttccgcagtcagccgaatatccaagcgcgatgttctattgccaaatgttgtagccatattgatagtgtacggcattttgccatacaaaacaactgtcaggtgcacaatcagattgtttcagactggggtatcggcttgaacgcgctggcggaaccgggaatctcacggaaaccgaaaggaagcgccttatacattggcttttcggggaatatgcgcctccataacccaccagcacatctcattttcctcttgaacgccggcaagcaattcacctccatgttccacaagctggttgcggaagcgagaaagaccagtgccatccaaaaccgcggaaggtttggcggcaatggcattgcgcagcctgaccgcatactcgtcacacgaaacttcaattgtaagaacgtatgcaaaatgagcgtcggcatacttggcaatattcgaaaaagttccctcgccaatcctagaagaagatgctcagtgacgacatcatcgctgccgggaatcatctctggcagcaacactattccgtcgagaccaagcgcggtcagatttgcctgtttttcgctcacggtctgccgtaattcattaagcatgatctcaccagaaacggcggccgaagaacgttttggaactgtggcgtacgatatcgcgtcgtgcggcggcttttcggaaaattgcgtaggttcaagtcgcgcaataagctcatgcgaacgcgccgaagcatcatcgaagcactgcatcgcgtctgcaatgcgagtgaaatcgccttcttgcgcctgcccaagcagcaatgaagcatcggttatatcgttggaaatataatcatgcagggcatgtgcaatctcaagattctcacgctgccgctgaagcaggccatgcaattccgcctgagcctgactttgccgaataaaaccgccgatcagcgcagccaaaaccagcaacgcaaccatgtacaacaattcctgtgaagaaataacattcgcggaaacagttttcctgtcatccattgcaggcaatagccagctcattcccgccaccacagcggcaaccgccaaacttttgcccaagatgacaataaccaagcgccccaatcgccatcatgcatgacatcatgtattcctccggcagaggattccacaaatcgcaggggaatagcgaaacgcaccaaatggcaagaattatccaactgccgcatcgaggcagaaaagcaataataccaagtggaatcagcgaaataattaatttaaaatatttatgagattcatgctgacattcgcttggagaagcaaatcagctagtgcacagaaatgcattatcaaacaagttgcgataagaattaagagatattttcgattgcggatgattttcagtgcactgtcgaccatggcagcactttctgaatttcacctattttattcttgaataagatgatgttgctggcaaaagcgtatagcttcgatccgcttgctcacacctaattttttcgaagcatgatgaacatgagaaagcgctgttccgcacgaaatattgagatattttccgatttcttcagtagttaatccttttgtgtacatagaaagtatgttgagttctcgcttggaaataatccgttcgtctttttcggaaacgatgcgaagatgctcataagattctctcgctgaaagaaaatcgcccgggcaatcggcgcgttttcccgaagccacctcccgaatagcttttgcaaaagccggtgagaagatatcccgcctggagaacaacccttgagccccggcggaagcaagctgctgacgatattggtccagcggatacgagttcacgccgacaatacccaacgatgcattgcggcacctgatttgccggtacacatcgacgccggaaataccgttcaacgcaagatccataacaagaacattggcttttgacagcgagtccgcactttgttcgaacgtcacccgttccagcgtgcgttgcgccgtcatgccagtccaaacaacatgcatcgagctgccggaccgttgcagcagaagccgcatcatctccaacgcgcatgcgtcattatcaagaatccccacattgacgccatcgtcgcagttcttcggaaccatacccccataataacgctccgaaccacctcagcctccggactccattttttctgtaatcgcacttgattctttgcttcgcgaagcacgaacttgagctacgccgcgatggagcgcaagtgctgacgcagactatatcaggtggcgtggctcaagtaagggggttgaagatgattcggcagacagttcagtggatcgtgtatttcgttaccgtcgcggcactcatctgcggattggagatcgtaaccggacttcccgcgcaaacgcaggcctcgctgccattggggacgcatctgtggattgcgctgtggtgcgttttgggactgatggtcatcgcattcgtgcgactttcgcgcagctacccgccgctgttcattatctgcactaccaccatttgcgcgctggattggctcgtgttgggattgaaatattcgcacatcaccattgccggtcttctctcggcatccaatgtcgaaatcatcagcaatgtgctcaatattgccgcgatcgccgtaatcgccttcagctgggcgaaagatgacgatacgggcaatactgacaatacaaagttgtgaccgcctactacgcaacccgtggtttcgtattgcacaagtcgcgaaaagaccgcaaatcgcgagttgtgcagacggagcttcaagattgtgcgacgaaatcacggaatcgtgaggtcgattcaaagatcgtgaggcggcttcatactttggacggagcgctcgcgtacactggaagccatgtcgaaggcatcagaagaagcgcagaagcaattggaccgtatcgtggcgttgggatatccggatgtggccgatatgtcggccgccgcgttccgtgctttggcacgcccgctcatccgcgcgctggaggattccgatttgggtacgcagattctgttggtgcctacgcgcgagttggtttccccggaatcgttgatcgcgcgtacgtcgatcaatcgcatggctggtttcaccacgatgccgccacgcgatatcgccagtttccttccgcaggatggtttcgaacctccggaaggtccgttttacctggtggtcgagccgcatacgggaacgtgctacatcaatcgagagcccgatgtggcgcgcaagttgatcgattccgacgagcgtttgccgcttacgttggaagagggacttgctattgctacgcagcatccggagtggttgttggagaagaacggtttcaatttgttgggatcgcgttccgcggatggtcgcgtcccaagtatttggatgagccagaacgcgccacgattgggtgcggtatggccgaattcccgtcatacttggcttggcaacgcgttttgcgtgtctcgtcgcggcgtcagcttgttccactgacgttctgctgatatttcgcagattttccacagattttccgcattccacagattggcgattgtccgactgttgcgacggccacgccttgcgtcgccgcacctagcgcttgaatagtttggcgatggcgtggccggctgcggcgcacattaccgatccgatgcccagcagtgtggcggtgacctgcgggcggcgcaattcgttgcggatgccgatcagatcggtcacgcaatggtcttcgaagaacacgcgcaattcgttgctggagtagcgcccgatcaagtcgccccacgtgagcatgcgcgtcacgtagctgaccggattgttttcgcggaattcgaacagtcgaatgcctcgcagccgcgatttcggaccatagcattcaaagccgcaggtcggcgcgtagccaagatcaatgtcatgcacgtgcccgacgaacgcgttcttatggtcatgcccgcagaacagcgcgaaatagccgcccgcatcgcgcaatgcctgcacttcgccaacgttctcatccgcacagccgatcgcctcgccaagcctcgagccaggtctgcacacgtcacgattcaacacatagcaatgccccgcgaacgttcgcgcaccctccaccgcattcggcgtgtatgcgggcacctcgcgcaggcaatcgtagaactcctgcggcggaatatgctggaacgcgatcgccggaaccgccaaaccgtcgccattgcgctcgcccaactcgcgttgcacttgcttcagccattcgatcgcttccggcgaaggcgtgccatagccgtcggaatcggccaaatcccatccgcgcgaattcgacgcgtattttgcgtaggatgtcagcgattcccgtcctcctgcagcatttccagtatttccggaagtatcgccagatttgccagcatttccagtatccccagcatgctcgcgatcgccggaattactgcgatcgccgtcaaacgcattatccgcatagtcgccggaattcaccatcatcacgctcatcgcaatgcgcccagacccgtcggaagcctcgatcggaatcgcaaacgtgcctggttcgagcgccaaaggagacgacccggcaacgggattcatgcaaccggaaaactctcggtagatgtcatcctgttcgtcggcgagaatgccgcactggaaatcgtggttgccgtaggttgcggcaaaggggattcgcgcttccaatgcaggtccaaggaatgctgcgaacgtgtctcgtactttctgccgcgtgctgtcgagtatggccgcggcggtcgcgcgattgatggattgcgcccatgattcaagcttgttggcggatccgttgcgtccgtcgcgtttgttgcgtttcacgagtttcggcgagtcggtgccgatgccgtcgatcatccaattgtcgtcggtcgggggctgttcgagcaacgctttggtgaagggatgtcgtttgatgccgcggattttcgcttcgatttcggtgaccgctcgtatgtgcgtgcccggctgctctccgcgacggcgcaggaacgtgtcgatgtacgcggggtcgtatccgcgaatctggtcgccggtgaagacgatcagatcgggatgcgttttcttgatggcggcttcgatgagacggatcgtgtcttcgcgcacgtttggtccgtcctgaatatcggccatctgcagcacacggaaggtgccgtcgctgttgaatcgcaaggtcatgatgctcactgtaatgcggcaaatttggatatgaggtgaaaaagagacgaaaatcgtggtctgtccgtcatatggcggaatgccggcgatatatgggattggttgccgctactatgggcggcagtgcaggtaggtaacatgcacgtaacaatgtgggccggcagaaggcctgcccagctttacagataaggaggagtgatgggtcaggatcaatcttcagtgtttgatctcgcggcagtggctgcagcgtccaacggagggaacaacgacccgctgctgcctccggcgcgttatattggagctccgcaaaagcccagcaagatgccgtacaacaagtacgtcgcatacgataagcaggtgccgtttgattacccggagcgtacgtggccgggcaagcgactgcagcgtgcaccgcgttggtgttccgtcgatcttcgtgacggcaaccaggccctcgtcaacccgatggattccgagcgcaagctgcgtttctggaatctgctggtgtcgttgggcttcaaggagatcgaggtcggcttcccgtcggcttccgaaaccgattacgatttcattcgtatgctgatcgagcgtgagctcattcctgacgatgttacgatcgtggtgctgacgcaggctcgcgagcacctgattcgcaagacttacgagtgcctgaagggtgccaagcgcgccgtcgtgcacttctataactccgtgtccgtgctgcagcgtgaggtcgtgttccgcaaggataaagccggcatcaagaagctcgccaccgacgcggccaccctgtgcaaggagcttgagggcgaagcccagggcatcgacctgtattacgagtattctccggaatccttcaccggcaccgagccggagtacgccgttgaggtgtgcaatgcggtgatcgacgtgatcaagccgactccggagcatccgatgatcatcaatctgccggcaacggtggaaatgaccactccgaacgtgttcgccgatcaggtggaatacgtgtcgaacaatctggtgccgcgcgacgccgtggtgctgtcgctgcacccgcacaacgatgagggcatgggcgtggccgccaccgagctggccgtgcttgccggtgccgatcgtgtcgaaggctgcctgctgggcaacggcgagcgcaccggcaacgtcgatctggtcacgcttggtctgaacttcctcacgcagggcatcgatccgcagatcgattattccaacgttcctgagattcgcaagacggttgagtactgcaaccagctgaagatttccgagcgtcacccgtatgccggcaatttcgtgttcaccgccttctccggttctcaccaggatgccatcaagaagggtcttgaggctcgtcaggtggccgccgatcgtgccggtgccgatttggacagcttcgtgtggctggtgccgtacctgccgatcgatccgaaggatatcggccgcacgtacgaggccatcatccgcgtgaactcccagtccggcaagggcggcatggcctacctgctgaagaccaaccacaatcttgatctgccgaagcgtctgcaggtcgagttcgacaaggttgtgcaggcgtacgccgatgagaccaagaaggaagtcaaggacgaggatatttggcgtctgttcaaggacgagtatctgccggtcgaagagtccggcgctactgcggctggtgccgtggtcggcgacagcaaggacgactccctcgagcagtggggccgtctgaagctgctgaaggtgtcggtgtcgtccggtgaagatggttccgataccgtgctgaaggccaggattcttgaccgtggcgtgaacgtcggcgttgatgagccggtggagcgtgaggtttccggcatgggcaacggcccgcttgccgctttcctgaacgcgctgagcaacttcggcatcgaggcttccgtgatggattacgtggagcacaccatgtccgtcggcaccgacgccatggccgcctcctacgtggaatgccagatcggtgaggaagaggatccgcggatcgtgtggggcgtcggcattgacacgtccatcgtcaccagctcgctgaaggccattatttcggccatcaaccgttccgagcgctgatttccgcgggttttcggttctcgtagctgaagggcttgtgatgtacttgcgagtacgtcacaagccctttgctttttgatttcataggattcccgagtttccggattttccagtttttccggattattcggaaactcggaaattcaggattgcgatccccaaatgcagacattgttgccgattgcggagaacgtcatgaccggcttgccgtcgatctcgcgggggagtgttgcgaaccgtgcaatgtaggtcacgtcgtccaatcggatttccgcgtcgcttgcgcaacagttgaatccgttcacggcgccggaaagcggtttccacgatccgcaggtgatcggcccgtccgtcgacctcggcagattcgcgtcgggagtatcgaagaaacttacgatttcaccccgggtgatccgcccgtcctcatggaacgtatatcgcgtcggacgattgatgccaacgtacgtgccatcatcctcttgcttgccgttgaagaacgtatgctgatcatgaagtacaacgttgtaatcgcctgtgatatcggcaatgccggtcggcgcgacggcaacggaaccgcggtattcgtacggtgccgcaaccagccagccgtcggaagtcggcagtaattcgcgtacgtgagattcgtaatcttcatcatcgccctcgctaaagcgttccgcgaaacgggtgtggtagacgaggaacatgcgaccgtccttcgaccgacgaatggcggaattatgcccctgcgagacttcgacatcggcaagttctgccggaccgccatcccactgtacggaagacgtcaatcgaatgccggtgccgcgctcctgattgtcgggaatctcaccgtacgaaatcgcgggattgccgttctggtccacgtacgggccaagcagcgattttgaacggaacagacgaatctgatatccgccggtgcgcccaagccagccgtacgacatgaacagataccaccatccgttttcacgaatgaagtacgatccttcgccggaattccagtagcctccggccactttcacgccgtaataaggatcggaggaatccttgaccagcgggtatcgcacggaataatcgcgcaagccggtttccggatcgagcttgaacatccagatgccgccgaaccatgaaccgaaactcatccacatttcgccgtgctcgcacaatgcgggcgccgcgtcgatggcgttgatgcgcgtgtctttgagcgacaggtagcgggtcaggtcatagccgacggtgccatcggttttgggctcaagttccagcactttcggcacgtcggtgttccacaggttgctctcgtcgaaaccggaatataccaccggccccacgtacgtccagtcgccgtccacatggtcggcggtcaacagcacgatcaccgagcggaactggtcgccgttcaccgacaggtacatgcaccacttgcccatggtctcgttccagatcacgtcgggcgcccacgtgttgccgagcaggtcgggattggaatcctgtttcggccatgcctgccaaatatcgccgagcagcgcgtacgggtcgcggctcagattgttatcgaaccgctcccaatgcaccatatccgtgctgcgcgcgcaccgacgatgcgtgccgaacagatagtagacaccgttttcctcgacgattgcgggatcgtgcacggccacccgaccgttggcgagcgtgtgctcgatgccgttgggcgaggtggccggtgccgcagatagtggttctgcagacgattgcactgcagcattcacggttgttgtgccgttttcactcacttctgcgacccccaaatgcactcgtttgcgccgattgcggagaatgtcatgacggatttgagatcattgtctcgcggaagcagcgcgaagtcgccttcataggtaacgccatccaaggtgatttccacttgattggtgccttctttgacctgccatgtgccagttttatctccgctgacggtgccgccttgttccagcttgatggtgactggtgtgttcacgcccttgtaatcggtgctgtctttctttgtggcatcttgcaatccttggaagaaggtggtcgggtcatgttcaacgagttcgtattcgccggtgagcttgctttcttcatagcccttagcgtcggccttggctccaacgtactcgtatggtgttgctgtcagccagccgtcagacgtggtcagcaattcacgaacacgtacttcgtgctcttcgcctcggttggagaagcgggtgtggtagaccacataggcagtgccgtcttcatccacgaatgcggagttgtgcccctgtgcaacctcgatgttggtgttgtcgttgccgctccattccacggatgccatgagacgtatgccggttttgccaagccagttgctgccgatggttgtggtggagattgcggtgttgccgtcctcgtccacatagggcccagtgatgtctttggaacggaattcgcggatttggtagccgccggtttgctgcagtgcggcataggagacgaacaagtaccagtaatcgccttgtttcatgatgtaggagccttcgccggagttgccatggccgccggcgattttgatgccgtagtactggtcggtttggtctttaacggtttcgtaagtggtgctgtagtcgcgcagaccattggaagcgtcaagtttgagcatccacagtccgccgaaccaggatccgaaagtcatccacagatcgccgttgtcgtcatacttcacgcaggggtcgatggcgttgatttcagtatcgccgggggagaggtagcgtgtgggtacttcattggaatcgagcacttgcggtacgtcggttttgctgacggtgtcatttcggaatccggagtagaccacaggacctacgagcgtccagtcgccttcgatgtcatctgcggtgagcagcacaatcgccgacttgtagttgatgccgtttaccgacatgtacatgcaccatttcttcatggctttgttgtagatcacgtcgggtgcccacatattgccggtcagatcagagttggctggctgcttgggccactcttcccaaaagtctcccagaatatctttgaactgagtgctgagattattggtgaacggttcccaattgactaagtcatcgcttttgagccatgcgcgatgcgagccgaaaatgtagtatttgccgttcgcttcgacgatggatgggtcgtgtgaggatccgcgttcaatgtcggagacgcttttgaccacagcttgtgacgagccgcctggtgctgagcatcctgccgcggtgccaagtagcatggcgcaaccggcgataagcgctactgtttttcgtaatgtgcggaacatgtctttcccttctccgtgatgttctgtactgcgatgtagtgatgtgtacgatttgtacaacgttgtaacatgcgatatagtacatcgttgtaaaccaaaagtctaactacatgaaggggcgtctaatgaagggcacctactcgttgctgtgctacacgcgcgaagccactggtcgcgaagaggcgaataatgaagacatcgcctacagcatgcatctggcgttgcgtgcgagcgaaaccgcggaatggaagccgttgaacgagaattacggcatcttcttcgccgctggcgtacccattcaggccgccaccgccgagtcgcgccgagcgtgcgtcgcggcggcgcatttcgtcgccgatccgttcgatgaggcgcatccggccaccgatgccgtcgcatatggcgcggtgatgccggggatcgacatcacgttgaaatccctgaagaacccgtatctgttccgccttgcggatggccgattcgcgctcgccgccacccgtaccgcgcgcggcggcgagccggatggctccgagcgatcggcgttcctgttggccgtcagcgacgatctgacctccttcacgcagcttggactggtgatgctgcgtaccggcggtggcgtcaatcgtccgtctgtcgcattcgacgcggacgcctcccgttatgtgatttcctggacgtcgaacgacggcaaatcgtatgtcgcgaccgttgccgatattgtcgccgtggccgaatccggcgagccgatcgatattgcggaagctgtggtaacggcggaatcaagccgttcctgcgattgcaatattcccaatgccgttcctggcaacgtgattgccgtcactgaagaagaagcgtcgaaactgatcgaacgattcggtcgtatttacaacgttgaaacatcggtggcgacgcagcatatcgacatgacggcaagcagggaagcgtcccgtgaagccgtgcaggcactcgccaaggtccgcgccgatctcgtctacagcgacggttccggtgccacccgtgccgtggattggaacaaagacgaacttgaggcgattgcgcaggacgccgccgaaggcaagttccagccgggcgacacgcgcacggtgagcggccgcatccgccaaaccgtatacccggtgccatttgccgtggagcgtgcggacccgtcggtgttcgcttggaatttcaacggcaagccgatgttcatgttcatcgccaccgacgataccgacggcaactgcgtcgatccgaacgatggcgccacgcatatgccgttgcgcatcgccgactccatcgaagcgctttccgacgcggcgggcggccgtgccaaggaaatcgatctgctcaaatgcggtgattacaacgctgaaggacgcgccatgaccggctgcttctgggcgccggaactgcatgtcatcgatggaaaactgtcggtgctcttcatgccatgcttcgatgggccggccaccaatccagacggcacgcccaacgatcgcgcgggcaagccggacatgtggacgggcagctgccatatcatgcagctcaagcagcattccgacggcacggatttcgatccgcgcgaacccgaaaactggacggtgccgaagccgattctcacaccgaccggcggcgtgctcaatcccatccaacgtatctcgctcgacatgaccgtcatcagcgattccggccgctggtattacgcgtggcagcaggtcggcagcatttggatcgccagcttcgatccggcccgtccggaacggctcacctgcgagccgaagcaggtcgttgtgccggaattcgcctgggacaacatgatcgccgaaggcccgaacgccattgtgcatgacggcacgatctatctgatctattccggctcgctggtcggtatcgactacaccaccggtctggtcaccgccccggccgggcaggacgccgatctgaccgatccgaacgtgtggacgaagctcgactatccgctgcagaaatccggagtatacaacgggcaatggcagctcggcaccggccatggcatgtggtccaacgacgaggacggcaatctcatctatgtatttcacaatgcggaatacgagaatggacggtatggcggccgcgacgcccaggtgcgccgcgtgcactggtccaaggagggtatgccgatactggacatgcaggcggcggaagagctcaatccggactatgctgatataacgatgaaaatcgtggtttccggcaataaaggctgatttcgttggcttcagcgctgcaaggggcgaaagccggtgttggggccgaatgtatgagacgtttttggtgaaaaggggttgacatgccgaagcagaatggcgccaacggcgagcacgtggtgaccatgcgcgaggtcgcgaaggcggccggcgtatcgatcaaaacggtgtccaatgtggtcaacgactacgagttcgtgtcgcaggccacgcgagacaaggtcaacaaggccatcgacgagctcggctacacgctgaacgtgtccgcgcgcaatctgcgcagggggcagaccggcatcatcggcctcgccattcccgatctgcagatgccgtacttcgcgcagctttcgtcgctggtcatcgaagaggccaagaagctgggcctgcgcgtgatcgtcgagccgacgcaatactcgcgcgaaggcgagattgaggcgttgcacggctcccagcagacgatgatcgacggcctgatctacagtccattggaacttgatcaggatgatgtcgaccaattggatgtggactatccgctggtgcttgtcggcgaacgcatcttcaccgacaaggtggaccatatcgccacggaaaacgtggaaggtgccaagcgcgccacgtcgtatctgctgcagaccggctgcaagcgcgtggccgtggtcggcgtgcatccgggcgagaaggtcggctccgccgcgctgcgctatcagggctaccttgaggcgttggaggaggccggcgtcgaattcgacgagcgtttggtggtcgagtcgggcatgtggcatcgtagcgatggcgtgcgcgtgatgaacgcgctgcttgattccggcgtggttcccgacggcgtcgtcgcgctgaacgacatgctcgcctccggtgtgatgcatgcgatccagatgcacaatctgcgcattcccgaagatatttcggtgatcggtttcgataattccgacgattcgcagtatttgtctcctgcgttgacgtcgattgctcccggtcttgaggcggtggcgcgtctgtcggtgaaattgctgaaggatcgtatcgacggggtttcgccgtcgaaggatctcaagccggagcagaaggtgttccgcaaggtttcgtcgtcgttggtggtgcgtcagtccaccaagctgcccacgaattccttggtggtgtgatcttccttccttctttttcttcttcttttggaagaaaggaagtgattggtgcctcggcgcttgcgtccggttttttacggattgccggtgccgaggtttttgttttccctttctggcgattgtctgttgccgggtactgcgattcgattcttccgaggagtcggatgcgagaaacacgcggtgcgttcctccgatttgttacaacgttgtaatagtgatatattcaacgttgtaaattactggaacagcggattgaaaagggatagacatggctgtttacaacaatccgatcgtgcttcagcgcgcagatccttgggttctcaaagttgacggcgagtactacttcactggctccgacccggaatacaactgcatcgccattcgtcacgcatcgaacatcaacgacctgcagaaagcccccgaaacggtggtgtggcgcaagcatgagtctggaccggcgagcatctatatttgggcgccggaactgcaccgcatcaatggcgcttggtacatctacttcgcaggcgccgcaacggatttcgaggcctccggcctaccgacccaccgcatgttcgtgctggagaacaccgatgacgaccccaccaccgacaactgggtggaaaagggtcagatcgtcaccccgatcgactctttcgcgctcgacgccaccaccgaggtgatcgacggcgtgcagtacctggtctgggcccagaaagatcccgccatcgaaggcaactccaatctgtacatcgccaagatggccaacccgtggacgctggaaagcgagcccgtcatgctctccaagccggaatatgactgggagtgcatcgacttcctcgtcaacgaaggcccggccttcctgttccacgagaacaagatctacatcacgtattccgcctccggcaccggtgtgccgtatgccgtcggtctgctgaccgccgagcgcggcagcgacctgctgagcaaggattcctggaccaagagcccggtgccggtgttcaagacctgcgccgaaaacggccagtacggccccggccataactcgttcaccaagtccgaagacgattccgaagacctgatgatctatcactgccgcaactatacggaaatcaagggcgatccgctgttcgacccgaatcgtcatgcccgtgtcggcgtggtcaagtggacggagtgcggccccgacttcggtgtgccggaacccgacaatctgtggaccccgaccaccacggacgtgttgccggccgatggcggcgctcttgcgggaacgccggtagcgaactgacttgcgtaatcgtaagaaacgttgcgattccaacaaaaacgaataattgaagattataaagaaaacagcttttccatcggcgtgtttccgatttgtacaacgatggaaaaaactgtataatcaaaattacaacgttgcaaacggcagtgcagctgacgaagcgtgaacgacatcgcaaacaaggttgttgatgaatgtcactgcaacggttggaggaaatgtcttgggagaccaagaggaaaaggagaaatccatgaagatcaagaagagcaccaaggctctcgcggccgcggcctccctggccatgatggccaccgtcggcctgtccgcctgcggcggctccgacagcagcgaaaccgatgctgatggcaagccagtcatccgcatcgcactcatcaagcgcagcacccagatcgaagctaaggaaatgaagctgcagaaggatcttgaggccgcctgcgactgcaccatcaagtgggacgaaatcctggatacccagtgggcccagcagtcctccaccgtgctcgcctccggcgacgttgccgacatcaccatctggggctacaactccgacaacttcgcccagtatgactactgggaggatctgagcgatgatctcgatcagatgccgaatgtcaaggcatacttcaaggaagtgccgaacgccgaaaagttcggttccgatatcgatggtcacgtctggcaggttccgtccgactacggcaacgcatccggcgctaagtggtccagcggtcagaacctcatgatcaacaagtcttggctcgagaagcttggtcttggcgtgccgaagacttgggatgacctgaccaaggtcctcaccgcattcaagaacgatgacccgaacggcaacggcgaagccgacgagatcccgatgctgatcaaccagctcggcaccgcaggcttcaactggtgggatccgttcctgctgctcaacggtaccggtctgaacacccaggtgatttccaccgccggttccaagggcatctacgtcaaggacggcaagatcggcaacttcatgatcaccgacaacttccgtcaggtcattgagtactaccactccctgatcgagaagggcctcatgccgaaggatattctgacccgtgatggctcccagaacaccgccgacatctccaacgacggcaagaccgccaaggtcggtctggtcttcggctggaacaccggcaacttcggcgatctgaaggatcagtacgagtccatcgaggttccggcagctccgggcgtctcctatgaggaaaccacttgggaaccgcagttcgaagatatctacaacggcgcttgcgtcaaggctgatctggacgaagcccacaagaccgcagctctcaagatcatcgacaagtggatcacccctgacatgtccatggaatcctactacggcgatctcgatacctacatctccaacgagggcgacggcaagtacaacgtgctcaagttccaggacgatctctccaccttcggtctggcagaccgtggtctgacttgggtgtctgacgacatgtccgtctccggcgatgaagacaaggtcctcgctgagaaggacggcaagacctacgaaacccagcagtcccacatcggcgacaaggatctcatcccggcctatgtccgtctgagcgcagaagacaacaccaccgtctccaacaacaactccaacatcttcaactacgccatgccgctgatctccacttggattcaggacggcggtctgaccgacgatgcatggaacgagtacgtcagcaccatgaagcagcagggcgtgggcgagaacgtcaagctctggcagaagtggtacgacaagaccatggctcaagagtgagcgtaggtcatcccgcaaccacataattgaatatctcacataactgaatcaaataaagccctccctgcggtgagcattcttccgtgcatcacgggggagggcactctgctttttaaacacattcgcatcgattaccaaaagagagggatggacatggcttcttcgcaaatcacaacatccgggtcgagcgccgacatcccggacaacgactacatcgcgcgtcacaagccgcttccgattcgtatttcggctcatctacgtcgttactggcagctgtggctcatggcattgcctgccatggttttcgtgttcatcttcgcctacattcctatgtacggcattcagcttgcgttccgtgagttcgtgccccgcaagggcttgaccggcggtacgttcgttggtctgaagtacttccagaagttcttcgaatctccgcagttcgtgagcttgatgcgcaataccatcagcatcagcctttcaaccttggtgatgggctttatctgcccgatcatccttgctctgctgatcaaccagattggttccaagaagatcaagggcttcgtgcagaccatcacgtacatgccccacttcatctccacagtggttatcgtctcgatgatcagcatcttcctcaacccgaattccggcttcatcggtcgcttcttcaatgaagacggcaagagtgttctgggtgatccgaacctgttcactccgatctactggatcagcgaagtgtggcagcactgcggatggaattctatcatttatttggctgctcttgctggtgtcgacacggccctgtatgaagctgcgaagatggatggcgcaagccgtctgcagctcattcgctacgtcgatattccggctattcttcctacctgtggcgtgctgctgattctgaacatgggctccgtgcttaatgtcggcttcgagaaggtcttcttgatgcagaactcgctgaacctgagctcttccgaggtcatttcgacattcgtgtacaagatgggcttcgtgagtaatcagctcttccgaggtcatttcgacattcgtgtacaagatgggcttcgtgagtaatcagtacagctactcgacagctattggcttgttcaacacgttgattaatttcgtgttcttggtagtggccaacgccatctccaagcgcgtgtccgataccagcatcttctgacggtgacagggcaaagaaaggacattcaaaatgagtaattccgttgcgccagccgtcaagacggccaatgacgagattccatggaatccgaaggttcgccagaagaagcagccggctgactatgtggtcgattttctgatcggtctgctcgtggtcgcagtggtgatcgtggtgctttacccgctgtggttcatcgtgatcgccagcttctccaacgcgtcgctggtttcccagggtggggtcaccctcttcccgaaggggatcgacttcgcgggttatgccaagatccttgatgatgcgcgaatctggaccggttacaagaacaccatcatctactccgtggtcggcaccatcgtcaacatgctggtcacactcccggtggcattcgcgctttcccgccgtgagttcaaagctcgtcgcgtgatcctgttcctgttcaccttcaccatgttcttcgccggcggtctcatcccgagctacctgctgttcaaggatctgggcatcctcaactccatgtgggtgttcatcctgccaggtgctgtgaatgtgtataacgtgatcatcgcacgttcgttcttcgagacgtccattccggaagaattgcatgatgcggctcaggtggatggtttgggctacttccgctacttcatgaagattgtgctgccgctgagctcggccatcatcgccgtgattgcgctgtactacttcgtgggtcactggaacgacttcttcaccggccttatctacatccgcaatcaggagaagcagccgttgcagaacgtgttgcagaacatcctgctggccaaccagatgaccacatccggtggcggttccgacggtcgttcgatgctggaacgtcagcaggctgcggatcagatcaagtatggcatcatcatcgtgtccaccctgcctctgctggttgtgtatccgttcctgcagaagtacttcaacaagggcgtgatgatcggcgcagtcaagggctgatcgccagttcgcgggttcgttccgctgacacaaagcagtgcggacccgcttctcaatcaataggacttcatttccttcctcctttcgcaaggctgccgtcgtcatgcggcagcctttttcacatcccaatcgcaatgctttgctgactctacggacgcaagcaacacgaaaaacaaacgatataagcagtaaggtgacatcatgaccgcaacagacagcccattcggctacctgctcgtccatttcatcgaagatccggacggctatgcggaaaagatctatatggatctttccgatggcgacaatccgcgtcgttggattccgcttaacgatggcaagccgatattgacgtctaccattggcaccactggtgtgcgtgacccgcatatcattcgtaatccgcagactggaacttggtatgtgattgccacggatttgcgagtgttcggcggtgataatgcaggctggttcgagtggactcgtcatgccagcacgaatctcatcatttgggaatctgatgacttggtgcattggagcgagccgcgcatgcttgacgtttcgcgcaagccggacgatacgcatctcgagttgggtatggcgtgggcctgcgaatgcctgtgggttcccgattattatccggaaggtcacgagggtggtcgcggagcgttcgtcatgtactggtccagcacgattttcaacgatgatgatcccgatcatactgatgatggcgtgtactgcaccgtgctatggggagccaccactgatttcacgcagcagacgtacgaatacggtggtgtgtttattgatacgggcggcgattccatcgataccaccatggtgcagcgtccgctgcctgacggtgtggttcgtacgtaccgtatcaccaaagacaactctttcggcaatggcatttggatggactccaccgatgcccgtcgttggtgggagccggatgcgcagtggacctgcgtgcagaaacatatcggtgccggttatgtgccggacggcaatcctgaaggcgtggaggggccggcggtgtttgcaaaccatcacaatgatggctcggatgcggatgaatggtatttgttcgtggacgtgattccttccatcggctatcagccgatgcgctcgaataatctggactctggcttcgttccgttggatagtcctgattattatctgtctgaacatacgaagcatggcggtgtcgcttcccttgcgaaagaggaatatgaccgcatcgcttccgaatatggtttgcagtgacatctgaatcgtcgatgccgaaggagggcatttgttcggccattttcggcatcgacgtcgcctgtgtttagtgcgggcttgatgtcggatttctgaatttcggcacgttgccgcctcaatacgttattataacgttgtaaacgttgatattccttggtatcaaacaaagaagtgccatttcgataatgtgatgaggtagcgtatgaagcgttttgcggtgggctatgaatttctgtgccgtatagtcatgatggtggttgttgccaatgtcgcatttcttgtgcacacgctgctcgggcttgtggtggtcggtttcttcccctcgattgcggcgacctatgccacgttccgcacttggcttttggatgttgacgatcgttcatggagtatctcgcgcacatggcgtaccttccatcaggcatggctggaggagcttggtccggcaaataaattcggttggcctcaattcctgatatgggtattgcttatttgggaatactggtttgttcagaataatgatcttggtactaccggctttgcggtttcaggtgcgttgctgctgctgaatgtgctgtatggattgttcgtttttgtgagctgggccatacacgtcaatttcgcggagaagctcacgtgggtggtcaagacgtcgttgagcatggtgatcgctcgccccctatgcagtttgatgattgcattgttgttcctcattgtggtgtgggcatactacacatggcctggattgatgattgcttttggtattgcggtgcctgtgtttgctgcgatgatggctatctattcatggggtcgtctgcctggcatggatgtgcatgtgctcgagccagtgcttatcgatgacatgccgaaaaaaacagatgccgattcgcgttcttgaagcggtcttatgcagtattgcgtggggttacggcggggagtggttttatgacgtattactcgtgagtaacgcatgattacgacgcaaaggagcgcgcatatgactttgcatattttcgaacgggtcccctacagcaggtgaggctactgccaggagagcattttgacgcgcagcaggccggcgcacggtacctgcttgagcttgacgtcaatcgtctgctctacccattccgcagggagacgggactgccgcagccgaccggtgccgacggctcgttgcattggcgtcgcgcgttggctggtggcgaattccagtatgcgatgcgcgggcgtggtcaggcgcatcgtttggaaatcgaggtgattgccgattccgcggaaagcgacggtgaaagcgcggcgtatgaagtgacgctcgacggcctgccattgcagcgcggcgaacatcgaaaatcgcgatatggcagacgactgaccgtccgggggcgtctgccatggcgatccggtgattggaggatgctgatacgcattgtggcggcaacgatggtattcgttgccgccacaatgttttttgcggttgctttgccggttgccgttccggctggcgtcggttgccgtcaatgagtgggtgccttgcctgccgccgacggttgttgcgacggttattgggctccgttcgactggtcgtctccggagttgtcgccactgctgttgccgccgttgccgccgtccccggagttgtctccgccgttattgccgctgtctccgctgtctccgccgtctccggagttgccgccgtctccgttaccgccgtctccgttaccgccgctgttctgatcgctgttttgcgtaggatcgggtgtggtctgctcggtgttctcttcggccttcggcgtctcctgattctgccgtgtctcggtcttctgcgcgccggtgccccatgtgccgtccgggccgccgatcttgccgttgtcggtcggttcggtgaaggtcagcacctcctgattctgcaatgcgagcgacataaactcctcgaacagatgcgacgggtagcccgtggaggaaacgccatagcctgcgaacgatggcacttcctgcgcgctgccgtcttccgcaggattccaaatggcccacacattgagcagctgcggcgtgtagcccacgaacgaagcggccttctcatcattcgcggtgccggacttgccggccacctggcgtccgagacgtgccgaaacaccggccgcggtgccgtacgtggtggtgccctgcatggccttctgcaccaagtggcaatcgtttgcgtcgaatacctgctggttctcctgcgctgtcttgtacagttccttcgaaccgtcggacgtgagcaccttgtcgacgatgtgtaacgtgtttttcacaccatcgttggcaatggtggagtggccctgagccagatcccatacggtaatgccgttgatgcccagaatgttgtaggtggtgtcttcggcaatgtctccctcaatgcccgcctgatgcgctattttggcgagattcgcggcgccgagatgcttgttgacgtccatgaacacggtgttcaccgaattcgcggtcgcctgatagaggttgatatacccccagttggtgttcagtgcgttcggcacctgcgcggtggttcccggcgtcgtttcaaacgtcaggccggaattgccgttgaagatggtgttgaaattcacaccctcctgcgcggcgcccagcaagccgaacggcttcatggtggaacccggttcgaacgtggcctgcgtggcgttgttgagctgcttggtgaggtaatcgttgcccgcatacatggctttcacggaaccggtcttctgatcgaccgcaatgccgcccacctgaatgctttccggcatgccctccggtcgggtgtcgccgacctgctgaatctcgtcctgcatgtccttgtcgagcgtggtgacgatcttgtagccgccggtttccagatcatcggcggtgaacgccttggaattgaccagttcgttcttcaccgtggtcagcagatacccgttcgcgccggccatctggttgctctgctgtatttccgccacggcggggaactgcgcttccttcttctcctgggcggtgatgtagccgtcttccttcatgatgctgagcacgcggtcgtatcgcttttcggcctgttcctgattgacggccggatcccatgagctcggcgccggaatgataccagccaacatggcggattccgacaaggtcagatcgctggcgttcttgttgaaatacgccttcgccgccgcctgaatgccatacgcgccacgaccaagataaatcgtgttcatgtaattgcacagcacctggctcttatcttgtgcctgcgcgatcttgatggccaggaacgcttctctcagcttgccggaatacgacgtggtttcgcccaaatagtagcgttccgcatactgttgggtgatggtcgaaccgccctgacggctgcctgtggtcagattcgtatacagcgctcgcgcgatgccatacagatcgatgcccttgttggtgtagaaggaacggtcttccgacgcgacgatggcattgcccacgtaatctggcaataccgcgcagtcgatgatttcgcggttttgctccgcgtagctgccgatttccgtagtgccgtcggcatagtagacggttgttttttcggcgagggcgaacttctccggttcggggatttccgtggtgatatacatgtaggcgaacaggccgatacctgccgcgagcagcgctgcgaagatgccgagtacccacttcagcacgagatgcttgcgcttgttctgctttttctgaggtccgttggcgcggtgcgatccgtggttctgcggcttgggcgcgctatgggatgcgttgctgcgattgctgccggcgccgcctctgcgggcgcttcttgagcgtgagcttacgcttcgtgtgtgtgaaaccataggttccaccgtagctgattgacttgagaaatcaggtgaaaatggggtgagtttgcccttgggagggcattttttgcgcagctcttttacaaatcgacagtttgtgggtcgttgtctcaatatcggctgattttcagggttttatcagtttttcaggtgccttttcgctgtttcgcaggtatgcttgaaatttggtacctgtgaaacgcatatatacatatatataacagaggagtcgtttacagatgagcattcgtgtagctatcgctggcgttggcaattgcgcttcttcgctggtgcagggcgttgaatactacaaagacacgaaggacgaggataagattcccggtctgatgcacaacaatttcggcggatatcgcgtgcgcgacattgaattcgtcgccgcattcgatgtggacgcgctgaaggtcggcaaggatctgtctgaagccatcgaagcgtcgcagaacaacacgatcaaattcgccgacgtgccgaatctgggcgtcgaagtgctgcgcggcccgaccaacgatggtctgggtgaatactatcgccagatgatcgaagagtccgacgccgagccggtcgacgtggcccaggtgctgcgcgacaagaaggtcgacgtgctcgtttcctacctgccggtcggttccgagcaggccgacaaggcatacgcccaggccgccatggacgccggatgcgcgttcgtgaactgcctgccggtgttcatcgcatccgatccggaatgggctcagaagttccgtgatgccggtgtgccgatcgtcggcgacgatatcaagtcccaggtcggcgccaccatcacgcaccgcgtgctcgcccgtctgttcgaggatcgtggcgtgcgtctggaccgcacgtaccagctcaacgtgggcggcaacatggacttcatgaacatgctgcagcgctcgcgcctggaatccaagaagatttccaagacccgcgccgtcacttccgtggtgccgcacgatatggatccgcataacgtgcatatcggtccgtccgattacgtggcatggcttgacgaccgcaagttcgcgttcgtgcgtcttgaaggcactacgttcggcgatgtgccgctgagcttggaatacaagctgcaggtgtgggattccccgaattccgccggtattgtgatcgatgccgtgcgtgccgccaagatcgcgctcgaccgtcatctggccggcccgattctggctccgagctcctatttcatgaagtcgccggccgtgcagcacgaggatggcgaggcccgccgcttggtggaggagttcatcaagggcgaggtcgaaggcagcgaagagcagcttgacgccgatgtcgccgccgccaaggcagctggcaaggatgtgtggcgcgcctgatttttagttcgcctgatatgaggaatccccaatctaccgtcggtggattggggatttttaattacgatttggaaacgatgcgtatcgtcacttcttgagaaggggttcgacctgttcctcgtacgcggtcaacgcggtgtcgatcacattgtgcatgtcgtagtacttgtacgtgcccaaacggccgccgaacaccgtcttcggctcggccttcgcgagctcctcgtacctcgcgtacagcgccttgtcggcctccgtgttgatcggatagtacggctcgtcgccacgctcggcgaaacggctgtactcctcccacaccacggtcctgtcgggattctgcgaggcggcgcgctccggattgaagttcttgaactcgatcgcgcgcgtgtacggcacgtccgcgtcggagaagttcatcaccgggcagccgaaatggtcgccctcgtcgtaacgcacctccttgaagtcgaccgtgcgccacttgagctcgcccagcgagtagtcgaagtagcggtccaccgggcccgtgtacaccaccggcacgccggccgcggccaaagccgccttgttgtacggctgggacccgtcgaagaaatcggtctccagggtcacatggatgcgcggatcgtcgatcatgcgctccatccacgcggtgtagccgtcggccggcaggccctcccacgtgtccttgaaatagcggttgtcgtagttgaagcgcaccggcaggcggttgatgatgcccgctggcaggtccttcggatcggtctgccactgcttgcccgtgtagttcttgatgaacgcctcgtacagggggcggccgatcagcgaaatgcccttgtcgttgaggttctggggatccttgcccgccagctcgccggcctgctcggccacgagcgccttggcttcggcgggcgtgtagtgcgcgcggaagaactggttgatggtgcccaggttgatcggcagggggtatacctcgccgtcgtgcgtggcgtacacgcggtgcacgtagttcgtgaacgaggtgaacctgttcacgtagtcccacacgcgcttgttggacgtgtggaacaggtgggcgccgtacttgtggatctccgcgccggtctcctcgtccatgtagctgtacgcgttgccgccgatgtggtcgcgcacgtcgatgatctccacgcgcacgccgagcctctccacggcctgctgggccacggtcaggccgaacaggcccgcgcccacgaccaccagatcgggatattccaccgcttcagtcataagaacaaccttccgaacttaaaacaaacacacaatattcgtgtgcgattcctcatcaagcatacccgtccgccctccttaacgcgggatgctcatggggaagcggcattttgacgtttgatttccctgtgtcgctggtcgtggggctggctgcttcacggatcatggcatggtctgtgtggttcgtgcgcggcctgtggcgcgggttgcgctgcggttcgtgcggcttgcggcgcggttcggtccgggcatggtgtacactggtctttgcctccgcgtggcggtacgtcacccaactcccccagggcaggaatgcagcaagggtaagtggcctcttccgggtgcgtggaggttttcttatatcttcatgccattcgcgcataccgtagagccaatgccgtattctcgatgattatgaccgacgaattcaagccaatcatccgagacccgcacaagtccgcgaatatgctggaacagccggtcgcgcccgttcccgtgccgcagccgccgtctgatccgatcgaacaggtgctttccccacgtgaagtgagcgaagggcttgccaaagccgatccgctgacccgtcatccgcgcgcgtcgagcattatgctcagcgtggtgttcggtctgctgctgcttgccgccgcggtgggcgtctggtggttgggcgtgcgcacgatggaaggccaaagctatgaagacatggtctggtcgaaattcgatgcggccctgccgggatggctggaaccggtcgtgcatgttttcaccatttccaccgttgtaatcgcaacaagcgcaatcatgttgataatcgccctcgccgtactcatcgtaagaaaacgatggctgttgattgcgcaactgtcggtattcggcggaatctgctttgctgcagcggagttgctgaagccgctgctgccacgtccgtacttaatcaatctggaatcaaatcccaataattccgcgccttccgggcatgtcatactcgcagcgacggcgggggtgatcctgttgtgcgccgtgcctcgcatgtgccgtgcgttggtcgcggtgattggttgggcgtacgcggtgcttgtcggattgtcggtgatcgcggggcagtggcaccgcccgaccgacgtgatcatggcactgctgatcgtcggcggagtagccatgctcatgctcgccgcaacgtttgcgaacggtatggatgagcccggatcgcgtgcatcgtcgccttccgtgcagatcgtcggcagcgtattgctgacattcggcgtgctcggcaccctgtatggcgcatacattatttggcagattcagccaggacttgcgatgagcgcggaatggacgaattccggcgcgcatctttccacggtgattttgactgcttccgtcgcgtcgctggtgttcggcctagtgctgaccatgcgtcagctgaccgcctcgccactgacgcaacttgggctggtgggggctcctccggcaccgccgaaacgctgacggccatgcctgcgatcgcaccgaaattttacggtgaaggccgctcgcgccacacgggcggtttgccaactgcatacggtcagtgagtattattgcgttgcaaacgctagtaataaggagtggctatggctaccggcagcaagctcgtgattgtggagtctcccaccaaggccaagaaaatcggtgggtatttaggctccgaatatacggtgatggcctcggtcggccatattcgagatcttgcgcagccaagccaggtgccggccgccgacaaaaccaaattcggcaagttcggcgttgacgtggaagacggattcaagccgtactacatcgtcgacggcaacaagaagaaaaccgtatccgaactgaaaagcgcgttgaaaaaagccgacaccctgtacctcgcaaccgatgaggatcgcgagggggaggccatcgcctggcatctggtacagacgctcaagccaaaagtgccggtcaagcgcatggtgttccacgaaatcacgaaggaagccatcaaagcgtcgcttgacaatactcgcgacgttgacgacgacatggtcgacgcccaggaaacccgccgtattctggaccgactgtacggctatgagctttctccggtgctgtggcgcaaggtcgggccgggtctttccgcgggccgtgtgcagtccgtcgccacgcgtttgatcgtggagcgcgagcgcgagcgtatggcgttcgtgcgtgccccgtattgggatgtcaccgcaacgttggaggcgccggatgccgatggcaataatgttgcgttcgattctcgtatggtgtcgttgggtggccgtcgtttggctggttccaaggatttcggcgccgatggcaagctgactgcggccggtgcgaaggatcaggtcgtgcagttggacgaggcgcaggcttccgcgattgcgcaggcattggaatttgcaacgtttactgtcgcgtcgatggaaaccaagccgtaccgtcgccgtccggttccaccgtttaccacgtccaccttgcagcagaccgccggcaatcgtctcggcatgagctcgcgtcagaccatgcgtgcggcgcaaggattgtacgaaaacggctatatcacctacatgcgtaccgattcggtgacgctgtcgcaggaagcgatagcagccgctcgtgaagcggtcgtcaagcatttcggcgaaaactatctgtcggatgcgccgaaacaatatgccacaaagacggcgggcgcgcaggaagcccacgaatgcattaggccggcgggtgcgaaattccgcgatcctgcggaaatcgcaagcaaagtgccggccgaccagctcaagctgtacacgctgatctggcagcgcacgcttgcctgccagatggcagacgcaaccggttccacggcgaccgtgcgactgtctgcaccgaccgaatcgaatggggaagccatgttccaggcttccggcactgtcatcgaattccccggctttatgaaggcgaccggtgaaggccgccgcgcatccgccgaatcgaagaagggtgatgctgctggaagcgttgaacaggctgcgcaatccggcaaatccagcaaagcggataagaagtcggatgacaatgtgtcgctgccgccgatgaatccgggcgatgcgctcgccgcggtggcggttggtgccgacggacatgaaactcagcctccggcgcgttacaccgaagcgtcgctcgtgaaaacgttggaacagaaggaaatcggccgcccgtccacgtatgcgagcattatttccacgattatcgatcgcgggtacgtgtatgagcgcggtcgtgcgttgattccgtcgtggctcgcgttctccgtggtcaaattgctggaaacgaagttcccgcggtatgtggattacgagttcactgccgatatggaaagcggtcttgaccagatcgcgagtggtcaggagaccggccgcaattggttgacccgcttctatttcggttccggtgagggtgccgcgcagtctgcggacgaggcgcatgccggtttgcagcagcaggtcgcgcagttgggtgaaattgacgctcgcgagatcaatacgattgagatcggcgacggtttgcatgtgcgcgtcggcaggtatggcccgtatctggaggatgtgaaccatctggatgatgagggaaatccgaagcgtgcgtcgctgccggatactctcgctccggatgagctgacggtggaagtcggtcatgatttgatcgagaatcattccggcggtccgcgcgcacttggtgttgatccggtttccgggggcactgttgaagtgcgtaatggccgtttcggcccgtatgttgcgttggtgatgccttctgcggatgctggtgctgacggtgacgtggctggtgatgacaagccgaagaaagtcaagagcgcgaagaaggctgccgatcgcccgaagatggcgtcgttgtttaagacgatgagcccggaatcgttgacgttggatgatgcgttgcgtctgctgagtttgcctcgtgaagttggctcttatgaggaagcgaacgctcagaccggtgaagtgcagacggttgttgtgcaagccaataatggtcgttacggcccgtatttgacgaagactggtgccgatggcaagtcggatacgcgttcgctcgcttcggaagatgagattttcacggttgatttggataaggcgaaggaactgttcgcccagccgaagtatggccgtgggcgcggtcgtggcgctgccaagccgccgctgcgtgaactgggcgtcgatccggaaacgcaaaagcaggtgaccatcaaggaaggcttctacggcgcgtatatcaccgatggtgaaacgaaccgtacgttgccgaagcagtatgctcccgagtcgatcgagccggctgaggcgttccgtctgctggcggagaagcgtgcgcagggtccgtcgaagaggcgtggacgcaagggtgctgctggcaagggtggtgctaagaagactgctgctaagggtgctaaggcttctgctgatcaagttcgtgccgatcgccgtgccaaggtgcgcgagttggccgataagggttgggccaacacccgtatcgccaaggagatcggttccacgccgaccacggtgaaggccgatgtggaatggctcgctgccaacgaaggctacacccgtcccgccgtagttcctgcccggtgatgaatatgcagggcatattcatctcctttgaggacggacagcccggtgggctgttcgtagcagtgagcagcggtagcgttgcgaacgccgcagggtacagtgatgaatatgcagggcatattcatctcctttgaaggcatcgacggcgtcggcaaaaccacgcaggtcgaacgattgcgtgcgtatgttgaggcgcaggggcgcgaatgcgtggtcacgcgcgagccgggcggtactgtgcttggtgtggcgattcgcaagctgctgcttggcggtgtggaaggttccgacgcggatattgctccgcgtgcggaggcgttgctgttcgccgccgaccgtgcccagcatgttgccgaggtgattcgccctgcgctggaacgcggtgccgtggtaattaccgatcggtaccttgattcttctcttgcataccaggctggcggccgcgaattgacggcaggtgaaatccgcgacttaagtatgtgggcaacgttcgagctattgccgaatcgcacgtatctactggatcttgaccctgtgcaatcgcatgcacgactacagcatgatgaagatcgcatggaatctgcgggaaacgatttccaacgtcgtacacgacaggcgtttcttgacttggcaaaggcggaatcgcaacgtttccgcgtgattgatgccagccaatccatcgatgaagtatggtcgcatattcaagacgattttgcacaaatcagccaaacgaaaactttccaatcggaggctgcccagtgagtgtgtgggattcgattgtcggccagcagcgggttgtcgaacaactcaaagccatcgcaagtggcgatccggaagccattgcgcaatcctggctgatctgcggtcctccgggatcgggccgttccaatgtggcgcgcgcgtttgcggcggcgctggagagccccgatcatggtcttggtgacgagccgaccaaaaccgtgcagcaggtgcttgccggcactcatcccgacgtgaccgtgcttgccaccaacaaagtgaccatcggcatcgacgaggtgcgagacatcatcaccacttccgaacagatgccgagcactgcgccgtggcgcatcatcattatcgaagatgtcgatcgcatgctggaacgcaccaccaacgtgctgctcaaggagattgaggagccgagcgcgcacacgatttggctcttgtgcgcgccgagtgcgcaggatgtgttgccgacgattcgctcgcgcactcgcatcgtcaatcttgccgtgccttccacgcaggcagtggccacatttctggaacaaaatggcggatttgagccgaaaatcgcggtgcgtgccgcacgtcttgcggaagggcatatcggcattgcgcgcttgtatgcggagaatgagcaggtgatgtctgaccgtgacgagctgattgtgggtgtgcttggattgcgtcgcgcgtcggatgcggtgctgcttgccggcaatcttatcgacaatgcgaaagtgcaggccgaagcggaggtgaaggtcaaggcggcagaggcggaagctgattttcgtagggtcaatgggcttggggcgaaggatcgtattcctccgaaactgcgtggcgcgtacaatgcgatcgccaaaaaagacgagctgaagcgccaaactacgcgacttacgcgtgatgtgcttgaccgtgcgttgaactcgattgccagtatttaccgtgatgtggctgtgctgcagaacaatgccgaggattcggtggggctgatcaatttggagaatcgttcatcgatcaccgaactgtcggtgcggcttacgcgtgggggagcggtgcggcggctggaggatattgccgttgcgcgtcgccgcctggccggcaatggcaatcccgtactggtcttcgaagccctcttctgctctctcatcgccagttagggctagcggcgttggcacatactgtttttcggcgggcagatttctccagtgagtggaaaaatggttgtttgggtatgattctggcttgctatcgtgcgataactgccggcaaaattgcaaaaattgcgattcagcgctggtagttggtggattcgcgcacgatcagttgcggtgcaagtgagatatgtgcggggctgtcggggccgtcgttgagtaggcgtagcgcttcggagacgatttgtttgaacggcgggcgcacactggtcagtggcggcatggtggtgcgtgcgattggcgaatcgttgtagccaaccaccagcacatcttcaggcacgcgaagcccaagcgaatgcaacgccaccatcacgccgaacgcgatcgcatcgtcggcacacaccacagcctccggttgcacgagcggctcggaaaacagtcgcatggcgcagtcgaatccgcgctgcacgctacggtctccgaacttgttccattcggtttcggtggcaagatggtgcgctcgcatctgagtgtggaacatggtgaatagttccgccgattcgaaggagatttccttgccggccatgtatgccacggatgcgatgccacgttcagccaaatgcccgatcacgatttccatggctgcgttttcgtcgacgctcaccatggatgtgcggaacgagcatcgacggccgcccacctgcacaatcggcaatgtggaggcgtaatgttcaagttcctcggaaaggtaggctccccaggcgggcagtacgatcagcccgtcaacatggcggtccaccaacgattcgatgcgttggatctgcgtggcctgatcgccgccgatgccgagcagcagttgctgcgaatccacgtcgatgacgggttcgatttcgtcaagcagttgcgcgcagaacgggtcggtggcggttggaatcaccagtccgatggtgttggtgacggtgctgcgcaatgcgctcgccgcataattgaccgaatagttgaggtgtgccgcggcggctctcacacgtcgtgcgatgtcgtcgtctttggtgcgttttccggaaagcacgcgggagacggtggcgatggagacgttggccagcgcggcgacgttcgtgattgaactgttcgccgaagtagccgaagccgaggcgttgtcggttgtgcgtgccatgctctcctcccaaaatcattcgaagtattggattattcgaattgctgccgtgtctcaatcgcgtattcaggaataaaacagccacccgtcgaatgcggcaggtggctgaagcaagtatcgcaatcatgcatatggaattgcgatcgcattgcgatttcataactgaagattgttgaatatcttgcgaaatcctcgaaaatcttcagaaaagaagatcactcggcgttgacgaggatgttcagcaggttgtctgccacggtttcgtcgtcggcgccctgcacgtcgatgaccacggaatcgccctgcttgatgcccaggcccatgatggacaggatggagcctgccggaaccgggttgccgccttccttggcgatggtgacggtgcagccggaggcggtgacggcctgggagaactgtgcggccggacgagcgtggataccgacgggatcgttgatgacggtggtgcgggttgccatgatggacactcctttgagtcgttattgttgattgttttctgttgtgttatttgaaagtcgtgctgcttgccgagcgaaatgcatcggtgcgccgctggtgattactatagcactttttccacgaaacgcagaaaacgtttactggttgtgtgttgcggtttaaagcgtgtatactgtgggcaggctgaaaatgatttaccggcaaagacggtggaaatcattgcggtaactcaacgcgcaaggcaggcgcggaaatcacaagaacacgttcggctcgcgttcctttcgcgagcaaacaacaaacgcaaacgacaaaacaaggaaacaggtcaaaggagttcacatgatcatcaagggtgttggcattggtcgcggcgttgcagtcggcccggtcatccgtatggcgcagccgctgccggaaccgtcggacgccccgcgtgcggaaggcattgccgccgaaagcgaaatcgcccgcgtggaaaagtccctcgcactggtgaacgccgacctgaaccgtcgcgccgaagaggccgccaatggtgacgaaggcgccaagcaggccgctccgattctgcaggccatcgccatgttcgcttccgatccgtcgctggctgaatccatcaaggggctgatccagcagggcaagaccgccgaacgcgcggtgctcgaaggcttcgccgcggtggaagacatgttccgcgccatcggtggatatcaggccgagcgcgccgccgatctgcatgatgtcggccagcgcgtgatcgccgaccttatgggcgctcccgcaccgggcctgccgcagagcgaaaccccgttcgtgctcgttgccgaagatctttcccccgccgacaccgcggcgctcgacatgagcaagaccctcgccatcgtcacctcgcagggcggcccgacctcgcacaccgccatcctggcccgtgcccgcggcatcgtggcggttgtttccgcagccgaagccgagaatctgaccgacggcaccaccgtggtcgtcaatgcggccaagggcgaactggtcgtcgacccgaccgaagaggagatcgccgcagccgaagccgccaagtcccgcgcggccgcagccaaggaactgcgcggcaatccgggctccaccaaggacggccacctcattccgctgctcgccaacgtgggcaagccggccgatgcagctaaggcgctggaatatggcgctgaaggcgttggtctgttccgtactgaattcctgttcatcggcaactccgagccgccgaccgtcgaagagcagacccgcgcttacaccgagctgttgagccagttcccgggcaagaaggtcgtgattcgtatgctcgatgccggcgctgacaagccgctgccgttcctcactccggaagacgagccgaatccggctctcggcctgcgcggtctgcgcaccctgcgcgcccacatggacgtgctcgaaggccagctcaaggcgctcgccgcagccgatgccgccaccgacgcgaacctgtgggtcatggccccgatggttgccgaccagcatgaggctgactatttcgtgaagcttggcaagagcttcggtctgaagttcgtgggtgcgatggctgaagtgccgtcgatcgcgcttatggccgataaggtggccgacgtggccgacttcgtgtcgatcggcaccaacgatctgacccagtacacgctggccgccgaccgtacgctcggttccgttgccaactatcagaccgcctggcatccggcggtgctgcgtgccatcaagatgatctgcgacgcgggcaacgccaagggcatgccggtgggcgtgtgcggcgaggccgctgccgatccggacttggccgtagtgctggccggtcttggcgtgaactccctgtccatgactccggtggcactcgacgacgtgcgtgcctcccttgccgaagtcaccttcgaagaggctcaggcccgtgccgaagccgccctcaacggcgacttctaccacccggccaactgagccgtactagctgtgcctatcgcctgtaatgccttgtttttcaagcgatgtgaggtctgataggccctgtttcccggaccgacccctgcccgcgtgccccacaggcccgccgcaggggtcgtttcgttatgtttcgttatgccgtcaattgaaaccttgtatgagtcagacgcttgagggatactgggtgcatgaagatttccgcagatttcaccgtcattcccgacgcgtttgccaaggcggcgccgcctgagaactgcatcgacggtacgccgattgtttccttccccttctacattgatgcgcttgatcctgcagtgcagttcctgcattgggaattcgttgatccggattcaattccggtatgcggtttccagtggaatcattggtccctcgcgaacctgcccgtggatgcgctgatgtacgatttcaacgattctcacgcgctcgcgattccggctgatttctcgcgtacggtttccgcgatgattcctgaaacgattcagggacgcacgtccgccgcctcgccgttgctgcagggccgcagcagtgatcccgcagtgacgatgcgttacaacggtccatatccgccagatcaggatcacgactactatctgcatgtgtggggtaccacggctccgctcgccggcctcaatcagggattctggctcaacgaaatggaacgtgcgctgcgtacttccggtacaatcgttgatcagggcgctattttcctcactggaaaagcctgatttgtgaaagaggatctcaagtaaggccagaaatttgatttccgcagcaatataacgatataaagatgcggaaatcagaaatatatccgacgaaaacgtattgacaataatcgaaaggattactgaataattatggcgtgcaccacgattttggttggcaaagacgcaagttatgacggatcgaccatcatcgcccgtaatgaagatagtgcaaatggtgagttttgcccgaagcgcttcatcgtagtcaagcctgaagatcagccgcacaagtacaagagcgtgctttcgcatgttgaaatcgatcttcctgacaatccgctgcagtatacggctgtgccgaatgccgatctgaaggaaggcatttggggcgaagctggcgtgaacgaagcgaacgttgccatgagcgccaccgaaacgctcaccaccaatgagcgtgtgctcggtgccgatccgttcgtggaactcacgccggccaaaggcaaggaaggcgaagaaggctttgagccggaagtcgccggtggcattggcgaagaggatttccttactctcgtgctgccgtacgtcaccaccgcccgtgagggtgtggaacgtttgggcgctctgcttgaggagtatggcacgtatgagatgaacggcgttgctttctccgacgtcgacgagatctggtggctggaaaccgttggcggccatcattggatcgccaagcgtgtgccggacgaagcgtatgtgaccatgccgaaccagctgggcattgacgaatttgatcttgaagatgcgcttggcgagcaggaggaccacatgtgctccgccgatctggccgagttcatcgaacgcaaccatcttgacctgtcggtggagaattccactccgttcaacccgcgtgacgcgttcggctcccactccgattccgaccacgtgtacaacactccgcgtgcctggtacatgcagcgtttccttaacccgtacgacgagcagtgggatggtcaggatgccgaccacaagccggtttccgacgatattccgtgggctcgccagccggaacgcaaaatcaccatcgaagatgtgaagtatgtgctgagctcccactatcagggcactccgtacgatccgtatggaaagcttggcgaccagcgcacccgccacatgttccgcccgatcggcatcaaccgtcagagccagcttgcggtgatgcagatccgcccgtaccgcccgcaggtgagccgcgcgatccagtggatcgcctatggttccaatccgttcaacacgctcgtgccgttcttcccgaacgtcaactccacgccgaagtatttggaagacaccaccacgcgcgtcacgtccgaaaacttctattgggagaaccgcatcatcgcggccctgtgcgattccagcttcgccgacaccgccaacgccgtggaacgctatcaggagaagaccggcgcgatgggccaccgcatggttgcctctaccgacgagcagatcgaacgtttggtgggtgacgtgaccgacgaattcgatgcggaagacgaaatcggcgatgttcagcctatggaaccggatgcaatcatcgaagccgtgcgcaacggcgaagcccgtgaaatccttgccgcagccaacgagaccatggccgcgcagctcaaggaggaaaccgacaagcttcttgattccgtgctgtacaccgccagcatgaacatgaagaacggcttccacatgtcggacttctaaaatctcactattcggctctcgtgaccacgttgcgggagccaattattttccgcaatgcaacatcgttagaatgacgtgcattccaatttgaagaaaggaaccccagtgaccagcattgaggatttcaccagccagtacggcttggtgcagaagattgatgcgttcggctatctcgattatttgaagaatgatccggatgctccacgcaagcatggcaaggtcgtgctcgtcaccgccgatactccgctgaaggcgtctcgcggcgagggcaagaccaccaccacgatcgcgctgatcgacgcgttgcgtgagcgtggcattgatgcggccgcagtgctccgtcagccgagcatgggcattaccgctgccggttccaagggtggcgcttcgggcggcggcaaggcttccctgacccaccctgagctgatcgactggggtctgtgcggcgaaatgggcgctatcgaagcggcccagaacctgctggtttccttcgctgagaaggccatcgacgacggcaagctcgacgatatcgccgtgccgcgcgtttccgaagtgccgtcccgttcgctgcgtcagatcgcggtggaccgcggcaagggcaatgtggccgagcgtgtggtgctcactccgacctgcgagctcatgcagatcgtggtgctctcccgttccatggatgagatcgccgagcgcgttgccaagatgattgccggcacgaaggacggcaaggccgttacgttcggtgaattcgttgatttgtggcgtattaccggcattctttccgatgcggtgaagccggcgaagacggaaacggtgaatggttctcccgtgtatgtgcacggcggtccgttcgcgaacgtgtcgatcggcattccgacgctggtctccgtggaaatggcgtgcgccctgcatgatgtggtgatcgtcgaggccggttacggtgctgacgcgggcgctcagaagtggcttgacattgcttgccgtgagtatggcgcacagtggccgtccgccgcgattgtggtgacccgcgcttccacctggcgtgacgatccggcgcttgcctggcgttacccgttccacgtgcagcgtttggaaggtcttgatattcctacgttcccgctgattaacctgtgggatggcgaagacgatcaaattccggcgttgcagcagaccgccaaggatctggagttccgcgagccgattatcggcaacctgtatcgcgatggcggcgatgcgctcgccccgcagcttgacgcgttcgttgacgcggtggtgaatggttccatgccggccacgccgcacagccacaagggtatggctctggtggagaacgtgcgttgggttgccgaaaatgcgtatggtgttccggcagatcgcgtgatcctgaaggacggttttgctgaatcgcttaataaggcggtggacctgtgcgccagcgccggtattgatttcggttcgcttgcactggttgcggtgaagtctccggccacgatgactgacaacgattccgctccggctgaagagcgtacggtgacgttgaagaaggttgaagtgcattccggtgccggtttggtgcatgtgaatctcaccgtttcgctgaccacgccgatgccgaagatcgtgtgataaacgagtcgtagcgttctgatcgcaacattttagggcggtcacttgcgtatatgcgtaggtgaccgcctttttgcaccttaatttcggcggtttctagcgaacgtcgcaacgccatgacctcgaaggaacggaggtaacttcgtcagaagttgccgccccgaaccgtgaggcgggaaacacggtgtgtttcccgtaggtgaggtgagaggttcgcaatatgggcgaacctcgaaggaacggaggtaacttcgtcagaagttgccgccgttccagccccagtcggtggtggcggtgtagcggatgtacgtgcggtcggccggaatgcccagttccttctccaatgcggccatgatctgctcggtcagcttctcccaagcggaaccgggcacggaacggccgaacacgttcacttcgacgtatgcggccggcttggaatcgtcaccgccgaaataaatcggcatattgtcttcaaacgggcacatcagccagccttcggacttgccgggaacggcggtgatcgccttgccgtatgcggacttcagcgcctcgcgctgctcgggagtggtggaaacggaaacatgagtgtggatgactggcatgatgctctccttggattgttggaatcagcctttgcgtgttcatctccagtctaggcgtcaaacggctcagacggggtggctgtgtgagaaattttgggctttgtctggatatccgccaaggtggtctgcgtgcgcgtgttaaatattcgttgtgagaaaactgattgaacagcttatgaaatttggcctcgttggcgtgatcgccttcattatcgactggggcattctgaatcttctcgtcggcgtgttccatatgcacaacgtgctcgccgcaaccatctcgttcattatttccctgattttcaactacattgccagcatgaaactggtgttcaagcaccgtgatgacatggcccgttggatggaaatcctcattttcgtggtcggcgcggtcatcggcctgttcatgaacgacgccattatttggatctccacgtatggcatgaaccatgatgcctacgtgtcgcagagcacggaatacctgatccgcaccaacgtcggcaagctcatcgccaccgccgtggtgatggtgtggaacttcctgacacgcaaatggttgctcgacgatacgcataccaacgccatgaaccgtttgcgcaaagccgacaaccgcctcacgccggaagagctggaagccaagtggcagaacagcttctcgcacaggctcggtgtatggtcgctggagcacacccccaacggttggcccaagtagtcctgaattcggaaaatctgtctgcacaacccggaaatctgccctgatcaaatctgccctgattcccgactcgcgcagacggccggacagtcctgcatatgaaaaggcggtgccttacacctataaaggtataaggcaccgccttttcatatgctctgcatgctttacgtgcgaaaggtcacacgcttacggtggtaagcatgggctgctcggtggagtccttgatctgcttgaagccgaacagggcgatcgccagcgaggtgagcgccagagccgtcactacaatgaaaccaccgtgtgatcccatacggtcgatgaactggccggcaatcgccgagccgacggaaccgccgattgagttcatcgcacccatccaggccatgccttcggtgaagcgtgtgggcggcaccaagtgcagcatcagctggttgccgttcacccacgtcggtgcctggcatacgccgatgaacaggtagatgatcatgatcacccacagatgtttggcgaacatgaacgagccgatgcctagatcgaccacggcaaggcagaagtagaaacgcttccacagcggaatcgtccaattcttcgcaccatacacgagcgcgccgatcagcgagctgaacgagaagcaggcgaacacgaaaccggtgtactgcttcatattcgcttccgtggcgaacgcgacgatcgaaatgctggcggccgactggaacgcgcccaaaccgaaccatgtcacacatacagcaatcaggcccggcccccaaatcgactccttgcgcccggcattcacatccgcggcggcctgatccatggcggcctgcacttccgcagccgttttgccttcggaacgtgctcgatcgcgagcgtactcaatggccgcttccgcctgcaacgccttggaacgggcggcttcgcgctcacggtattccttgcgggtcatgcccgcttcgcgagccagctgcgtctgcgatttcggctcggtggaaagctcggtgaggaacatgagcgcgccgaccaccacacacacgccagtgaatgagaatgccaacagcccggaaatcacggccagtgtggaggcgagcggattgccgatcacccacatgcattcgtcgaacacgccggaaagcgaaagcgcgcggttggttttctccatgtcacctttaagcagcgtggtccaacgctgacggctcatcgcgccccacggcggaatcgccgccatgaacggtacgatacagaacagaatccacgacggcactcgggcggtgatgcaggaaaccagtgcggtcgccgcaatcatccacacgatgattgtcggaatcgacacctgacgctggccgaacttgtcaaccagcttgccgagcaccgggctcgcaacggccagcgcgatcgcctgcacggccgtcagcgcgcctgccagcgaataattgccgtaataatgctgcacggaaatcgtaatcgtcatgccgaccatcgggaacggcatgcatgcgatcactgaaccgaccgaaaatcgggcggtgtgcggtatgcgaagaagctccgcgtaccctccgaaaagatgttggccgatgcttttggcgccggcgaggactgaattggtcatgttttgccgctcctttctgctcacggttggtgcttgcgtccgctgcgttgcgttgccgcggaccgcttgatataccctcgttctgtcttgattgtttgctctccagccccagtctctcacttcaaccttgcttgaacgtcaatcgattgacgttcaagcgtgttgcatagggggtggagactggttgtgtgccattttcttgaactagacaactttatgcggaggtactgtcgcaacacgcggtgcattgaggttggcagacataattcgattggctattttgtaagtactcaccacacgttcacttggtggacgaaaagatgtccggcgggcgaaagacggttgttgcaaaatggttgcgcaacgcttccaaagcttgcgattgcagaattttcgttccatcggtcaacgtcagcagtccggcagcatcttgcggaaaggcggtagggatgcccgcaacaaccatccatttcgtacgtcacggcaaagtcgaaaatccagggcatttgctctacgaacgactgcccggattccacctgtcggaagtgggtgtgcgcatggcgcaggcgaccgcgcactacattgccgtcaatccacgactcaacacagtttccgccatctactcgtcgccgctggaacgcacgcgcgaaacggccggcgaaatcctcaccgcactcaacgaagtgcgtgaaacccgtggcgaggagccgctggaactcaccaccgacgagcgcatcatcgaagcgcgcaacgaattccgcggcacgcgcatcggctacggcgaaggcgcactctggaaaaacggcaactggaagctggtacgcaacctgtggaagccaagctggggtgaaagctaccagtcgatcgcgcatcgtgtgcaagcgttcgccctcgaaaaagtgggggagcatcccggcgagcaaatcatcgtagtcagccatgaatcgcccatctggagctacaggcacatgctggaaaccgggcacccggaacataatatgctgctacgccatacggcactcgcctccatcacttccattacgtacgattgcgatacacgcaaagtattgtcgatcgcttacgtcgatcccgcggccgacgtgaaatagcgcataatgcggcatggaatcgccggattggaaacttttgaccgagacacgcgacaatgagtgcggcggttgttgaaagaacggggattccatgcaatcatggaagggctggatgctgttgggtccagtgaggaaaacaaaatgtcgaagctgcaaaggggcacgcatggctttcactatcaacaacggagcgctttatcaattattcgataggcctcatatgaaaattgccatcgaaagctgtgttggagtggtggaattatggccgctgcaaaccgttcaggagatggagaatgacgcaaagtacacggaagatctgcaagtaagattctcctgcaccatggcaagggcaatgctgcgattgtcccacgggattaacccgtccgtggcggaagccgtgtacgagggaatggacgagattccgggttgcgatccggaaattgtgcaagcgctcacgcgggccaatcaggcatacgatgtgatgcgcaattattccgaaaccaacaatgccgacctgttcttcgaagcggccgacattctgggcatcttcatcgacgcccatgtcgagacggaagtccgcaatatactgcaaaagatcgtggagtacattcggcagagcgtcagcctgggcttcgacggcggagcgctggaagatgtcaactactgctacgctttcaccacgaccccaaggacgctcaccgggcgattcctcgcggcgctcgcggtgggtgacggtctgatgaatctcatgtgcgaaggcattgacgatgtggacgaacagaccgtgcgcgtgctgccggtgatgctgtacatcaacgagttgtgcgagcagatggctgttccgccgatctatgtcggcgacgtgaccttgtctcgaatggttgcgctgcgtaatgctgtgcgtgaggcgggcagggcaacgccactcgaggagaattccttctgcgacaacacattcaccataaccgcggacaatgtcattccgtgcgcgggcatggagtgggatcatcatgcggagtgcctgcgttgggatccgaagagggccgagcaggaagccaaagatgaggatgaacgtaagagcaaggaagcgctcgctgaaaagttcaatttgatgacggacgctatgaaaagtatgagctacatggatgattccgatgattcgggtgattcaggcgaaggtgcggatgctgcgtgacgtgggcaatccgggataatccgaattagtgggaattatcgatataggaataagaaaatcccggcacttgcgattgcggtgccgggattttctttatgtagtactgattattgcaagttcggttcttaagttcagtgctgaacctgcatatttcgtcagtgctgtatgttgccgtacacggtaggatcgtcggaatcgtcggaattgtcggatccgtacggggtctggccctgcgaatcgttgccgaacgtggggcgatcgaactgcgtctggtcaagctgggtggactgttccggaaccgtaggcagcggaggcatgctcggcatggaaggggcttcgggtgccggggctgcatgcggagttgccggggcggccggagtgtactgggcggctggagcggctggcatcgcaggtgctgcgtactgatcggtcggagttccgtaaggagcgccatacgggtctgcggtgggcattgccggagtcggcgcaggcattgcaggtgccggagcggctgccgtatacggatcagcggttggcgtcggaacagccgctgcgtacgggtcggtgaccggtgccggagtgccgttcggggcgtattgtgcggttgcggtcggtggcatgcccggggctggggcgtagccgttgccggctgccggatcgtcgaagcgtgcgccggctggatcggtcttcttggccatgagcacaatgagcacgatcgacgtggccaggcatgcgatgaaaccgatgatcaacaggagtatgccggctgtgccagtcgagctcgatccgccaccgattacggaaatggcgccaagtcccgtcatgacgaggccgacgctcagcagaacgccaccgatgaagtcaatcgcgtagaggatgaccagcgtggtgccggccttgttggtgtcgtgcaggcggcgaacggaaagcgcaagggatggaacaatcgttgccagtgcccaaatggtgttgacgaagcttcgcattccattggctgtattgctgtcgatgatggcgcccaacaccgcgaagatgacggcaaacgcgatctggatgatgaatgtgcacagaacccaccaccagaattcgccgcgggaggcgcggcccttgaacgtggcgtactttttccagaagcggatgaacgcctcgccgatggtgcagttgtaggccggctggtcgagcggagcggtcagtgcgaagaagctgccggacccctgtggctgaggttgcggtgcgccgtattgcggctgctgctggttgtatccggccgcattgccgtattgcggtgcgctgtattgaggcgcgccatactggggtgcctgctggccgtagtcgggtgcgccgtattgcggtgcctgctggccgtaatcattctgaccgtaggagccgtaaccgccatattgctgggcctgctgcgggttctgcggattatattggttggggtccgtcattagattaccctttcggaaagtgaatcgacatcaaaaaagtgaagtcgattaacacaatactcttgcatcgccaaaaataccgaaaaatattgcagtgtgggacaatcccgacggaccccgcaaaaatcccctttgacttggggcatcttctgacgcgttggggaagtccgtcgatggcgcggctcatgcccagcatggtgttgtaaggattggtggctgcgatcatcgggtcaattagctgcaggatgttcatgaccgcgaaaagcgagttggtgcgtgggactggatggcacgtccggtttgcggggcacaatggagcttatgactgaagctgaaaacaccaaaccagaacttcctgagcatgttcgcgtgcgtttctgcccgtccccgaccggcattccgcacgtcggcatggtccgtaccgcactgttcaactgggctgaggcccgccacaccaagggcacgttcgtgttccgtattgaagatacggacgctcagcgcgactccgaggaaagctacaaccagatcatcgaagccctgaattggctgggcatcgactgggatgagggcatcaacgtgggcggtcctgacggtccgtaccgccagtccgagcgtggcgacatctacaaggatgtcgcagccaagttgctcgaagccggctatgcgtacgaatccttctccactccggaggaaatcgaagcccgcaacgtggctgcaggccgcccgaaggcattcggctacgatggttacgaccgcaatctcaccgaagaacagaaggccgctttccgtgcggaaggacgtaagccagccctgcgtatccgcatgcccgacgaggatatcgcgttcgacgatctgatccgtggccgcatcgaattcaaggccggttccgtgccggattatgtgatcgtgcgcccgaacggcgatccgctgtacacactgaccaatccagtcgacgacgccatgatgaatatcaacgtggtgctgcgcggtgaggacctgttgagctccaccccgcgtcagatcgtgctctaccgttacctgatcgagctgggcgtggccaaggaaatgccgctgttcggccatatgccttacgtgatgggccagggcaacaagaagctttccaagcgcgatccggaatccaacctgttcctgcatcgcgacaacggcttcattcgcgaaggcctgctgaactacctggcgctgctgggctggtccatcgccgccgaccgcgacgtgttctctatggaagagatgatcgagaagttcgacgtgcgtgacgtcaaggccaatccggctcgtttcgacatcgacaaggccatttccatcaacgccgaacacattcgcatgctcgaaccgcaggacttcctgaaccgtgccgtgccgtatctgaaccgtgacggcgtggtttccgccgattcttgggatgcgctgaccgaccgtgaacgcgaagtgctgtccgcttccgtggatctcgtgcagccgcgcgtgcgcctgttgggtgaggttgcgggcatggtcggctcgctgctctccaccgagggctatatcgagcctgacgacgatgccaagaagcagctgaaggattccgctccagcagtgctcgacgccgccattgccgcactttccgctgtcgatgaagctgattggaagactgacttcctgcacgagacgctgaacaaggcgctgatcgaggatggcggttacaagccgcgtctggcattcggtcctgtgcgtgtggccatgagcggccgtcgcgtgtctccgccgttgttcgaatccatggagatcgtcggcaaggagattgccgtcgctcgcctgcagggtttgcgcgagcacctgtgatgcgctgattcgtgcgtttgcatgactgcataactgttgacccgctggaatgttttgttccagcgggttttgttgttcctgagatgatgctttagaatggcggaaaatagcgcgacacgccgtgacttgcgcacttttgaggattcgcgtatatttatcactcgttgcggttcacggctctgctgagaatcacaacgataatttaagcccccgtcgtctagcggtctaggactacgccctctcacggcgccaacaccggttcaaatccggtcgggggtacgacggacaacttttcggagttgccacgcctgccaaattgggatgtggtgtaattggcaacacagctgattctggttcagccattcttggttcgagtccaggcatcccagccaatgaccctcgcggatgcgagggttttttgtttttcgcaagtaaagtctgtcgctatggcacagtccaagaaaattgcactaccctaggaaatatgactgaattgcagaacgcagcaaaagccgcggccacgcgaccgcgcatccaaccggcggaagaaggcgacgatcgcccgctttccgtatccgcgcgactggggcgactgcaattccaccaatccggcaaattccgtgtgctgcagcttaccgacatccaagacgggccgaaagtcagcaaagacaccgtcaaactcatcgaagcgtcgctggacgccacacggccggacattgttatcttcaccggcaatcagatcgcaggatacgatcccgcatacgcgcaaaccacgcgcaagcgtcgctggagcgcttctgtcggaactgcacgcgagaccgcctcatccaagtcttccgaagcgtcagaacggttcgaagccgcgctggaacgcacccgcgcatccgtgcgcgccaccgtcgaacagctcgtgcgtccgcttgccgaccgcggcattccgtgggcggtgaccttcggcaatcatgattttcagtgcgggttgggcaatgcggaaatcgaaagcatttgcagggaatttcccggatgcctgaatcctgatcctgcgggacgtcaggtggagcaatatttgccaagccaacgcgtgtttgcctgcgagccgggcacattcgcgttgccggtttccgacgtggatcatacgacgtccgtgcttggtctggtattgctggattcaggcgattacgcacgttccggcgggtatggaagcccgtccgcggaggcgttgcgatttcttgccggagtgccggaaatgatggccacgcaatctcagaaacgggtagaatcgcacgaaaccgcgaaatcgcaggaacaggcagtgccgtgcatggtatttcagcattttccggtgcaacagtattaccaactgttgaagccggctgcgacgaatgcggcgcgcgcgatcgaaggctaccgcaatttcgctggaaaacactacgttttggacgaggggaaaacgcttcccggcagttatttaggagagggcatcagctgccccgataccgacagcggcgaatttgcgattttggagcaatgtgggtatttcgcgatttccgcggggcatgatcaccgtaatgcgttcgttggaacggtaccgatttcgcggaattccgctgatgtgcgaatggcgaaggttttgtcgaaggtgattggcgggctgatgatgatcgcgtcgcccaccagcggtttcggatcgtacggtccggtgccgcagaagagggccgcacgtctgattgagttcgacattcgacatccgtacgagcctcgcacacagctattggaatacggcgaattggtgggcaagccgagcgcgggcaaggcgtacgcatacggtatgaccagcgagtcgaagcccgaatccgaaggcgtggacttgctgcataggccaacctggtggagcaagctcctgtcttggctgcgcaagtaaacggcaatcgcggcaaatgaaaaccgcaaacgaaaaaccgtgccttgcatgcgttgcaaagcacggtcgaaaagcttgcgaagctacggtcgtaagatcgtaaccgcctgtcagcggccggaagaagccttaatcagggcgtcagtcaggtatttaccagcggccatgaccagcggggcgtaacggcgtccgggattggaccccatacgaccgtccgggccggaaatcgagatcgcggcaatcacttggccggaagcattgcgaatcggcgcggaaatcgagcatacgccctcatcgcgctcgttcacggattcggcccaaccgcgcttgcgcacggcggtaagcttggccgcggtgaacttggcgtgacgcaacccctgatgcaggcgttcggaatcctcccaagccagcagaatctgggctgcggaaccggcctccatcgacagcattgcaccaaccggaatggaatcgcgcaaaccggatgcgcgctccacagcggcgatgcacacgcgcatatcgccctggcggcggtaaatctgcgcggattcgccggtacgatccagcaaagtctgcaaaatcggcgcggctgcggtcagcaaacgatcttcgccggcggctgcggccaattccgcaaaacgcgagccaagcacgaaacgaccatgctgatcacgcaacacaaaacggtgacgctccaacgcaatcgccagtcgatgcgcggtcggtcgggccaagcccgtcgaggaaaccagctgtccgagcgttgccggaccggattcaagtgcgtcaaggattttgacggtcttgtcaagcacgcccacaccggaatgaatctcgttgctttgagaagacatcgtgcggttggtctcagcttgaagctcagtctcatccgactgcgattcaggcatggcggtgcttgtattcgaagaagtcataagagggattatgccatctcacatattgaaatgcaaaatgtatgcaatgtcgagctgcggtaaagcagaaattttcgaatcttcactcagcaatagaaaagttgggaaaatgctgaattttcaacgattatgttggtgcatacggggagatatgtcgcatttcgcgtgtttttagcgtgaattaacgtgaactcgacgcatacatgatgtgtgtgttgcatgcaagtatctcatataccggcatagacgcgttcgaaccgggctcaaacaccataggcttatagcacgaacaatgcgagttggcaatactcgcgaggaaaaagtgaggaaaaattcgaggaggtcccgcaatgggaacgacattggccgagaaggtctgggccgatcatttggtgcgcaagggtagtgatggggctcccgacttgctgtacattgatttgatgctcatgcacgaagtcaccagtccgcaggcgttcgaaggcttgcgactggccggacgcaagccgcgtcaccttgaccagctgatcgcaacggaagatcacaacactccgactgccgacatcgaccgcccgaatccggataagatctccgcgctgcagctgagcacgctcgaaaagaactgcaaggatttcggcgtacgtctgtgcccgctgggagacgccgatcagggtgtggtgcacgcgttcgcgccggtgctgggcctgacgcagccgggcatgacgatcgtgtgtggcgattcgcacacctccacgcacggcgcgttcggcgccatggccatcggcatcggcacctccgaagtcgagcatgttatggcaacgcagaccctgagcctgaagccgttcaagaccatggccgtgaatatcgaaggtgagctgccgaagggcgtcaccgcaaaagacattattcttgcgattatcgcgaagatcggtaccggtggcggccaggggcacgtcatcgaatatcgcggcgaagccatcaagaaactgtcgatggacgcacgcatgaccatctgcaacatgtcgatcgaagcaggtgcccgcgccggcatgatcgcgccggatgaagtgacgttcgaatacttgaagggccgcccgcacgcgccggaaggtgaaatgtgggacaaggccgtcgaatactggaagacgctgaaaaccgacgatgacgccgtgttcgacaaggaagtgaccatcaaggctgaagacctcgaaccgtacgtgacttggggaaccaatccgggccagggcattaagatctccggcgtggtgccggatccggcctcgttcaacgacgaaaccgagcgcaccgcggccgagcgtgccattgcctacatgggtttgactccgggtacgcccatcaaagacattgccgtggataccgtgttcatcggctcctgcaccaacggacgtcttgaggatctgcgcgtggccgcctccattatgaaggggcatcacaaggccgaaaacattcaccgcgtgctcgtggtgccggcctcctcgcgtgtgcgtctgcaggcggaaaaggaaggactcgacaagatattcaaggacttcggtgccgaatggcgtaacgccggctgctccatgtgcctgggcatgaaccccgacaagatggtggcccgcgaacgttccatttccacgtcgaaccgcaacttcgaaggccgtcagggcaaggggtcgcgcacgcacttggcgtcgccggcagtcgccgcagcaaccgccatccgcggtaccatctcgtctccggccgacctgtgaatccttggaaatcatcggaaaatcttggatttccggcatcctgtgaatcgtaaatcgaaagaaatgttgaaatggaaaaactgactgctcttaccggcgtggccgtaccgcttcgccgctccaacgtcgataccgaccagattattcccgccgtgtttttgaagcgcgtgcagaagtccggttttgacgacgcgctgttctatgcatggcgtcgcgatccggaattcgtgcttaaccagccggaatacaagaaaggcaagattctcgttgccggaccggatttcgggatcggctcttcgcgtgaacatgccgtgtgggcgctgcacgattacggtttccgcgtggtgatttcgtctcgtttcgccgacatcttctacggcaacaccgcgaagaacggcgtgctggctgcgattatgccgcaggaatccgttgagctgctgtggaagctgctcgacgaggagccgggccgtgaaatgaccgtgagcctggaggatcgcacggtgacgtgcggcgatgtgacgctgccattcgaggtaaacgactacacccgttggcgtttgatgaacggctacgacgacatcgatctgacgttgcagtatgaagacgatatcgtggcatacgaaaagatgcgtgccgaaaagttcccgttcaagccgaagacgctgccggtcaagtgcgagccggagcagacgatcgcttctgcgcgcgaaggtgaatacccggattggcagggcccgcttgccgatcgcggcattatctagccgtgtccggcggctggcattgcagtgcactgccagcagggccttgccctagtttcgacggcagccgaaacgagggagcattgagtccgcgcgcagcgcgatccgtaattgcgggacaggcctgttggctgatcgcgactgtagcctaccgcatcattggctatcattctttaagcccggcaaccaagccgggctttttgttcgccatcatcgtctttccgtcaatagcaaattccacaaagcggtggcaaagcgcgtgaaaagcggtggtaaaatcgtattacgacggcaaagcggcggcaaaatgagtgtaaattgcttggtatgtaaggtgatgatggcaatggacggtaatgagcatgacgatgcctggtggtcccgagaggttcctcggatgcgtgaaggtaaccgtttggaagcgaagcgcgccaaaggtgggttgccgcacagtttgtgggaaacatatagttcttttgccaacaccgaaggtgggttgattctgcttggcgtgtccgagcatgaagaccattcgttgtatatcactggagtcgatgacgctcggaaaatggtgcaggatttttggaatacggtgcatgattcttcgaaggtcagtgccgtcgtgctgagcgataacgatgtggtgattcgccatacttcgcagggtgacgtcatttccattgatattccgcgcgcggcaagggaacatcttcccgtatacgtggggtcgaatccgatgaagggttcatatcggcgcaatggtgatggcgattatctgtgtgatgaggaaacggtccatgccatgcttcgggatagtgatttgcttcctttggatagggcaattgtcgaagatatgggcgttgatgcgctgaacgccgatagtgttgcgtcgtatcgtcggcagtttaagagcaggcgttctgaccatccatgggtcgggttgtctgatgaggattttctgcttcgtattgaggcgttgcggcttgatggttcgcaagtccgtcccactagggctggattgttgatgtttggtgaggcgtggcggatcacatccgaattcccctattatttcttggattatcgtgagattatgggcgatcgggaccggtgggatgaccgtttcacctcggaggatggcacttggtcggggaatttgtatgatttttggggaagggtggtcaaccgcctgcggtccgctgtcgctcatccatttcggcttggtgccgatttacatagaatcgatgacaatccgatggacaaagccgttcgtgaggctgttaccaatgcgcttgtccatgctgattatttcgttcgtcggggtacggtgatcattcagtattacgacaggatcgtgctgtcgaatcctggtggattgcgcctttccattgacgaggtggtacagggtggcatttcggatacgcgtaatcctacgttgatgaagatgttcaatctgattggcattggcgagaaggctggcagtggctttgatgtgatgcgtgaaggcagtctgttcgcaggaactgccgatccgaaattggaggtgtttgacaatccggatcgtgtgcagcttacgttgtatccacgtaagtttgtcggaagcgcggaaggttgcatgggtggatattctgttgacacagcgccttccgatacggcgctaagtccggaaaacggttccggtgcggcccataggggtggtacctatgaaaacggacggctggaagatatggttgctgcgtctgatgaagctttgatgtcgtgtaatgccgattttggcgatgtgattagaccgcaaagccagttggagaaaatcacttatgcgctgacggttggcgggccacagcccacatcgtatctggccacagtgctgggtcttggtcttaccagaactcgggagatattagcttcaatggtggatgacggcgtcatcgaaccaataggtgttggccgcggacgcaagtaccgccttaccgggcgagacggttcgcggaaagtcctgattcgttgagctggcttggtctgaacagtccgaaacgatctgtgggaagctgtttcggtgagacagtccgggcgtttggggattatgacgcgttacagtggatacaacatcccgcgcgttcacatcgcacatccaacatgacacgagaacaacttcggagaacactatgagccaaggtttcgcgccgttttatgacgtcaatcgcacgtatgaagacaactatctgcaggggccgttcggcgcattcgctgaagtattgaagagcgatgccgatgccgatgcttccgagcagtccgctcagtcccagccgttcgatcaggctgaggaattccttggcttccgtgtgaacctgccgtttggcattccggcaggcccgctgctgaacgagcgtttcaccacggctgccttccacatgggcttcgatttggccgtgtataagacggttcgctcccgcgcatggggttgcaatgcgttcccgaacgtgcttgccgtgcatccgaggaatgctgacggttcgctggttcccggcagtgccgaacttgacgagggcgtgcttgccgacacccgctatgagcttccgatttcgatttccaacagttttggcgttccctcccgtgatccggacgagtggcagccggatatgcaaaaggcgatcgcggcggccggcgatggccagctgctggtgccgagctttcagggatcccgcgttgaaggcatggatcgcgaggcgtacattgccgatcatgtcaccaccgcgcatttggtagccgaaactggcgctggtctgatggaaatgaacaccagttgcccgaatgaggggcataatcgtctgctgtgccatgatccgcatttggttggcgagattacggaagcggtgaagaacgaaatcggcgatcgtccgctgatcgtgaagctcgcatacattccgaatgataccgatttggagatcatggtgaaggaaactgtaggccatggcgcggtgcagggcttctctacgatcaacacgatttccgcgaaactagtggatgcgaacggcaatcaggcgttgcctggcgcaggccgtgaccgttctggcgtgtgcggcaatgcgattcgtggcgcaggtctcgatatggtcggtcgtttgagcgcgattcgtgagaagctggggcttgattttgcgatcgtcggtgtaggcggtgtgattcgtccggaagattacaaggcgtaccgtgaggctggtgcgaacgcggtgatgagtgccacgggtgccatgtgggacgcgaatctcgcgcgcgaaattaaggagacactgcgctgaattccgttttccgcgaatatgctacatgccttatggcaaactgaaaggcagtgtttctttaaatttgatccgatagcgggtcgaaagaggttgagcgtgtctgacaataacaacgacattctgcacgtcgaaggtggcaagccgctgaacggcaccatcaaggtgcgtggcgcgaagaacttcgtgagcaaggccatggtggcggcgctgctcgccccgggcacgtccgtattgaagaatgttccggagattcgcgacgtgcatgtggtctccgacttgctgcgtctgcatggcgtggacgttacggtggacggcgatcacggcgtggtcacgatcgatgccacgaatgtgcagcttgctgatgtggccgacgtggatacgctgtccggctcgtcgcgcattccgatcctgttctccggcccgctgctgcatcgcttgggcgaggcgtttattccggctctcggcgggtgcaatatcggcggtcgtccgatcgatttccatctggaaacgttgcgcaagttgggcgccaacgtcgataaagaacataaggacggcattcatatcaccgcgccgaacggcctgcatggcgcgaagatccatctgccgtacccgtccgtgggcgctaccgagcagacgctgcttgccgcagtgctcgcggaaggcaaaacggagctttccggcgctgccactgaaccggaaatcatggatttggtgtgcgtgctgcaaaagatgggcgcgattatttccgtggatgtggatcgtacgttccgcatcgagggcgtgaaggaactgaagggctacacacacacttcgctgaccgaccgcatcgaggctgcttcctgggcttccgcggcattggccacgcatggcgacattttcgtcaaaggtgccacgcagcctgaaatgatgacgttcctgaacgtgttccgcaagatcggtggtgagttcgatatcaccgataacggcattcgtttctggcatccgggtggcgatctgaagccggtcgcgattgaaactgacgtgcatccgggcttcatgaccgactggcagcagccgctggtggtggcgttgacgcaggcgaagggcctgtcgatcgtgcacgaaacggtgtatgagaaccgtttcggtttcaccaagccactggtgcagatgggcgccacgattcagctgtatcgcgaatgcctcggatcgctgccatgccgtttccagcagcgcaattacaagcattccgcggttattttcggaccgaccccgctgaccggccgcgatattgatgtgccggatctgcgcggcggtttcagccacctgattgcggcgctcgccgccaaggggccatccaatgtgcagggcatttccctgatcgaccgtggttacgccgacttccgaggcaagctcgaagctctcggcgccgatttcgactgattcgccgtgaacggtcaggattggttgtggctgaccagtcgtggctgatgatttgcgattgaacggtcgtgtcgaacgtctataccgcctttcaccggcactcgcttcacgcgggtgccggttttgttttttccggcgattgctgtggatgtgcgaagtctttctgtggtttgatcttgctgcctcatgttttttctgcatcatttgataagaaaatggggcagaaggcaatgaaaggagaaggtcgacgagctgcagcatcggcttgatgctatgaacgaaaactgatgccgatacggttccatacgtatcggcggccggtggcacaatggagaccatggcatctaaaggaaaaccgtcgccgcgctctgcagtgaagccgctgagcgacgagcaagtcgcaaaactcgcgcagaagcatcatcttgtagacccgacccatgatttcccgaccggcccacgcaaagccaacaccgcggaaatcgaagcgcagaatccaaaagcgacccaccgtctgctcaccggatgcgacatcgtattccgcaatcgcaccaaactcaaggcgtggggcatcgagcatgtgccggaaaccggtccgttcatcaccgcggccacgcacgtcaccatgttcgacgtgttcgtgcccatgatctctatattccaccaaggccgccgcccgcgttatatggccaaagccgaaatggcctcgtggccgctgatcggcaaatggttccagctggtcggcatgcagccggtgcagcgtcgttccggcaaagccaaagctattgaggaaacctccatcgaaatcctcacctccggccgacctttaaccgtatggccggaaggcacggtgacgcgcgacccgcagaaatggccgatgagcatgaaaaacggcgtgggtgtaatcgccctcgaatcctcgcgccgactcggctaccagataccgttgtactgcgcggtaacgtggggtgcggcaagcatcaaccattggtggccgtggccgcgcaagaacgtggtcatgtgctacgacaaggcgcttgattatgcggatctgctcgccgattgcgattcctggggtgaggaagtgccggaagatctcgccaacgaactcacccgacgcatacgcgtgcgcatgaccgaagtcatggccgaaattcgcggcgaacaagcccctgacggatattgggattatcgcacgatgagccgagtgaaggactgaatcgaaaaaggccgaacacgcgattgctgaaatgcagtaatcgaaatactgccagctgaatgcgcgtacgtgtggcgcgtattgcagtatgcatcgcggtgtgcgcagccggcggtagcataggaaaagcaatttttgagccaagactccggctatgaatgatgcccggagcgatgcaaggagcaaatatgacgaacgtgacggtactgggcgcaggagcttggggaaccgctttcggtcaggtgcttgccgacgcaggcaacaatgtgaccatgtgggccatcgaaccggagattgtggaaggcattcgcgaccaccatcataacggtgttcgcctgcctagcgtgaaagtgctgccaagcaacatgaccgccaccggcgaccgtgccgaagccgtggccaacgccgacattgtgatcgtggccattgccgcacagttcgcccgtgtggcgctcgccgaattcaagggcctgattcccgaaaccgcactcgtcgcctcgttgatgaaaggcatagaacgcaccaccgacaagcgcatggatgaagtcgtcatggaaactctcgacctgccggctgaccgcttcgccgcgatttccggaccgaacctgagtaagcagatcgccgaccgtgagccggccgcgaccgtggtcgcctgcgaagatctcgacaatgcgcgcaagatcgcagctgcctgcaccaccgactatttccgtgcgttcgtaacccgcgacgtgatcggcttggaaatgtgcggatcgctgaagaacgtggtcgcgctggccgtgggcatggcccgcggcgccggctacggcgaaaacactgccgccatgatcgaaacccgtggcctagccgaactgactgccctgggcgaggcggcaggcgccgatccgaagacgttcgccggtttggctggcgtaggtgacctgatcgccacctgcggatccccgttgagccgcaactacacgttcggttccaatctgggcaagggcctgagcgttgaggaagctaccaaggtgagcaacggcgtggccgaaggcgtgccgactgccgatgcggtagtggcgctcggcaagcagtatggcgtgcccacgccgcttgccaccgccatgagccacgtgctttccgacggcatctcctgcgcgcaaatgctgtccgaacttttcggcgaaggcatcaacgaagaataagctttccgcaacatcgcaattgcagataagaccgcactttcaggtgcgatttgtatactgaactgcgatattgcgaatgcgtggtatcgcaggcgaacagaagtgcgaaccggcgcgatattgcgaagacagacagtatagacagtattggcagacggtgttgggcgcgtgtgcgttcaacggaccaacttatggagcataagacaaagatggcaaaacagcgcattgtggtgatgtatggcggcaaagccgacgagcattcgatttcctgcatctctgcggcgggcgtgctgcgcgcgttggatactgacaagttcgaagccattgaggtgggaattaccaagaacggcgagtggatcgtagacggcgaggatccacgcaagtggaacatgagcgaaggcctgccgatggtggagaagacggattcctccaaagatgtggtgttggatgtggcgctcggccaggatggtttcttcgctcgtgaagatgacggcacgctgacttcgcttggtcacgtggacgccgtgcttccggtattgcatggtccgtacggtgaggatggcacgattcagggcctgttcgaaatgatgaacgtgccgtacgttggctgcggcgtgctcgcttccgccgcctgcatggacaagcattatacgaaggtattgctggctgcggccggtattcccgtggctcccggcatcacgttggatgtgcgcgattatgatgccgcttccgaattcgccgccgaagcggacgagatgcttgccgcggtgcagcaggccggattgcagtacccgctgttcgtgaagccgtcccgcgccggttccagcttcggcgtgaccaaggtcgaacatgagggcgatgcggccgagcttgccgccgccgtgttcgaagcgtcccaccatgattggcgtgtgctcgtggaacagggcatcgacgcgcgtgaaatcgaatgcgccgtgctctgcccgaaggccggcgaggctccgcaggccagctggccaggcgaaatcgtgcttgacaagcgtgccgagggcgacgaccagttctatgatttcgacagcaagtacgtgaattccgatgcaagccatgtggaagtgcccgcaagcctgccggaagaaactctgaaccgcgtgcgcgaaaccgccaaaaaagcgttcatcgcggtcgatggcgccggcctgagccgcgtcgacaccttcgtgacggccgatggcgaagtgatggtcaacgaaatcaacaccatgccgggcttcaccccgatttccatgtatcccaaggcatgggaggcgaccggcgtgagctacaccgacctgatcaccacgttgatcgaaggcgtgctgcgctgatttcgattgtgtggtggctccgcgtccaatcgccgcgctcgccgtgtgagctgtttcgttgtggacgttcatgacgacggtcatgagattgtaagctgatattcagcattcctgtattaaggtgctgaatatcagcattttcgtatatgcaccccgtgcacgtcgtcgcaaaggcaaatatgacgtttccgcagtacccacaatatccgcagcggccgcaacagcagaatccgcagcagccatcccaatatcagcaatatccgcaacaaccgcagtatccacagccgcaagtcaatccttatgaactttggcttaggcgcgtgaaaagcgtgttctcccgcatcggcgcaggcatgtgcctgatggtggtgatctggtatgcgcttgcgatggtgctttccggcgtgctctatcaggtactgcacgccacgaatctgccgaattgggcggtgtatgtggcgtcggatgcccctttgtatctcgtggccatgccgctcgcggtactgatcatgggcaaatcttcggtcattgaaacacgcaagttcgacatgaagccaggccaattcttcaaactgctggtcatgtgcttcccgctcatgtatgtgggcagtctcatcggcaatatgctggcgtcgctgctttccggaggcaacgccagcaattcggtaagtgatctggctatgcaattcaacgtgtggaacgtggtgttcctcgtgattctcggaccgttgttcgaagaatggatcttccgcaaggaactcatcagccgcacgcgcaaatacggcgaaaaaaccgcgatcgtgttctccgcgctgttctttggcttggtgcacatgaacctgttccagttcttctacgcattcgcattgggtcttgtattcggctacgtgtacgtgcgtaccagcaaactgcgttattcggtggtcatgcacatgttcgtcaacttcatgggcggcgtggccgcgccatgggtgatgacgaacattgacatcgacagtctgatgaacgtgctgaccagtgcggaaaacggcgacggaacagccatgatgcagtggatgggccagaatgcgacgggaatgatgatattcggcatctatatgctgctgtattgcggtctgatcattgcgggtgtggtgctgcttattcgtgaacgtaagaattttgtattctataccgcgccggaagaactgcctcgtggtgttcgcacgagcacagcaatactgaacgtcggtgtaattacttacattgtagtgacggttattattacggcaatcaatctaatgatgtaataatttcagtataaaaaagtgccgcatgtggaatactacatgcggcactttttatacatgggtcaatcgcgatttcttgtgttcacaaggagattacgattccttgttgatggcgcgattctcaagaaaatcagcattggcgatggaacgtgccacggcgttgatcatgtcgggaagcaacgatcccggcttggcgtacgcgcacacttcgacattgatgccgtaaggggagtagccggtcagtctcactttcggggggaagcgcggatcggccaaatcggcggtgtcgcgctgcacggcctgaaccacctgacgggtcatctcgtcgatgtcggtaccggccttggcggtaaacggcacacgaaccagcatctcattggacggattgagtttttccagtgacgcggtgttcagaatcgaattcggaatgatcttgacgttgccattgcgctcgcgcaccacggtctgacgccagttgatgtcttcgaccacgccatcggtgcccgccacattcaccagatcgcccggctggattacacggccaagcatcagaccgaaaccgccgatgatgttcgcgatcgtatctttcataccgagcgacaccgcaagaccaccaatgccgagcgcggtgaaaatcgtggtcggattaatgccgaacaccggctgcagcacagtgcccacagccaacgtccacaccaccgcgcgcagaatattgatgaaaatcgaagcgttcggcacttgcgaacggtccagcactttgctcacgattcgggtaagcgccttgtcgataacggccgcaagcagtgcaacgacaatgagcagaatgatttttccggaattggttttcagccaatccacaacgattccaatcggttccatagtgttctgaagcgtcccttcataagtttgattcgcatgcattactggtgcgcgcgacttgcgttcgctgcgtctgcgatgcgtgttcgagatgcgtgttcgcaacttgtgttcgcacatatcctacagtgcgtggctgagtcggtttgagcgtgggtgtgcgggggcgtgcgcgagaacatgtgggaatgcgcgtggtgacatgtgtccggagccgtgaacggactaaagttgaggcatgggcaatgttgtggattatgtgcgccgcgagttccgcgggtttggcgaattggcgttcagcaatgtcgattccttggtgctttccgagctttcctacatgcgattgccgggcttggttccagcattcggcgaggccaagtcggtggcgaccgtgccgatccgtgacttgctgcgcgccgaaagctacgatgagatgtttgtttcgaattcctctgaaatgaatgattatcggctttcgttgctgcgcgcggtttgcgaatcgccgcgattccgcgggttgcgggtgggggagtatgacgaacgtttggatgagggcgagcagcagcaattcgctgcgatgaccttcgatttgggtgccgatttcggcttatatgttgcgttccgtggcactgacggcacgctcgtcggttggaaagaggattttaatatggcggtgcgctgcccagtgccgtcgcaagaatcggcatatcgatatgcggactcgattctggacaggacggaacgtttcctctcggcgaaaaaatcacccgacattatgatcggcgggcattccaaaggcggcaatatggcggtatatgcggccatgcaaatcacgcaaagcgatattgaagcgaccaacgaacgcgcgcaacggctcggactgctgccggcgctcggaggaagcgtgccgggacgcaactgcagaatctcccgcatcttctcgcatgacggtcctggaatgtctcaagtcatggtgcatagccgcgcatatcaggcaatcgcggcacgaatcgacaaaaccgtgccggaatcctccattatcggcatgctgttgcaatcgcaaatcaaaccaaccttcgtcaaagccgacgccataagcattctgcagcatatgggatcaagctggcaagtgacgcaatccggcgaattcgagcgggcaagcgagctgacaggcggtgcgcaactcatcggcaaaaccattgacggatggttcgaccgcgtaagccaggaacaacgcgaacgggccatcaaccagatatacgacatcttcgcagccgcggggtacggtaatatcgctgatctggtggcgaattggacggattcgctgccgaaaatcgtggcagccgccagaggtaccgacgtgcaaacgcgcgaactcatcaaagacgtgttcaaggcgattccagccagtgcggcgaaagtcgctgtcggggaactgcgcaacgacaaggagggggatgcgtgatgggcaatattattgactatgcgcgcacggaaacgcgcagtttcgaggcattgccgttccgtgaggctgacgcattggtgttggcgcagctttcgtacgacgaagtaccggaatgcgtgctgcgattggacgatttggtagcgaaatacggtacgttgcaggcgcgtgcgaagcaattcgatattcggcgtccgattgcatcgttgcgtatgctgcgcaagcccccgtttggcggcgtgacgattgcgcgtgccgatgacgagctgaaccacgacaagcccgtggccgaccatgatgtggagaacgtgggattggtcgatccgcaggtgacgcacgacttctaccatgctgtggcggcgaatccgcggttttccgacgttgagatgagcgcgtattgcgagcagttcgatggtggtgcgcaaacgcagttcgcggcagtgactttccggctgccgtcgggaacgctggttgtggcgtttcggggtactgatgattcgctggtcggatggaaggaagacttcaacatggccttccaatacccggttccagcacaggtttccgcagctgaatacctgaaaaaagtcgcctcgctgtgggatgggccgatactgctgaccggtcactccaaaggtggtaatctggccgtatatgcggccatgaacgccgaagacgagatcaaggaccgcgttgaacgcatttactcgctcgacgggccgggtttccccgaagaagtggtgaaaagtttcgaatatgcgagcgtgagcgaccgcattgtgaaaatcgtgccggactcctcggtggtgggcatggtgtttgaaacccccgaacgttgcgtggtggtgaaatccgacgtggacggcatcatgcagcatttcgccttctcgtggcagatgcacgggggtgaattcgccaaggccgaagatgtggccgacagttcggtggtgttcaacaagtcgctgaacggctggcttgcgggactttccaaagaacagcgtgagcatgcggtcgacgcgctgttctccgtgcttgaggcttccggtgcgggcagtatttctgcgatcgtggcggccggtccgaaagtgattcctgaaatgctcggcacatatgttggcttgagcagtgcggatcggcacaacatcaatcaggcgctggtgattctgttgcaggcggcgctcgcgcgcaatccgaaagttcagcgaaagtgaagcgcgaatgaggcgtgagcactgtgcgaacgtgggcgagcactgtgcacgtagcgtacttgtgttgtaagcgtgaactcgtatacgacatttgtcgaaattcggtctagacaacttgtacaataaatgtggttataaggcagtgtgactaattatcagggggtactgatgccacgaccacgcagagattcagaaatcctgccagcgaaagaacgtctcgaaaacgcattctgggagctactttcggaacgtgagtacaacaaaatcactgtcaccgacatcgttcgcacggcagacgtgaatcgcaattccttctactaccatttctccgggctgccagaattggccgattccgccattctgcacgccgtcgaaaacacgccaatgccgggtatgccagggcgggattttgatcccgacaccgaatggcgcaagcatgtcaccgcgctgctgcgtgaccccgaacagcgccagcgcctcgaccgactggcattgctggccggcccgcacagctcaccggaactcgtctcgtcactcaaggaattcgggcgactcaccatgatttccgtacttggactgaacgccgacaacctcgatctgaaaaccgatctcatgcttgacttcacagtcggcggaatgctttccgtactgcagcgctggccgaaactgcatgagaaactgccgatcgacaccgtattcaacgaggacgtcgccgtgcttgcggcgggcatgttcatgtcgatgtcgaaagcagacatgctcgaatattggcgcaggatcttcagcgaaggattcgtacctggcatagcaatttcgcaacagcagccgccgtctgccaagtgaccatcgaaagccggctgggacaatccggtggtaaaaacaatatagcggcgtttttccgcggattgccctgcgaaaaacgcaaatgtgcgaacatgcgaacatgcgtggcagcgcgaacgtgcgaaagcgcgaaatgaacgaacgacggggaggttgtccatgatcaacgaagcttacaaagccatgctcggcggaaaatccgtaatccgcgagctgagtgaatatgcgaccgcgcgcggcgccgaaatcggctatgagaacgtgttcgactattcgctgggtaatccgagcgtgccctgtccgcaaagcttcaccgacgagatgatcgccctgtaccaggagtcggaaccggtcgcattgcacggatactcgccgtcgctgggcattgcctcggtgcgtgcggccattgcagaaagcctcagccgtcgtttcgacatggactacacggccgactacatcttcccgactacgggagcagccggcgcgctggcccacgcactgcgcgtggtgaccaagccgggagacgaagtcattacgtttgccccctacttccctgagtaccagccatacgtcaacggaaccggcgcgcacctgaccgtggtgccagccgataccgaaagcttccaaatcaacttcgaagcgtttgaacaggtgttgaacccgggtaccgccgcggtgctcatcaacacgccgaacaatccttctggagccgtctactccgccgaaacgctgacgcgactggcagaaatcctgcgcgccaagcaggctgaatacggccatgacatcttcttgatctccgacgaaccataccgcgaaatcgtattcgacgggggtgtgcagccgtatccgagcaagttctacgacaatacgctctcgtgctactcgtactccaagtcgctgtcgttgccgggagagcgcatcggctatgtggcggtgaatccgcgtgccaccgatgccgagctgattgtgccgatgtgcgggcaggtcagccgtgaaaccggacacaactgcccaggatccagcgtgcagctggccgtggccaaggtggtggacgagaccagcgatctttccgtatacgaaaagaacatgaacctcctgtacgacgcgctggtgaggctcggattcgacgtggtgcgcccgggcggtacgttctacatcttcccgaaggcgctagaagatgatgcgaacgcgttctgcatgaaagccaaggactacgacctgattctcgtgccgtccgacagtttcggcgtgcccggctacttccgtatggcctactgcatcgacacggaaaaggtggaacgctccatcaaggcacttgaaaagttcgtgcacgaagtctatggccgttgaaaaagtcgtttgcgctatatgtggcaggtttatgcggaaaacgacggttagaggggataaaacttgctccctaagtgacgtttggcctagtaggtctgccacatataacgaatattatttttcctgagagggggaatctgccacatataacgaatatcgttttttgatgtgtgcggatatgggttcgcccgaaatccggtgggggcgggagaccgggcgaaatctacgaaacgaggtgctggtcggcgcgtggtacgtggcgctcgccgaccataacgcaatcagtgcgtggcaatttcgtcaatcttggtgacgtggccgccgaactgggcgcgcatcgtggacacgacgcgcaggatgtcgtcggcaccgccgcgtgaagtctgacgtgcgtacagtgcggccgcggtggcgggggttggtacgcccagttcgagagccgcttcgatcatccactttgcctcgccggattcgttggccaccggcggcatggactggagtgtcggatccgacttgaacgcgatggccagcagatcgagcagccaggactgcactacggaaccatccttccaagagctcatcacggccgctggatcctcgacgagatcagacttcaccatggtggcgaagccctcgccgaaggcctgcatcataccgtattcgatgccgttgtgcaccatcttggcgaagtggccgccgcccaccgggccggccaacaccaggccggaatcgccttccggcttgagtgcttcgaaaatcggacgcgcggtctcgaaatcatccttgttaccgccgaccatgagcgcgtagccacggttaatgccccaaacgccaccggaaacaccgcaatccatgaagtggatgcccttcggctccagttcggccgcgtggcggacgtcatcggtgtaacgggagttgccgccgtcgatgatcatgtcgccaggctccagcagctcggcaagctcgttgatggtgctgtcggtcggctctccagccggaaccatgacccacgccagacgtggcgtcttcagggctgccaccatttcctcaaggctcgacacggtgcgatccaactcgggggaacggtcgaagccgaccacttcatgtcctgcggccgcgatgcgcttcgccatattgccacccatacgtcccagaccgatcattcccaactgcatgatgtgcttctttctttgaaaaatgtgtgcgattgataagtattggtgccatccgtcggcttcccgcgccttccgcaacgcagaaaagaaggttgcggaaagcttcgtggacggcaagatttggttatgtgattgcgattgcgtggcgattgcgtaagccgcggcctacgcaatcgcggattaatatgtcgatatgtggtttgctcttgagttctgtcaaagcaccagcgagagcagcatgacgcagcccaagccgaccaccgacaggatggtttccatcagcgaccaagtcttcagcgtctggcccacggtcatgccgaagtattccttgaccagccagaagccggcgtcattcaggtgcgagaagaacacggatcctgcgccgatggcgagcaccagcagcgccaggtgggtcgggttcatgccggtggcgagcggcaccataatgccggaagcggtgacggtggccacggttgccgaaccggtggcgaggcggatgagcacggccaccagccagcctgcgatcagcgggttcatggcggattcggtgatcgaattggcgatcacgtcgccgatgccggaatcgaccagcgtctgcttgaagccaccgcctgcggcgacgatcagaataatgcctgccacggagccgaaggactgtccgaccatgccgttgacggcgtcacgggagaacttctgcaggtagccgagggcgaccatggcgaagacggtggtgataagcagcgccacgagcggggtgcccaggaacgcgatcacgcggccccatgtggtggtgttctgcccggtcaggtcgacgatggatgcagcgagcatcagtaccaccggcagcaggatcacggacagggccgtggtgaaggacgggcggttttccgcggattttggcgcttcggcctcagccttgttttccggagcggcgattggtacccacttggctgcgagtttgctgaagatcgggccggagatgattacggttgggatggctacgagcaggccgagtgccaaggtgatgccaaggtttgcgttcagtgcgccgattgcggtgagcgggccggggtgcggcggcacgaacgcgtgcagggtggaaagacctgcgagggccggaatgcccagcagtacaaccggagctttggcgcggcgggctgcgaagagcaccaccggaataagaatgaccacgccgacttcgaagaacatgggaatgccgacgatgaacgcgattagtgccattgcccacggcaggcgttgcaacggtgttttggccatgatggtgtcgacgatggtgtcggctccgcccgacttgaacaggatcgtgccaatgatcgagccaaacgcgatgagcagaccgacattggcgatggtggagccgacgccggaggtgaagctgccgaacgccttgtcgtattccacgcctgcacatacggccatcgtgaatgagccggcaagcaaggagaggaacggatgcactttgcataccgcgataagtaggacgatgatggcgatgccgatgatcgccgctgcaatgaggttcatgaatcctcctcgattcatgggtttggcgtgctagatttgtccgattctggagattcggacattcatgtaccggttttggtgtttggatgtccgtttctggtgaatcggacacatttggaccgggggatggcgggttaggcggcctgggctgcggtctgggctgccacggttgcggccacggttgctgcataggcgttcagcgcttcgatggcacggtcgaccatttcgtcgacgctgccttcgatggagatttccacgccgttctcttcgggagcaagcggctcaagaatggcgaactggcttggcagtagtgcgggcggcatgaaatggcccttgcgttcgctgagtctctgctgaatgagctcgtggctgccgttgaggtgaatgaagaatgtgggcacgtccttggcgagcacctcgcggtagctgcgcttcaacgcggagctggacaccacggtgttttcgccgagcgcctcacgtgccaccatccaggagttgatgacgttcagccacggccagcggtcctcatcggtgagtggaatgccggctgacattttgtcgatattcgcctgtgggtggaagtcgtcgccttccgcgtacgcgtatccaagtcgttcatggatggcttctgcgacggtggatttgccacatcctgcaacgcccatcaccactacgtgaatgctcatgttgctctccttgctgttgacgatcctgtgccgcttcgcatcaggaataagactactataaaccgtaaaagtagtatcagtcaaataaaaagtactacgaattggaaaaatcgtgtgacttgctatgctggagatagtgcaaaatggcggtaaatcacgcaatcgcggatacgcaatcatctgtgatttgtgattgccgcgcatgccacagaatacgtgaaacataccgtgaaacaaagcaggcatgttgtggagtgggtaagggaggagcgatcgatggctgaaggcacggtaatcgcagaaaataccggcggtgagctgatgcaggattcggtgagtcgaacgctcgccatcgaaatgctcgacggcgagtggaaggctggcgaaagccttacgttggaagccttgcaaagtcgtttcggtatttcccgaaccgtggcgcgagaagtcgcgaaaacactggaatccatgaatgcggtacttgtcaaacgtcgcatcggacttgtcgcacgcccattcggcgaatggcaggcgctcaaccatcaggtgatcgaatggcgtctccactccacgcaacgcgagcagcagctgtcgtccctcaccgaactgcggctagcggtcgaaccggctgcggcagcttccgccgcgcgtcttgcccccatcgacgtcaaggcgaaattccctgtgtacgcggcgcaaatgcggcagatcgccgaagccaacgaggagggcgaagccgggctcgcacaattccatgatctcgacgtggaattccatacgctgatcctgcatgaaagcggcaacgagctgttcgccgcgctttccgacaccattgccaccgtgctgcgcgggcgcgtggaactcggcaaatacccgatgaagccgaagcccgacgcgcttgacgcgcatgatgccgtagccgacgcgatcgccaagggagagcctgaacgtgcgcgcagcgccatgctcgacatcgtcgacgaagtggcacgtgccctcaatttcttctgattttcgaatcaacattgcgtttcttcgcagactctgaagaagaatgcaattgcgattactacgcggctgactcttgccatgcatgacttttcagatgtaagttgacatcggaaatacggcatcacctaggaatgcgcacgcagaatcaattggttgtggcgattgaatctacatgcgcatttagtagacaagtactacttacgggtggggtctttttgcaggagaaggaagatgagggcgacgatcagcaggattgcgattgaaagcacgcctaccgaagcgttgccggtcagcgacgtggtggtcgcaacgaggaaggtgccgataatcgaagcggttttgccgaaaatatcgtagaaaccgtagtattcgttggcacgattctttggaatgatcttgccataatacgagcgcgacaacgcctgaataccgccttggaacaagccgacaagaatcgcaagaatccagaattccgtagcggaacgcaagaagaacgcggcgaacagcacaatgcagatataagcgatcacagcggtggtgatcatggtttttgcgccaaaacgcccagccagtttgccgtacgcgatcgcgctcgggaatgccacgaactgcgtgatcagcagcgccattaccagatgcgtggagtcgatgcccaactgcgtgccgtatgaggtgctcatggaaatcaccgtgttgaccgcgtcaatatagaagaagaacgcgatcatgaacatccacagcggcttgttcttgcggattgcgcgaaaagtggagccgagctctgcgaacgtaccgcggatggcctcgccggtctgacctgcggtagcgcggtaatgcacttgcttatagctggtgagcagcggaatggtgaacgcaacccaccacaatgcggtgattacgaacgaagcgcgcgtgcatgccaccgtggaccatccgaacaacgacggaccgccgaaaatcagcgcaatacaagcgatgaacggaatcgtggagccaatatagccccatgcaaaaccatgtgaagatacgcggtccatacgctcattcgacgtgatatcgaccagcatggaatcgtagaacgtgagcgaaccgttcaggccgaccgtggcgagaatgcacaccaccaagaaaatgagccagctgagcggcagcgccatcgcacagcaggcgaccacgcccgtcaagaagaatccggtgaagaacttcaccttcatgctctgcacgtcggccatggacccgagcacgggcatcatcaccgcgatgatcagcgatgcgatggtctgcgcgtacccccatgtcgacacgatattcgattggccggcggactgcagtaacgagtttgcgtagattggtacgacggcggtcgacagcatcacgaatgcggaattgccgacatcgtagacgatccactttttttcgcgggtggttagttttgcgttgggttccggcagattttctgctgatgctgcggatgctgcagaagctacgggcgcggaagttgcggcaggcgcagttgttggcgctgttgcgcgttcagacatgattgttgactctttcgaataaaccgtcaattcactgttgtatacactacagttcatcttaaatggatgtaagggatgcgctctgccgttacgtatgaacaatgcatgaacattgcgactgatgtgtgattgatgttcagttttttgaacaagcgccatgattccggggaatccaaggcgatttctatccacaggtttgcaatctggtttgcgattggctggggctggttgtatagttgagaagttgtgtgttctgccgtgcattcagttgcatggcgtcgaacgcgcagacttgcaagtcagtagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtcaagtgcatcaaggctggcaaggttcagcgcgttgaagcgtgaatcgcgaaataacagcttgaaaccccggtagaccgctggtcgccggggttttgctttatgcgcccaggtcttgagcgtccggattgttccagtgggtggggaattttgcccgctgaagccgcatctgtcggcataaatggggagaatggtgcgttatgagcaccacactggaaacaccgatttcatcaattgaaagcaaccgccgcagggttggcgcgctgaaatcgcttggcgtggtgtccgtaggcgacgccctgacctactatccgttccgcgtaaccgaccccgttccagcacacgcactgcacgaggcgaaaatcggggagaaaatggcattcgccgcgcacgtgctcgaaacgcgcgttttccccatggcccgtcgtggcttccgtctgatcgcaacagtcaccgacgatgatttcgcagcccgtcgcaacaccccaaaatcgttggcgtcgctggttttcttctcatatcgcaaatcgtatgtcgactgggtgcagcgcaaattgcacatgggagcgctgctggtcgtcgcaggcgagccaagcgtgtatgacaatcgtttgcaattcacacatcccgacctgcttaccatcaatcccgtgcaatcgcaagcagaaagcggggaatggaatgacggtttcggcgatcctgcaaatccacctcttggtaatctgaaatacgatgcgcaaacggttgatgaagcattgaaacgagtctgccgtccgcgaccggtatatcatgcgaattccaggatttccagcgaacatattcacgaatcggtattgaaatacatggatgcgttgcgaggaagcgagtatttgccatcgcaaacgccaaataattcctcggataatatcgcacaagaaggggagtttgacgctcctcaagtagatcgtgaagcgcagattaaatcgttgtctgttgctattcccgacattattccggaagattttcgtgagaaatatgggcttatgcatcgcgctgaagcattcatggcgattcatgatccggtcgatcgcaagaatttcgacaacgccctgcaaacgttgcgatacgaggaagcgctgatctgccagaccgcactcgtcaaaacacgcgacgcatcacgcaaaaacaaggcgaccgcatgttccgtaacgcggttgaaagacgatttcattgcctcgctgccgtttgctctgacgagcggtcaaaggcaggttattgccgatatttccgccgatatgacgcgcgattaccccatgcaacgattgctgcagggcgaggttggatccggcaaaaccgtggtcgcgatcgcagccatgatgcaggctgtgggatcaggcgggcaggccgtgcttgtagcgccaacgcaggttcttgccgaacagcattatgcgagcatttccaaaatggtggcgaaattgacggatacagacgataaaacggcttccgcaatccagggaaattctgcgtcaactcaagtgtcgaaagtccaacaaactggggaatccacacaacaaactatcaacaataatgctgtggataaaggtgcacaacttgtcgacctgtttgacatagccgaaatttccaatgtggataactcaaataacgacgattcgattacattacgaagtgagcaatcgcatatttctgatgcaaaaaaagcgagtattccaagcaaagggaacgatatattcggcacaaaagatggggagattcccgtatttcttcttacgggaggcatgcgacttgccgaacgccgccgcatactcgccgcagccgcatcaggcatgccttgcatcgtcgtggcgacgcacgccgcattttccaagagtttccaggcgccgaacctcacactggcggtaatcgacgaacagcatcgcttcggtgtggagcaacgcgaatcgttgaattccaagggagctactgcgccgcatctgctggtcatgacggccacgccgattccgcgcaccgcagccatgacctggtttggcgatcttgatatttccgcgctgaccgaacttcctggcggccgcaagccaattcgtacattcgtggtgccggaaagcaatgcgtcgctgatgagcgaaatgttcgccctgatccgtaaacgcattgatgcgggggaactagcctacgtggtctgcccgcgtatcgacgacgattccgagaatgcggacgacgtgttggcggagtcggctatttcaaactcgaaaaccacgggctcgccgattcccgcctttgatgaagcatacgatcttggcgaagacgacgaacagcgcgcgcaacgtcccccgttgcattccgtcgcagaaatcgtggagcgtctgcaatcgttgccgcaatttaaaggcattcgcttcgcaacattgactgggcgcgacgatgacaccacaaaatcgcaggttatggccgattttgaagccggtataacgccgattctggtggcgaccacggtaattgaggtcggcgtggacgttgcgaaagccagttgcatcgtgattttcgacgcggatcggtacggactttcgcaattgcaccagttgcgagggcgcgttggccgtggcggcactgattcgggggctttcctgatttcgcgtgcacctgcggacagtgatgccgcccgccgtcttgacgtgattcagggcacgttggatggtgccgaaatcgcgcaggccgatttggaattccgtggagccggcgacgtgctcggagatgcgcaatccggcggaaaaacgggattgaagctgctgcgcgtggtcaaggatgtgaagatcatcgaacaggcacgggccgaggccacgcagcttgttgcggccgatcccgatttgcttggattcgtgcagttggctggagcggtattggatttcacgcgcggcaacgaaatgttcctgaccagcaattagtttggcacgcctaaaagagccggacacacctaaattaagcccgccacgctagagtagtgcgtatgcgcgtaatttcaggacgattcaaaggtgtggcattgaccacgccgaagtcgggtacccgaccgactacagatcgcaccaaagaggcgattttctcgcatctcgattcatggggagtgttggacgatgcccgcgtgctcgatttgtttgcaggaaccggcgctttgggcatcgaagcattgagccgtggcgcacgagagctggtggcggtggaatcatccgctccggcggccgcattgatcgcgcagacgctgaccgcgttgaaacataaccgttcgtgggaacatggcatgagtgcccgcgtggtgaaggcgcgcgcggaaaaatacgcggcttcagcttcggccgttgaaccgttcgacatggtgttcatcgacccgccgtacgccttcgaaacgaatgattgcaaccagctgctcgccgatcttgccagccgtgaactgacttccagcaacacggtgatcatgctggaacgatccacccgttccgaagagcccacggctccagaaaactgggaaatcaccgatcggcgcgattatggcgaaaccgccgtctactacattgaacccagcgagccaatctcagataacggtcagcaataatcgcaagaaaaaacttgcgattattccgcgtaaaaacaagcgtttaaaagctagcgtttgcgcggatgggcggcggaaacctcccaaccgagcgccatcaaggtcttgcgatcggctttgtcgagcttggcgcaatccaacgcttcgatcaggtcgggacgcaactcattggttttctcgagcgcctcatcgcggcggaaacgatccactttcgcatgattgccggaaagcagcacgtccggaaccttgatgccacgccattctgcgggcttcgtgtactggcggtgctccaacagcgcattatcgcccgtatacgattcctcaacaatcgattctgcattacccataaaaccgggcagcagtcgcgtaattgcctccaacatgaccgaaaccgcgacctcaccgccgttcaacacataatcgccgatcgaatattcacgcacgtcaatgccttgcgcgcggtaatactgcggaatgcgagcgtcatacccctcgtaacggccgcagccgaacagcagatgatcggcatggcttagttccgtcgcatcctgttgtgtgaacagtggggcggaaggattcgggaaaatcagcacaggacctgcggacgattgtgcagtgtcagttttttcggaattgccggattctgcgggaactgcaacagttgcagaattgccaggatcgcaagtatcgcaggaatctgcggaatcctcaatattttccattttttccgtattttcgattgtagtcggctgaagctgcagcagctcgtcaaggcattcgctccacacttccggcttcatcaccatgcccgcgcctccgccgacaggagtgtcatcgacggaatgatgcacgtcgtgcgtccagtcgcgcagattgtgcgcggtcacttccacgagacctttcgtctgcgctttgccgagcagactgaggttcagcacttcgaaatattccgggaaaacagacacgatatcgatcttcataatgttcagaataccgggatgtctgccaagtgacggaaaacgtaaaggtgggcactggaaatccaagcccaccttgagatagatatgtgatcgcaaacgatcacagacccggaataagacctccaggcggatcgagggtcagatagccctcttcgaggtcgatgtccggcacgagctcgtccacgaatggcacaagcgcgctgttctcaaccacaacgccgtcggcatccttcaccggattggcgagacgaatcttcagcagccattgggccacttctatcacgtcaacgactttgccgaccaccacgcccggttcgagaccaagcatattgtcttcagccagtcgcgcctcaagaccgatgaggtctttcggataccattcgtcggcttcaagcatgtcttccggatcgtccgcctcgccatacagcacaatgccgttggccgcttcggactggtcgcggttgtcaatgccttcgaacttgatgatccaacggtttttgaaggtacgggagttctccaccacatactcttcttcgccgtctttcgtgtacaacacagcaccgggagcgaaccggtattccggttcgtccgtaaagatctgcacggtgacttcgcctttgagcccctgcgcacgcccgatacgacagaccctcagcagctcgggctgttgagggtcgtcagaatgcatatcacgcaccacgctaggatctcacctgcgcacgtccatgatgtcgacgcgcaccttgtggtcggacagtgcctgcaccacggcgcgaatcgcatttgccgtgcgtccgctgcgtccgatgacgcgaccgatgtcttccgggttgacgcgcacgcgaatgagttcgccacgcgcgttctcatgggacttcaccgaaacgtcgtcgggaaaatcgacgatgttcttaatcagatgttccacagcctgggcgagcatgatcactcagcttccgcagccggctcttcagccggagcttcctcggtagcggcggcttcggcttcagccttggccttggcgtcagcttcggactttgcagccttcagcttctgagcctgagcctcaacggcctcaacgcgagcggcggcatccgggccagcttcaacggtcttcagggtgccttcagcaccgtcaaggcccttgaacttctgccagtcaccggtgatcttcagcaggttcagcacctgctcggtcggctgagcgccaacgccgagccagtactgagcgcgctcggaatcgataacgatggtcgaaggctgggtgttcggattgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtataactaggggtgtgcgtttcgttttctgtgtggggcacggaatccgaaacccacatgttcctcacgtcacgcgatagttagagggcctcgcgcgcgcgaataacttaccaagtataaccgtggggtacggacggatgggtcttaggatgtttcccgctctatgcgactttccgaatccgtgcaaaaccgggaagtcgtttgtctgattctgcggaaacggtcaattatgcggcgaatatgatgccttgaatgaccgaatcggcagaatcggacatttgctggcattcgtgagatgtttgcgtgggtctacatggcggaatcgtcggaatcaggcaggctggctacacttggaggttccgagtttgcgtatgtccgttcggagtgaacggtttgcatagggggagttgcctgaatgattatcgcgctttggattgcgttgattatttgcgttgtatggattgcgcttggcgagatgccggctggttgggatggccatttgccgctgccgtacttgattgcgttgattccgttgctgtggattccgacgcttgcgatcgccgtcgccggtttcgcgttgcatgagccggctctcgggggagtcgctgcggtggtctgtcttgcgtcgctgctacgcaaaatcgcatattggatggaaaatcttaattctcccaatactgcgcagagggttgccgaaaaacttgcggaaaagcgtgaaacatctcgtgaaacaggcaatgaagctgttacggaatccgcgaaacatggccgtttccgtgtgatgacgctgaactgccgatttggtcgcgccaacgctgcggcaatcgtcagtgcggtcaaaaaacatgatattgcagtacttgcattgcaggaattgacggacgatctggttgcgcaattggacgcttcgggattgtctgatttgcttccgtaccgtcagttgggggagagcaagggaacggacaatggcggattcaacggtgtgtggattcgtattgaaccaagcgacatgtctccggtcactgcggtgattcccgcggccgacgtgccaggcgtgtgcttcccgatcgattcgatgcgcggcatcacgtttgtttcggcacatccgaagtctccgatgcgcggatgcagggaatggtccgccggcatcatcggtttgggggagttggcgaccactcagaagcagggcgacatcaccgttgtgttgggtgatttgaattccggcaccgatcatccaagcttccgcaagctgctgaatgcgggcttcaaggatgcggccttgtgcgaggcgaagggccgtcatgccacgttcccatcatggctgccgtggccgcgcatcattctcgaccatgtgcttttcaccaagggattggacgcttccgacgtgagttcgttctgcgttgaaggtagcgatcatcttgcgcttgctgccacgttgacgttgaagtagttgatggcgattataaggtagtcgattcagctgaaaacagctgattggagtacgcaaaaaggggatgcgattcgtcttgaatcacatcccctttttatacgttaccgttttcgcgtcgcttgctttagtgcagcaagccggacagtccgccgccaaagttcggcggcagctcaccggcatcgcccatcaagtcttgcaatccggcgggaagtgcaggattctgcggcttcttggcaaaagcggaaccgccggaaggcttaccgtcggagttcttgccggcaagcttgtcgcgcaatgccttctcttcagcctcgcgcttcatcggattgccggacttaccgcccttcttcttgcccttcttgcctttacccttgcctttgcccccgcccatggcagggccgccaaagccaggcatgccagcgccagccttgttgctcatacgcttcatcatcttcgcggcctgctcgaaacgctgcaacagcgcgttcacctgcgaaacggtcacgccggaaccgtaagcgatacgagctcgacgagaaccgtcaataatcgaaggatcacgacgttccgcaggagtcatcgaacgaataatggcttcagtacgatcgatttccctctcgtcgaactgctcaagttctttacgatgcgcggccatacccggaatcatgccaagcagattcttcatcggaccaagcttgcgcacctgttgcagctgatcgaggaaatcatccaaaccaaaggaaccatcggaaatcttgatggcggccttacgagcctcttcctcatcgaactgcttctgcgcctgctcgatcagggtaagaatatcgcccatatcgagaatgcgggaagccatacgatccgggtggaaaacctcgaaatccttcagaccttcgccagtggaagcgaacagaatcggcttgccggtaacggaggcgaccgaaagcgcggcaccgccacgggcgtcgccatcaagcttcgaaagcaccacgccggtgaagtccacgccctcatcgaacgccttcgccgtctgcacggcatcctgaccgatcatcgcgtcgattacgaacaggatttcgttcggctgcacggcgtcgcgaatatcgcgagcctgcttcatgagctcttcgtcaacgccgagacggcctgcggtatcgatgatgaccgtgtcgtacagcttctgcttggccagcgcaacagcgtcacgcgccaccttcaccggatcgccggtggtcagacccggggaagcaacggcttcgccaccatcggactgcacgcccttttccggagcgtacacgggcacgcctgcacgttcgccaaccacctgcagctgcgtcactgcgttcggacgctgcaaatcggccgcgaccaacagcggagtgtggccggaatccttcagccagtagccgagtttgcctgcgagggtggttttaccagcaccctgaagaccggcgagcatgatgacggtcggcggattcttcgcaaaattcagcggtcggtcaacgccagcgccaagcacggccgtcaactcttcgttgacgatcttcacgacctgctgggccggattcagcgcctgggaaacctcggtgccgagcgcacgctcgcggattcggccggtgaaggaacgcaccacgtcgagcgccacgtcggcgtcgagcagcgcgcggcggatttcgcggatcgtaccatcgatatcagcctcggaaagcttgcctttgctcttcagatgcttgaacgcattcgagagcctatctgtcaaagaactaaatgctgccataatgtccctcagtctagccgtcccgcgggaaatttcgcattccaattaatggtgttgatgatgttcggttgatattcggtgagatgcttgatgctatttgcatgagaaatggaaatcccgtctcttccaataggagaagacgggattattgcttattaagagcgctgcggattatttgagggtccaggtgggaccctggggagtgtcttcgatggcgattccggctgcgcccaaggcatcacgaatggcgtcggcgcgggcgaaatccttggccttgcgggcttcggcacgctcctccaactgttcggaaaccaaacggtcaagcgcagtatgctcagcggaatcagcaccggctccggctgcgccgccggccgcaccctcgcttacccacggttccgccaacggatccaaaccaagcgtatcgagcatcgcacgcacattcaccaaaacagcgcgaacttcatccttcgcaacatccgaatcaacacgatcggcaagcttcgaaagcaacgtgttgccagaacgaatcgccgtgaaaatcgcagcggaggcgccggaaacattaatatcgtcattcattgcggcgacgaaatcagccggcagctcatcggcggaaaccgaaacgatctcctcacgggacggctgcccgccaacggcggcaccggcacgttcgatgaaattcgacacacgatcgtacgcggactgagcctcggtcaacgtctgatccgaccattccaacatggaacgatactgcacggaaccaagcgcgtaacgcaccacccaagcggaattttccgccaaaactgccggcacggacaagccgttgcccagcgacttcgacatcttctcacccttggcggtaacccatgcggaatgcatccaacgagccgccgaatcgtaaccggcggcacgagtctgcgccatttcgttctcatggtgcgggaaacgcaagtccagcccgccgccatgaatgtcgaacatatccttcaaatagcggtggctcatcgccgagcattcaatatgccaacccgggcgacccgtgccgaacggagtattccaacgcgcgtcaagcggatcggaatccttcggagccttccacaatgcgaaatcacgcggatcatgcttgtcttccgacatgtccgcaggatcaaccggattgtacttgtcgttgcccgtattgtcgacagacggacccatggcatcggccacctcggaagcggcatcggccacagcggtctgcttctgatgcgtcaactcgccataatgaggccagctggcaacgtcgaaatacacgttgccggtcggattgccgttctcatcagtcaccacgtagccgtggccgttgtcgatgatctgcttgatcagatcgatcatgtcgatcatgtggccggtcgcacgcggctcatacgtaggcggctcaacacccaacgtgttgtaagcctcagtgaattcacgctcgtaaatgtacgcgcgctcccaccactgctgaccggcggccgcagccttatcgagaatcttgtcgtcgatatcggtgacattgcgcacgaacgtgaccttgtagcccaaacgctcgaaccagcggcgtaccacgtcaaacgcgacagccgcacgaatatggccgatatgcggcgagctttgcacggtggcgccacacacgtacatgccgacctgaccaggcttgatcggcgtgaaattcgacacggcgtgcgatgcggtgtcgtacagcttcagatcggcagcggcgctcgccactgcgtcaactgcggttgcgacgctagaaatgttgatattctgcggttcttgcgtgttcgtcataaccacgagagtattgccagaatcggacatgcatgcgagatgaaaatgaacggcaaaacggtttttgttggatttgtgaacatcgtttacgtaggtgatgcaacaatagaacgtatgacgcaatcgcaggtgctgattttgcaacacgttccgtgggagagaccgggacgcattttagacagtctggatgatttgggactgcagtatcaaatcatcaatgtcgccaagcagaagaaaccggatttgcctgattttggcgaggtttccggcgtggtgatcatgggcggcccgatgggtgcgctcgactacgacaagtatccgggattaaaggccgaggccaagcttgcgcgggctgcggtcagcgttggcaagccggtgttgggcgtgtgcctgggacatcagatcatcgccaccgcgctgggggcgaagctgaagtcgggagatgctccggaaatcggttttgcgccgattaaatgcatcgacaagcatgattatttctcgatgtggaacaaaaccgtggatgtgctgcactggcataacgacgtggtgtcgttgccggagggcgcgcagccattggcacgatccgcgaagaccaaggtgcaggcgttccgttttggttccgctctgggcatgcagttccacttggaggttacccctactctgttggaggagtggcttgacgagtcaagcatggtcaaggatctcaaggctgccggcgggtcgaaatcgcagttgcgcgaggcgttcgccgaatataatccgcagttgcagccgcttgcggatcaggtgttttcgagttttgccgctcgttgtaattcgtatgggcagaatttggctcaggcgcagcagggctgatcgccgagttgtgtgcggttccgattgctgcgtagcgctggtggcgattcgcaagttgcggcattgcctgcaggtttgggagatgttcccgctacattggtgacttatgccgacttatgatttgggacttgaacacgtttcgcttgcttttgcgaccaagaatattttcaacgatgtaacgcagggtgtttttgaaggcgaccgcatcggcatcgtcggtaagaacggcgacggcaagtccacgttgctgcatttgttcaaaggcacgcaggagccggactccggtcgcgtgaccattcgcggcgggcttacgctcggcatgctcgaccagcgtgatccgctcgacgacaacgccaccgtgcgcgaagctgcgctcgaaggccgtgaagactacgaatgggctgcggaaaccaagtcgcgcgaaatcgtcgaagcattgcttggcggcatcagcttggaagcgaaaatcggttcgctttccggcggtcagcgtcgccgcgccgatttggcacgcctgttgctcaaggattgggatattctcgcactcgacgagcctacaaaccatttggatgtggtgaccattcactggctggcggaacatttgaagaaccgttggccggccggatccggcgcgctgctgctcgtcacccatgaccgttggttcctcgacgaagtgtgcgaatccatgtgggaggtgcatgacggcgaaatcgagccgtttgaaggcggctattccgcatacatgctgcagcgcgtggaacgcgatcgccaagccgacgtgcgtgaaacgaaacgtcgcaatctggctcgtaaggaacttgcctggcttacccgcggtgcccgcgcccgttccaccaagcagaaattccatgtgaaggccgcgcgtgagctcatcgccgacgtgcctccggtgcgcaatacgctggaattgaagcaaatggccacatcccgcttgggcaagcaggtggttgacctgattgacgtgacgcagattttcgaacatgtgcaaggcgaggccgatatcgatccggacgctgccgacatggaagcgtcggcatcgcgcgtcgatgtggtgccggccatgtatgccgagccgcaagtgcatggttccgtggaagttgccgtcgacgatctgactgatccgcgattggtggatgccggtgttgcagcggcgcaagttgctgcagctgcgaaagaatcgcaagaaattcaggaatcgcaagaaaataatactgatgatcctgcagaagaaattacttctgcagcgcaaaaaattactgttaccggtcgtaagattcttgacgacgtgacatggctgatcgggccgggcgatcgtttcggcatcgtcggcgcgaacggtgccggaaaatcgacgttattgaagattcttgacggcacgatcacccccactgtaggtcatgtgaatatcggcaaaaccgtgaaattcgcggtgctttcacagcgtctcgacgaattggagaagctcggtaaatacaagatcaaggaagtgctgagccgttacaagccgagctatatcgtggacggcaaggaaaccacgccggggcagatgatggagcgtctcggattcgagtcggcgcagctgatgacgccgatcaaggacctatcgggtggtcagaagcgtcgtatgcagttgctgctgatcctactggacgagccgaacgtgctcatcatggatgagcccggcaatgatctcgacaccgacatgctcgccgtgatggaggatctgctcgacacttggccgggaactctgatcgtcgtctcccatgaccggtatctgctcgaacgtgtcaccgatcagcagttcgcgctgatcggcggcaaggtgcgccacctgcccggtggcgtgcaggattatctggacatgactgaggccatcaagaacggcaagaatccgtttgcggacgaaaaggcaggtgccggcaaaggcaagaagggcggttccgctgggactgccggttccacgaccgaaggcaccgcaggcaactccgcaagtgggtctgcgactgctgaaaccgcatcttccgcgccttctacgccgaaactttccggcaaggcctttcacgaagcctccaagcgcgtatcggcaatcgagcgcaaactcgccaaactcgaagagcagaaagccgatcttgagcagcaaatggccgcgcacgaccccagcgactacgagggcctaggcaagctcaacgaccagcttcaagccgtcaccgacgagtccgaagaacttgaactcgaatggatggaactctccgaacagctcgagtagcattcgtatcgtccgcgtcaattaccggacagggtgtgcatgttgtggcggcggcgcagctcctccagcgtttccggtgaatgttggccattcgtgcgacagcgatgcgtggcattccatgtgccaatgtcatattcttgttattgcaggaaaccttagctgttcttgtcggagagaccaatggaggtgccttatgaatcaagtgatgcgaagaagcgcctgttgcttgttgtccagcttgttgttgtggtcatgcgttggctgcacgaaagctgcacatgaaagtttcggtgatggctccgtacagagcggcagcgagaatgatgatgccgcaaaacaggcatataaagcatttactgtggacgctctggatcgtgtcgccgtcgatgatctcaatagctcggacaaactggttctagtaaacaagttgggtgcgaaatccgtacatggcgatgatgctatttcatttacaaaaacagttgatgacagcaatatgtattatgtcatctccatgtgtaagcagaaggagcaggctccttattcgtttgtcctctacaaagatggacagccacacaccctaaccactagggaggcctgtacatctaacggaatagaaacgatctctctcccggcgaagaatttcccagatgccacctcattgtccattatcaatatcggcaatacggatcttgttgtttccgtatatgaagtaaaggaaccccatcatgaataatttcagtcataatgctccctgtcgtgctgccatcatcatggtttgtggcatcacgatgaatgctactgggctagttgttgcaaaactggccgattaggtagatggggtagtaggtgatgttgtggtcggtttcgatgttgccggggccgaaaactaatccttggcgaaggtgataactttcctctgcgagcacattattaagagcccgatgaaccttgtttgatatcttcttgcgcctggcgaacgtctatgagactgttgttttgcgcaaaagatgctactgcagctggcatgcctccaatgatcagatattttctgaatatcgcagatctgacaacaaaaagggctttcccgcgttgaaacgggaaagccctgtaggtttgggattaggctgattggatcagcgaccggtgatttcggagccgagcaccttttcgctcaaggccttcggaccgcgcgtcactgcgaccgcgccggaacgaaccagctcgataatgccgtaatgctccaaaagccccagcagcgcatcaatcttgccttcggcaccggtggcttcgatggtcagcgattccggattcacatcgaccacgcgcacgcggaacagacgcacgatctcaagcacgtcggaacggttggattcgtcggcagttaccttgataagcaccagttcgcgctccacagtggtgttcggatccaaatccacgattttcaacacatgcagcagcttgttgagctgcttgatgatctgctcgagcggcacctcatccacatcggcggtcaccgtgacacgcgaaatgtcagggcgctcggtgggggagacggacagtgagttgatgttgaacgcacgacgggcgaacaggccggcaatacgcgccagcacgcccggacggttctctacgagcacggaaagcgtatggcgcttagaacccggctgagatgcaggatacattggtagacccttccttactacttactcgtttgctcgtttactcgttgtcggcagcggccttcgggcgctgcagcggcttgattccgggcatataggtgacattgtcgttggcatcgccagctgcgaccatcggccacaccatagcgtccttccacacgcggaaatcgataagcaccgggcgatcgttgatttcgttggccttcttgatcgcttcaatggcttcttcttccgcgaacgcacgcataccaacgcaaccgtacgcttcggcaagcttcacgaaatcaggaacatccacgatttccagcgtattctctccatccatcagattggtggcggaataatgctcgccgtagaacagggtctgccattgacgaaccatgccatacacggaattgttcagcagtgcgatcttaatcggcgtgtgatcgtggaacgcggtcgccagctcttcagaagtcatctggaaggaaccgtcaccgtcaatcagccacaccggcttctcgccctcatggaaacgttcggaaccaacacgagcgccgatggcggccggcagtccgtaacccatggtgccgaggccgccggagctcagccaagaatgcggcttctcgaaatcgatgagctgtgtggcccacatctgatgctggcccacaccggtaacccaaatcgtgtcaggatcagccagatcggaaagctgcttgatgacccactgcggagccatcgaaccatcggtcggctcatcccacttgatcgggtacttttcacgccaatcgttgatgatctcccaccaatgcgaagtgtcaggcttgccatgcacggcctgctcgcgcttgatttccggaatgagatcctttagcacggttgccacatcgccaacgatcggcacatccggctgacggttcttgccgatttccgccggatcgatatcaatgtgaatcacacgtgcacccggagcgaaagcgtcaagcttgccggttacacgatcgtcgaaacgagcgccgatcgcaacaagcagatcgcaacgctgcacggcaccggtagcggcaatcgtgccatgcatgccaagcatgccgagcaccttcggatcggaatcaggcacaacaccgcgcgcgggcagcgtggtgacgatcggagcgttcgtgacttccgccagctcctgcacgagcttgccggcatcggaacgtgccgcgccgccgcccacatacagcaccggacggtacgactgctcgaacagcttcgcagcgtcggaaagcacacggccgtgagccttcgtagtggggttgtagccgggcagaatcatgcgctgcggccacgaatagtacatgtcgccggtctgtgcggttttggtgacgtcgaccaccaccggaccagggcggccggaacgtgccacatagtgtgcttcagccagcacgcgcggaatatcctgcgcacgcgtgaccagataggagtgcttgaccaccggataggttgcgccgacgatatcggcttcctggaaggcgtcggtgccaatggcgttcacgccaacctgaccggtgatgaccaccatcggcacggaatccatgttcgcgtcggcgatcggggtgatcatattcgtggcgcccgggccggacgtgacgatgcatacgccgacctgaccggtcgatacggcatagccttcagccgcatggcctgcggcctgttcgtggcgcatcagcacaaaacggaagctggtttcatcattgattgcatcgtataccggcagaatcgcgccgcctggaacgccgaaaacatccttgacgcccagatcttccagcgaacgtaccagcgcttcggcgccggtcatcttctcgccgtcaacaatggtctgcttttcagtggttgcggctgccttgggcatgccgctgaatgcctgcaggggcgtaggtaacaccatgttccctctcatattcgctcgtggaactttcttacaggggtatgctgccgcgtttcggtgcacgcaatcagccgaaccccatcatcggaaagcggcgcaatcgcttgtggcgacttgcgaatcgcaatccttcgctagtaatcagtctatgctatcggctgacaggagaatatgccggattcgtgccatattctggcgtattgcgttccgcggcggtatgagagggcggattcgtagctgctttttatctacctgcgactacttactggtgttttcgccgttgctgccgttactttcgttgccgctgtgcttgtgatgatgtttgcgatgcttacggacgttttgtgcttcaggcttgcgattgtccagtgccttccaaccttcttcggctgcggcgagttgcgccttgcgcttgctggtgcctgtgccggtgctgatgatttcgtcgctttcgcccagcatgacgttcgcagtgaacacttgcgcatattccggaccggaaaccgacatctggtagcgcggttcgccgaagcccatgccatgcgctttgacggtaagcgaggttttccaatcgagggctgggccttccgtcgcgacttccgcaagcgtttcgtcaacaagatgatgcacaacgcgacgtgcctcgtcaatgccatgctgaatgaacgtcgcaccgatcaacgattcgacgatatcgcacagaatcgagcttttatcagcgccgccctgatcgctttcgccatgaccgagcagaatgtacgggcctgcattgagcttttcgcgagcgattttgctcaaggattcctcggaaacggctttcgcgcgcattttcgcaagctgcccctcgttcatgtcggggtgtgccttgtacagggtttccgtggagacgagctcaagcacggcgtcgccaaggaattccaaacgttcgtagttttttgcgcccggattctcgtgcgagaaggagcggtgggtgagcgcttcgaccagcaggtcgggttcgagcgtggtgccgagcgcttcaagcagtgcgttggcggtcatctcgccttcggaaacggcggatgcgtcggcgttgttctgggtcataatcgtcctcggtttcgtagtgggtatgcgacggcgaagctcgccgcgctgttcgggacgttgcgtacgtggcaacaagccagcgaatctggccgattgctatgcaaacaacgatcccgttcagtctactctccacccatgtcgaggcggaaatgcagggaaatgcgcggatactaggtggatgcgatacttggcggatgcgaggtgagatggtcgggtgcatgcgaatgcatatggccaagtgcgcagcctgaaatatacaaaaccctgccacccgtcgatggcagggtttcaatgcttcatgccgttactcggcagccactcacttggtgtggatggagcggacagcctcgcggtacacgcggccgcggtaggcgccgcagctcgggcaggccatgtgcggcagcgccggagcgccacagttcgggcaggtaacggtctgggcggccttggccttccagtttgcgcggcgagaatgagtattcgcgcgcgaggtcttgtacttaggcagtgccattgtgtttcctctgtttcgttcgaacgattgagcttaagcgttcagtatcttaacttgtgctccgtacaaattgcaaaaaccgagcaaaatcagccctgccagcacccggatgaaccttactcgttgccttccagccgggccttcaagccttccaaagcggcgaaacgaatatcggtcacatcgtgatgatggtccggatcctcgttcagatcggcgccgcactgagagcacaatcccaagcaatcaggcttgcacagcggctgcaacggcagttcctcgaccaacgtgtcgcgcagaagcgtctcaatatcggcccaggatccgccttcaagcagcggatacgaatcctccgactcgtcttcgctggcgataatgtcgacttcctcttccttgacgccgcccttgccgtttttgccgcccttgccggacgcaacgcttgcggacttgtcttcatatgggaagaacgaagtgacgttcaccgtccaatcgcgcttgatcggtttcagacagcgggtgcattcggcgtgcacgggggcactgatgcgggcgttgaaaatcaggccgtcgacaatggagtcgaacgagccgacaacggtcacatccgcaccctcctcaacgccgacgatcacatcgccgatgccgctcggtgcggggaacgttgcgtcgatctccttgctttgcccggctcgcgaggcgacttgcgccacggaaatcgcccacggggaatcttcgatacgtgccatgttcagccttccattcagctttccggatagtcgtttgcgtcaagatgcggcacatgcgtgctcgcttcgcgctggcgatcatacagtacgttcaatcccgcctgcacgtcgttgccaagcttgccgagctgctgttgcagcgtttccatcaccgtggtgcagtatttgtcagctccctgcgtgagatggtcggccctggcttgcgcttggtcgagaatagcacgcgccttctgccgagccagttcggtcacgttttcctgcccggcgaggaattgcgcctgctcgttggcctcacgtatcgtgtctgccgcacgcgattgcgccgaagcgacgatggcgttggcttgcgtttgcgcgctttccaaacgtcgttccgactcacgcatcaacgccgaggcgcgttccagctgcaccggcatcattttcttcaactggtcgagctgttcggtgaattcgtcgcggtcgacgcgcacgctgccggggaagaacagtatcggtttcgcttcgtccaatgccgattcgagtttgtcgataatgtcgtacacggtggtgaattcgtcgcggctcaaatcgttggaatcgtccagcggcgcgttgggattgaacgtgttgcgtaaatccggcagatcagacatggaaatcaacggtttgaccggctcggcggcgcgtgccgtggcttgtgccttctgaccggattgggccgcccgatcggtcgggcgttcggcggtcacgtcgtcgtcaaactggctgccggccggatcgtacgcattcgtttcttcacccatcatgccctcttttcattattgagcgcttctccgagtagcggaatcacgcaatcaggcaccatgccggtcacatcgccgccgtgacgtgccacatctttcacgatcgaactggagatatgttccaaatcgggcgccgccggcaaaaacagcgtttccacgtcggcaagcttgcgattgaccagcgccatacccaactcggcttcataatcgccattctgccgaagccccttcacgataaccgtcgcaccgaccttcttgcaatagtcggtaatcagtccggttgttgaagcaaccttgatattgcggcaattccgctcttcaagcgccttacggataatctcaacgcgggtctcttcggaaaacatcggtgttttcgccgcgttcaccgccactacgacatgcacttcatcgaaaaaacgcgcgcaacgttcgatgacgtccaaatgtccggcggtcactgggtcgtacgacccggggcaaactgcaattgtcatagcctcaagcgtaccgcgattgcgtgaaattacgcgaagtgtcggcgaatatgtgggtttccatggctatgatggaggcagtggtgccgcggttgcggcgtatttgaggagttgattatggcatgttcgatgttcgatgatcgcgacggcttcattgacgaggccgacccggtctcgccgctttccaatcccgacgcaggtaccggcactgcggtgctggaacgccccgaagaggagacgaagctggatgatggcggcaacggcgatgcggatcgtttcgcgcattatgtgtcgcgcgatcgcattgccgagtcccgtcgcaccggccgaccggtggtggcgttgtgcggcaaggtgtgggtgccgaagcgtgatccttcgcagttcccggtatgtccggattgcaagcgtatctacgacgaaatgatgaattccaatttctaatcgtttttctcatcgtatttctcgtcgtatggtgatcttggaatttcactgaaatttctgaagattgccgaacacgattacatataaaaaatctgccgagatggtctctatatcgaaattatttttcgatgattgagattgtctcggcagattttttattgttgttgcgtcttatatctgctgatatatccgcgtttagcgcaacgaaatttcgtcgatgcgacgcaattcctcatcgctgaacgtggtgttcttcaacgcgccgatattgtcgagcagctgctgcgggcgggaagcgccgacaagcacggaggtcacgtaaccgtcgtgcagcagccaggcgagcgccatttcggcaagcgtctgcccgcgttcggcggcaagatcgttcaggtcgcggatctgctgcaggcgttccggcgtcaacgcgctttcctgcaggaatcgaccgtcgtgcgcgatgcggctgtctgcgggtacgccgttgagatagcggttcgtgagcaggccctgttcgagcggcgagaacgtgataagacctttgccaagctttttggcggttttcttcaatccgttgcgttccacggtgcggtcgaaaatgctgtaacggttctggttgatgatgaacggcacatgcagctcatcgaggatcgcggtggccttttccagcgtcggaccatcgtaattgctcaggcccacgtagagtgccttgccgctttgcacggcggttgccaacgcgcccatggtttcttcgagcggcgtggaggaatccatgtggtgatggtagaaaatgtcgacatagtcgagaccgaggcgttcgaggctttggtcgagcgaggcgagtagatatttgcggctgccgagatcaccgtaggggccgagccacatttcgtagccggctttggtgctgatgatcagttcgtcgcgatgatgatggaaatattcgcgcagcagacggccgcagttcttttccgcactgcccggctcgggaccgtaattgttggcgagatcgaaatgtgtgatgccgttgtcgaatgcggtgaacacgatgtcacgcatagtggcgtacggcgtgatatcgccgaaattatgccaaaagccgagcgaaaccgctggaagtttcaggccgctctcgcccacatgattgtaggtcatggaatcgtatcgagcgggtgacggcgtgtagacggtggtcggttcaagcatggttcctccttgaaaactctgcgtattccgctgtgcgctgtgttgcttgagttggcgcatgtcgtaagtttgtcgacgatactatcgtcgcacttcaagtaaacttgaatgcaagtatcgtcgatagtgtgttttccgatgattgacaatcgcaaggaatcgcaaaatcgctagaaaaacctagaaaatcgtagaaatgagaaggggaatggcaacatatacgattcgtgaagtcgcgcaacgattccatgtgcagacgtcaaccttgcgctattacgaggatcaggggctgctgtgcgacgtggagcgcgacgatgcggggcgacgcgtgtacaccgactcgcatatcgggcggctcgaggcgatcgcctgcttcaaacatgcgggcatgagcatcgatgaactcaaacgcttcttcgcatacgaaaaagacgagcgtgcgcacattgcggacatgctggaattgttggaatcgcggcatcaagcgattttgaaacagcgggccgcgctggaagaggcgtacatgcatgtgttgcgcaaactgcacttgtatcgcgatattcagcacagcatcgaaacgggggcgccatacccggattgggcgaattatgatggcaaggattttcgcgccgacgatcagtgaagttcggtggactgacgaagatcagtgaagactggttggcgaagggcggtgacgcccagttggcgaaaaagcggaaaataaaaggtgtggaaccgcaaactacagttctacacctttagaacacctagcagaacgtctaatagagactgctgcgactcgtttcagccctacttcagcagagtggccacggatggcagcagggcgcgcaacgccttgccgcgatgggagatggcgttcttttcggccggttccatctgcgcggacgtgagcttctcgccggcttcgacggcacgcgccggctgatcgtcgggcacgaacagcgggtcgtagccgaatccatgctcgccatgaggctcatgcaacagcacgcccggcatttcgccggtttccacgatttcctgagcgatcgcataacgaccatcggcgcctgcgcctgcttcggtttgcggcaccaccagcgcggccgcgcaacggaaacgcgcggtacgcttggcatccggaatgtcggcgatctgcgcgagcagcagcgcgttgttggctttgtcatcgccatgcttgcccgcccaacgtgcggaaagaatgccgggggcattgcccatcacgtccacaatcagaccggaatcgtcggcgattgccgggcagcccgtacgtgcggccacatcacgggccttgagcagcgcgttctcttggaaggtcacgccatcttccaccggatccggcagattcagcgaaccggccgacaccagctccacctgatccgcgtccgcacccaggcaatcttccagaatgcggttgatttcaacgagtttgccctcgttatgcgttgcgacgataattctcacgttccgattcctttcgttgctgttcgttgcttcgttgatgtcggcttgcctgacgtgcgtttgacgtgccctgacttgcctaacctacgattggtttgcgaggccagcctgcggttggcttacgtccgacttgcagccttcagtcctgtgcgagcgcggactgctgtgcggcctgcagttccttgttgcccttttccgccaggtcaagcagcgcgttcaactcggcgcggttgaacgggcggtgttcggcagtgccctgaatttcaatgaattcgccggaaccggtcatggccacgttcatgtcggtcatggccttgctgtcttcgatgtacggcaggtcaagcatcggtgtgccatcgatcacgcctacggacacggcggaaacgctgtctttgatcacgcgctcggcggacctgatgtgcttgtgcttctcggcccagcgcatggcgtccacgagcgccacatatgcgccggtgatcgacgctgttcgggtgccgccgtcggcctgcagcacgtcgcagtcgatctgcacctggttttcgccgagcgccttcatgtcgaccacaccgcgcagacaacgtccgatcagtcggctgatctcatgcgtgcgtccgccgatcttgccgcgcacggattcacgatcggtgcggtctgcagtggctcgcggcagcatcgcatattccgcggtgacccagcccaagccggagtccttgcgccaacgtggcacgcctgcggtgaacgtggccgtgcacatcactcgcgtattgccgcattccacaagcacggatccttccggaacatccgtgaaatgacgggtgatgcgcaccggacgcagctcatccaccttgcgtccgtccgcacgaattaccgtctgcccgtccaacatgtctttaatcgctaccatcgctgatttctctgctttcgattgatcacacgatcaacaatcgtttgtattttccgaaaaaacagtatcaccagccgaaaacccgtctttccgtcttgaactcgcctcttgctgcacctcaatttgcctatcccaatttgcgtcgtgcccgaatttgcgcgcatctcacgtttgtctcacgtaatacaggcatgcaagcacgtatgatggaacgaaaacctgtgcttggccacggcgaggcctacacttatggtcagtttcaccaaaagtcagaaaggctttggaaatgctggattattcacctgcactcatgaccgacatgtacgaatacaccatgcttgacgcgtgcctgagggacggcaccgccaatcgcaagtgcgtattcgagattttcacccgtcatctgccgcttggccgccactatggggtggccgccggccaaggtcgtattcttgacgcgcttgaaaatttccatcttgacgataatgatctgaaattccttgcagatcgcaaagtagtgggccccgaaactatcaaatggcttgagaatttccatttttccggttcgatcaagggatatcgcgaaggtgagatgttcttcccgaattcgccgattctgcaagtcgaaggcacgttcggcgagtgcacgctgctggaaacgctgttgctgagcattctgaattacgattccgcggttgcgtcggccgcgtcccgcatggtcagcgccgcgaaggatcgcccgtgcatggatatgggcgggcgccgtacgaacgagtgggccgccgttgccgctgcccgtgctgcggtagtgggcggattcaagggcacggccaatctgctggccgcgcaaatgtatggcttgaatgccatcggcacggccgcgcactgcttcacgctggtgcatgatgatgagcgcagcgcgtttgaatcgcagattgccgcgctcggcaagaacaccacactgttggttgacacgtacaacattgaagaggccgtgaagacagctgttgaagtggccggacccgaattgggcggcgtgcgcatcgattccggcgatctggcgtcgttggcgcagcgcgtgcgcaaccagctggatgcgttgggcgctaccaacacgaagatcaccgttaccaacgatttggacgagtatgcgctcgcttcgctgcagaccgcgccggtcgattcgtatggcgtgggcaccatgctcgtcaccggatcgggcgctccgacctgtgcgatggtgtacaagctgactgaacgcgagaattccgctggtgacatgcagccggtggccaagaagtcgaaagacaaggccacggttccgggccgcaagctcgccttccgttcgtacgagtattcgctggccgactgcgaacatgtgatttccggctccgaagagcagctggccgcctatcagccggaagaaggctggaaggatctgctggtcggctacgtgagcaacggcgaaatcaactccgattatcagggacacgaggccatcgtcaacgcgcataattaccgcgcccaggcgctggccgaactgccgatcggcgcgcaaagcctcatgaagggcgacccggtaatccctaccgaaatcaccgtcctttgactcgtgctaccatcatgctggttgcgtacggcaatcaatctcgtaatcaaccagcatgaaggggtaggattacatgcgagcattttctctggttacgttgagtccggaggcgtttgacgatttttccgcacatcacgcggacggcaactttcaacagacctctgccgcaggccgtctgcgtgccggccaagggatcgaagtggaataccttggcgttcaagaaaacggcacaatcgttgcgggagcgctgttcgaaacgcatcgcagccgcctttccaccttcagtgtggtgcacgacggccccttgtgtgactatcgcgatcgcgaattgaccgaatatttcatgacccaactcaagcagcacgcgaaggcgaaaggttccgcacagatggaaatcgtgccggaaatgccatactgcctgcatgactcgcgtggcggcgaactgccagccgaccaaggtggtgctcctgctgatgatgccgtagaaacgttgaaaaacctcggcttcatgcatgacggcttcaccatcggctacactgcggtgccgcgctggcgttacctgaaagacctgactggcattaccgacgaaaagtcactgctcaagtcgtatgacaagcgcacgcagtggagcgtgaaacgtgccgcatccatgggcgtgcatgtgcgcgagctaggcgaagacgagctgcaggtgtttgccgacatcgagcaggccaccgccgaacgccgtaatttcgaatatcgtggtgaagcctacttccgcaagttcaagcaagcttacggcagtaaggcgcacttcatggtggcgcagattcacatcggcgaatacattgccgacatggaatccaagtgtgacgccttgcggaagaaggtcgatgtgctgcaggccaagtacgacgagcatccgaccaccaaaacggaacgccagctaggggaggagtcccgaaacttggcggcggcggaaaaacgtttgaccgaggcggccgagtacgccaaagacggtgacgtgcttccggcggcagcatccctattcgtggaacacgctcgtgaaacggtgtatctgttctcaggcagtgtggaaaagtacaagccgttctacgcttccgcgctcattcaacatgatgccatgctgcatttgtgtgtggaacgcggtgtgacccgctacaacttctacggcatcaacggcgtgttcgacgatccggaagatgagggtcgtggcgtactcgaattcaagcaaggcttcaacgggtacgtcgaggaactcatgggctcattcgtgcttcccgtacgcccgctgaccttcaaactcaagaccgccctccgcgaactcctgcgccactagctattagctcaccttccgcttggaggattctgggtgggggcttataggtgcgcgagggttatgtgaacgctgttgacggcgactgtaggccggactaggttatcgcttttggtgaaaagggattttagccagttgggatagtgaaaggtagttacggatcgtgatgcgcgaagtgaatgcgagtgaggaacaagagcaagaatcgtctgaatggaatgtgcgcgagctgagcggtagtgagtttgatgagctttccgccgcgagcagatacggcggattccagcagacttccgaaatggcggcattggctcagtccgacggcatgcaaacgcaatacgttggattggtggattcgcacgatgctccggtggctggcgcgttggtggctttttcgcaagggcgtttcggcgtggaaggctcgttatggcttggcccgttgtgcaatgggaataacagagagcagatgaccgcgttgaccgaaggtttgcgcgaggctgccgaacgggttcacgccatcagcctgacgtgctggcccaaccaggtgtattgcgttcgtgattcgcaaggcaaggccatggccgaacccaatgatgagatggtgcgggagtacgagcggctgggttggaagcatgctggctttacccgtggatacgatgccctgatgaaccgttggaattacgtcaaggacttgagagagttctcgaacgccggcgagctgctcgcttcgtatgcgaagaacacgcgtcgtaacgtcaagatcgcgcggaacagcggcgtggaggttcgacgcctgaatcgcagtgagctgaacgtgttccacgatatttgcgagctgagtagcgaacgccagcatttcgccaaccgtagccttgattacttcgaacgcgtatatgatgcgtttggagacaaggccgagttcatggtggcggaagtgcatcttgaccgctatttgcaatcctgagaggaaaagctggcgaagttctcgaaagacgtggaacgctgggagcgttcgcttgagcatacgaagtacccggatgatgtgcgcaagaagctcgatacggctcagaagaatgtggagtccgcacgtcgccgcattgaggatgcgaacgagcgcatcgctcgtgatggcgaggtggtgccggtcgccgtaggtctgttcatgtggcatgaacgcgagctggtgtatttctccagcggatccgacgatcgttacgccaagttctacgcgcccaccgccttacagcatgagatgatgtcgcgttgcttggaacgcggagtgacgcggtacaacttctatggcatttcgggagtgttcgacgatccggaagacgatggacgcggcgtgctcgagttcaagcagggcttcaacggctacgttgaggaactgccgggcgaattcacgcttccggtgagcaagctgcgctacggcgtgagcgatttggcccacaaactcctgcgccactagctttagggggtttcagccatgcttggcgcgacgcggatttgcgtggggtgagactttctggtacgctttatgtcttgtgcgcggatggcgtgtgcttccgggcattgccactttagctcagtcggtagagcggctcactcgtaatgagcaggtcgacagttcgattctgtcaagtggctccagcgccctagatgtgaaagcatctagggtttcgcatatcaggagcgttttgccccgatatggctacttgcgcgagtggcggaattggtagacgcgcaggatttaggttcctgtgtctttgacgtgtgggttcaagtcccatctcgcgcactttcagaaaacggcggaattccgccagttcttggtcattgtagtccactcaataagcctttttgagaacatgttgaaaacattttgcccgtttgcgtcccaattcttccactgactggaggatttgggacgttggggagcttgtttgcgggtggattcttccactgactggataatttgggacggtggcaggcttatttgcgggtgaattcttccagcgggtggaggatttgggacgctgaggggcgcgtgagcggagtgtttcttccagtgggtggaagaaacaggacggtgatgggtggcttggtggcaggggatgctcctaagatggcttcgggtaggaagagaaagagatgattagggattaggggagtgtcgtgtctgcgctgattcagcctgttgcgctactgctgattattctcgccgggtacttgttcaaacgtgccggcctgttcgaagatcgcgattaccgcattatgcagaccattattttcaatctggtgctgccaggcgcgatcgtctattcgtttgctacgaatccgcatgattccagcatgctgttgatttcgctgttcggcctgattgttgcgttcattccgccggtcgtggttttcttgacgtcccgccaccgaccggtgcagaaccgtgcgttcatgatgttgaatggttccggcttcaacgttggctgcttctgtttcccggtggtgcaggcgtttcttggcacgggcgcgatcgtgcccgccgccatgttcgacattggcaattgcgtaatggttgccgccggtacgaatgtgatgacgcaaacgctgctgcacatcaagcctggcatgccgcttaccgaacagtatcagggcaatgcgcccacgctcccgtatgtgaagccgaaagacaaggatgccaaacgtcttgcccgcaaggcgttggcccgcaacgtgttcaagggtttcttcggttcggttccgttcgacacgtacttggtgatgattattctcacgctcgctaacgtgaagattcctgacattattgccgcgctcgtgcagccgctttcgaacgcgaattcgttctgcgcaatgctgatggtgggcatgcttatggatttgccatctggcaagcaggatgtgcttcagttgttgaaggtgattggctggcgactgccgtttggtattgcgtttgctactgcggcttggctgctgctgccgtttggcgctgagattcgtgaggcggctgcaatgtgttgtttggcgccgattgcagtgttttccacgctgtttaccgacaaggtgcttggtaatgcgaagcttgctggttttacgctgtcgattactgcgattatcagtttgctgctgatgaccggcgctcacttcttgttcgtcgcgctcgcataagagcggcaaggagatctttaccgggtgcgggagattgtttgtgaccccgcagagcacgaagtcgttgaatgcttgcttgctggtagttgcagtgccgttttcttgtcgttcactgcataatgcgatcgtttcgtttattacatgtttggaagtgttacgaagccttacgacggaaccatgcatacgatttcagtaatcgtcgaaaatgcgcatgtcgaagacggaaggttgtcggaaccgcgctatattgcgaatcttggcgaatgtgttaactcaggaaatatttttgtgttgttctgtcttcttttgtgagtatcttgtgaggtgaagagatacggaatgcgacacgcggaaatccgcagagaagccgcaatcgcatccgcttcatagtgatgatgaaaggacctatacaccatggccatcaatcctcctgttgacgccaccaagaccccggagtgggccgcactgcagaagcactacgatgagctgcagtccgaaggcatcagcctcaagcagtggttcgccgatgacgtcgagcgcgtcgagaagctgagcttcgacgcgggcgacctgcacttcgacctgtccaagaacctgatcaagccggaaaccctgcagctgttcgcagacctcgccaaggccgtcaagctcgacgagcgcaccaaggccatgtacaccggcgtgcatatcaacaacaccgaagaccgcgccgtgctgcacaccgcactgcgccgcccggccgaagacgaaggcaagtacatcgttgacggacaggacaccgtcaaggacgtgcgcgaagtgctcggccgcatctacgccttcgccgacaaggttcgctccggcgaatgggccggcgtttccggcaagaagatcgaaaccgtcgtcaacatcggcatcggcggttccgacctgggtcccgtcatggtgtacgaagcgctgaagccgtacgctgacgcaggcatctccgcacgctacatctccaacatcgacccgaacgatctggccgaaaagaccaagggcctcgacccggagaccaccctgttcatcgtcgtttccaagaccttcaccaccctggaaaccctgaccaacgctcgcgaagcccgcacctggctgctcgacgccctcaaggccgccggcgcagtcgacggctccgacgagaagaacgccgaagccatcaagaagcacttcgtcgccgtctccaccaacctggagaaggtcgctgagttcggcatcgacccggccaacgccttcggcttctggaactgggttggcggccgctactccgtggacgcagccgtcggcacctccctcgccgtggtgttcggaccggaacgtttcgaagagttcctgcacggcttccatgagatcgacgaatacttcgccaacaccccgttcgagaagaacgtggtcgtgctgctcggcatgctgaacgtgtggtaccgcaacttcttcaaggtcgcatcccacgccgtgctgccgtacgaccagtacctgcaccgcttcccggcctacctgcagcagctgaccatggaatccaacggcaagtccgtgcgttgggacggcaccccggtcacctccgaaaccggcgaaatcttctggggcgagccgggcaccaacggccagcacgccttctaccagctgatccatcagggcacccagctgatcccggccgacttcatcgcgttcgtgaacaccccgaacccgaccaaggacggcgaccaggacgtgcacgagctgttcctcggcaactacttcgcacagaccaaggctctcgccttcggcaagaccgctgacgaagtgcgtgcagagggcactccggaagagatcgttccggcccgcgtgttcaccggcaaccgcccgaccacctccatcttcggcgtggcactgaccccgttcgcactcggcgagcttatcgccctgtacgagcacatcaccttcgttgaaggcaccgtgtggggtctggactcctacgatcagtggggcgtcgaactgggcaagcagctcgccaagcagatcaccccggccatctcccaggatgacgaagcactggccgctcaggacgcttccactcagtccctgatccagttctaccgcgcaaatcgcaagttctgatttctctaaggattaaatagccttcgaaagggctctgcacgggatgcagagccctttttgctacccctggccatcttcaaaaggtctggcgggtgaggtatttttgaatattgctgtgccgggattcaggacgccgcataatcctgaatcccttcgggtccagccggaaacaatcgcaagattgaacggaatgttgcacaaacgcaagttaccgtgattttcggcggattggcaatccttcgcaggcagacctgcggagaacatacgaggcagaacgaaattgaaaaatcgtgaagcccttacctgtgcgctgatatgcggcggcgactcgaggaaacacaatggttaacgctattgaggcatttgacgccaagcacatgaagccggccgaggaaatcccggcattccgtccgggtgacaccgttgaagtcaacgtgaagatccaggaaggcaacaactcccgtatccaggccttcaccggcgttgtgatcgctcgtcagggcggcggcgtccgtgagaccttcgttgttcgtaagatcagcttcggcaccggtgtggagcgtcgcttcccgctgcactccccggtcatcgactccatcaaggtggtccgcaagggccgtgtgcgtcgcgccaagctgtactacctgcgcaacctgcgcggtaaggccgctcgtatcgttgagcgccgcgacaactccgagaagtgagtttcaaacgcaaataaagcgtgaaattggccctcagcctcacggcaggagggcctttttctattctagaccgctatgataggggtcagtgtgcaaaccggacgataaaggaatcatgtatgaggcatgccaaagaagaaaacaatagcggcgacagctttggcttgcgcgacaccttggtctggtgcggaattcctattattatcgtgctgctgatacgcattttcctgctcggattctacgtgattccctccggatccatgatgaacaccatcgaaccaggtgaccgcgtgatcacctcgaaactcaccccgaaagtcttcgatctgaaacgcggcgacgtggtggtgtttaaggaccccgaccactggctgcggcaggaagacagtagcaaactcggcggtgactacctcatcaaacggctcatcggattgccaggagacaccgtggcatgcgaagggccaggtaagccgatcaccatcaatggtgtggcgattgacgaaagcgcatacattcgccccgacgtggatcccagctcattcgcgttcaacgtgaccgtgaccgaaggacacgtgttcgttatgggcgacaatcgcgccaattccgccgattcacgctatcatcagggtgattcctcacatggacttgtgcctatttccgacgtagtgggtgtcggactcgcgaaatattggccgttgaaccgcatcggcgggctcgatgcgcaccatgaagtgtttgccgacgttccggaaggaggctcggcggcctgatggcggtttccgtaattcccacattggatttggaacgtgctattgccgaacaaggctacgatgtgatcgtcggctttgacgaagtggggcgtggatctctcgcagggccggtaatggttggtgcggctgcgatttgggcgcgtgacttagacgggccggctggagcttcgcaaggaggctcgcaagaatcttcgcatctggaagtgccgaaaggcgtggccgactccaaaatgctgaccgaacacaagcgcgaagccatcttcgacgaactcaaatcctggtgcgcatcttgggcggttggcgccgccagcaacaaggagattgacgagtggggcatttcccatgcactcggcgtagccgcgttacgtgcgttggcacaggcggaggcgaagctcggcattgacggcaacggcatgctctccggcaaaccggtgaaggtcggcgcgatcctcgacggaccgaacgattacatcaccaagacgctgaacaccttcgacgcgcccgaagtgccggtgccggcgaacgttaccaccaaagtgaaaggcgaccggtattgcgtcgccgtggccgctgccgcggtcatcgccaaagtcacccgggatcggctcatggtcgaactgggagcgcaaccccaatatgaaccatatgaatgggcccacaacaagggttacggttcggccgcacaccgtgacgccatcgctgaattcgggcccagcgacctgcaccgcctgtcctggcacctcgtctgacatacggcatctcatccgcagtccgcgattacgctaatccttgcggatgatgcatgccggaaggaaacctgtaagttcatcccgccgtctgatggccggggccaatccgtttccgtaccgtaggaaacatggaacacatacttcaggcgaccgatctggtcatggattattcgacccaacaggcgacaccaaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctagcgcggttgagcgacgctgaccgcaccaaactgcgccgcagcgccttcggcttcgtcttccaatccggacaactgctgccggaactgccggccatcgaaaacatcgcgttgccgatgatgctgggcggcgcaagctaccagcaggccaccgacatggccatgctatggctggaacgattgggattgcgccagctcgcgcaacaacgtcccggcgaaatgagcggcggccagatgcagcgcatcgccatcgcacgtgcgctcgccgcgcagccggcaatcatcttcgccgatgaaccgaccggcgcgctcgaccagaccaccggccacgaaatcatgagcattctcatgcggaccgcacgacagaccggcgcggccgtggtcgtggtgacgcacgattcgaacgtggccgcattctgcgatgccaccgttaccatgcgtgacggcaggttgagctcgccgcagcaatcccaacctaccgccggaggcgcacgatgaacatgttccgattatggcgattgttccaccgctccggcacccgcggcacatccggccgcacctctgcgctggccatcgttgccttcgcatccgccaccgccgtcttcctaaccgtgctcggaggcctgcatggcttcatttggcgggcctccgccgaccacacgttcggttgcatgatcgattccaacaggtgcgcgcccggtacatacgaaacatggtccaaagccctggcgcacgccgacaagctcgtcgccacggtcggcgacggccattggacggccgaccaggccacagccgtcatgaacacctattccgacggctatgtgatgctcgccgcattcgccagtctgctactcatcgtgccgttcgtggcgctcgccggctcggcggcccgtctcgcggcctcccgcagggacgcacgtctcgccgcactgcgacttgcgggcgccaccaccgcgcaggtcacgaaactcaccgcgctcgatgcgggtggccaggctctgcttggcgcgctggtcggcatggccggctacttcgcgctgataccagcgatcatgctgctcgacttccaaaaccagcatttcaccttcgaacagttgtgggtgggactgcctgccctggcggctgtgaccgtcggagtcacgctgcttgccttggtctccgcgctggccgccctacgccgcgtggccttcaccccgcttggcgtgacgcaacgtaccggacaacccatgccgtccgcatggcgcgcactgattttccttgccgtgttggccgtaggctacctgctgctcaacagcatctccgcattcgcacacttgggtcagatggtggtctacgccatcatcttcggcgtcttcttcctcggcttcgccatggtgaacgtcgtcggtacctgggtggtggcgatgcgcgccagatcgcgtgcgaaacacccgaaggacgcggccactatgattgccatgcgccgtatcctcgacaatcccaagcgtgcttggcgcaacgtgtccggcgtggcgctcgctgtgttcatcgcggggatgacgtcggtgtgcggattgctcgccaccggaatcggaggcaaccacgacccgttcgacccatctatgctgtacatgcgcgatatagcgatgggtggtttcctgacgctcgcctttgccgcggtgctcgccgccgtcagttccggcgtgatgcagacgagcaacgtctacgaccaggccgacgagtaccgcatgcttgcgttggaaggcacggatgaggcgacgctcgacaaggcacgcatgatggaagtgatcaccccgctcaacacggtgatggccgtttcattagggtgctcggtgttgttgctgtttccgattctggcaacgtcgttgctcaatccggcttcgttgcttacgttggccgcgggaatcggcttgtgttatgcgctgatggtgctcggagggtgtgccgcgaatcatgcggcgcacgggctcggtcatgccggctaccgtacggacgattgatggtctcgccgcggcggtcgtggataccgcggcgaggactggcgaggtcagccgagcagcaccgcgatgattgcgatgaagatcggtgaggtcagtgtcgagaagagaatgccgtcgcgtgcgaacgagagacccacgttgtaccgcgccgcgtagttgtagacgttctgcccggtcggcagggcggcgagcaccacgcacgcgtacaatgtggcgccgcggaagcccatcacgaaatacgacagcaggaacgcgataattggcatcacgatgttcttcaataccgccaccgtgaacaccgcgggaatattcgacttgtcctgcagcggcttcgtgccgtgcaacgacatgccgaatgccatcaaaatcattggcactgcggaatcgccgatcatgtcgatcggatcgtaaatacagtccggcaccacgaaatgaccggtttttgcggaaatcgcggatacggcgatgcccagcagcgaaccgataagcagcggctgatgcagcggctgcttcagaatctccctcgtggagaccttgcctttggtggtcacatcgagcacggtcaggccgatcggtgtgaacaccgcctgttgcatgaccagaatcggcgcgaccaaagcgggattgcccagaatgtacgtggcgatcggcagaccgatgttgttggagttcagatacagcgaattcaacgcgccgatggtggcatccgccgccttcagatggaagaacagcctattgaggatcagaaacaccaatccgaccagcacggccgagaagaacgccacaacaatggaggagtggaatatctcgaagattctctccttggacaggatggcaaacatcaggcacgggctcgatacgaaaaagctgaacctgttgagcaccatctgcgcggtaggtccgcctatgcgcatgcgcgcggccacgtaaccggtgccgatgacgatgccaatgacgcagaagccttccaatgcgcttaacagaccaggcatgacactcttcctttcgttctcggccgttggtttggccgctatccagtgttgcaccatgcatatggataacatccgatccgtctcaaaagcgttgtcgaacggcgatgtcggttccggtggtgctggataatgggcggtatgaacgaacttgagattggattttccgcttccgccaccaggcaggagcagctgaacgagctgatgacccagatcatgggaacctattccgtgagcgacgacgaagggccgttgaccgacgcggtcgaagcgtttttgaataaacagcagcatctgacagtgcgcaggcatggcgatacgctggtcgcatccacgaattttgggcgtgagcgtcgcgtgatcctcgccgggcatctcgacacggtgccggtgatcgacaatttcccgccgcgttggctggaactgggcgatccgctgattcgcgaggatgttgccgccggccatgggcgggagcgcgtgatatgggggcgcggtgccaccgatatgaagggctccgacgcggtgatgatgtatttggcggccgcgttgacggatgcgaaatacgatctgacatacgtgttctacgaccacgaagaggttgccgccgaaaagaacggcctacgcaaggtggtcgaggcgcatcctgattggatttccggcgattttgcgattatcggggagccaactgattgcggtattgaaggcggctgcaatggcacgatgcgtttcgacgtgatcacgcacggcattgcggcgcattcggcgcgtgcgtggatgggtaggaacgccatccacgcggccgctgagattctgagccggctgaacgcttatgaaaatcgtgcgattgaagtggatggcctgacgtatcaggaaggcctgaatgccacgctgatttcgggcggcaagggcacgaatgtgattcctgatgaatgccgcgtgcatgtcaactaccgttttgcccccgacaagtcgttggctgaggcgaaggcgctgatgattggcgcggatgccggtgcggaattgggcaatggcgagcatgttgccacaggtggcgtattcgaaggcttcggcattgaaatgaaggacgagtcaccttccgcacgtccggggttgacgtcgccgctcgcgcagtcgctggtggaattggtgcgcgagcgcacggggcgtgagcctctggccaagcttggctggacggatgtggcgcgattctcgatgctgggcattcccgcggtgaatctgggtgcgggcagtccgttgctggcgcacaagcatgacgagcagctgccggaatcggatctgctgctgatggccaacttgcttgaagactggctgaagtagctgtctgctgcctttttctgcctcctgtttctgcctgctatcggctgtttgttgttttccgtcttctgtctgcacaagtcggatcggctgtctgcacgagtcgtaatctgtgtctgcatttctcgcgaatcgtgatttctttcgacttgtgcagacggagcaacgacttgtgtggacggggcctgggatttgcgggcggggaaagcaggcggtgagttgcaggatccggaaaatttcccgtcatgtcacgttccgttgttttttgtgtcatacttatagacggtggttctgcaaatcaccaatgcatccgatggcgttgatcccctcgcgtgaagttcatgtgtgtccgcgagcgctggtgtccgccgtcgcatgatgaggacttttgacggaagttgcttcctacgggcgccatgatgcgcggccacggtgagagcgtggtgtgagaaccgtatgaggcctaagcgtgggcggcgcgattgcagcgtgtcgtcgaggagccattgtgcctaataccagtgagggcttcgatcaggtcgaagcttcggcatcgcctgagcatgccgtgaatgttgtgaaattcgagtcggtccagtccgatcctgccccgcgtcgccgtcgtggcggtcgtcgcgtggtgcgtggcgtgggagctgccggtgcgtccttggagttgaaggtcgaggagcatgcttcggctccgctgttcgaggagccgaagttgccggttgcgcaacctgcgcatgataccggtgattccgctgattccgagggtatgatccgtccgacccgtcgccgtcgtcgtccggttcagtccgatgatgatgttcgtgagattgccgacgaacggccgacgcgttctcgtcgccgtcgttcggtgcaggttgaggatgagcaggacgaggatcgtccgtcgcgtcgtcgcagccgtttcgccgatgatgcggatgagtacgatgagatgccgcgtcgtcgcgcttccgtcgatgattcccatgatgaggagtcgtctgtggagcgtgccttggatgccgtcgatatgttgccggaaggccatgaggtccgccacaatccgcgtccgatgatgtctctgcttttccaggagccggttttgccgtccgttgcggattcccgagacagggcagacgacgatcgcgacgattcccgtaatgaccgcggcgagcgtaatgatcgcaatgcgcaggaccatgacgatgagcaggatgaggatcgtccgtcacgtcgccgtcgccgccgcaatcgcgacgttgccgacgaagagcgttccgaagacaatcgcaatgaacgcgataatcgggataatcgcaatgatgatgcggacaatgacgaggaaggcggatctcgcaagtcacgtcgttcccgtcgtttgaacgcgcaggagcgtcgtgccgcagctgaagtcgaacagatcgaagaggatttgatcctcgacgatattacgtatgcgccgattgatgacgaaacccgcaatcgtcatgacgatgatgacgacgagcagccgacgcgcacccgtcgtcgccgtcgcagccgcggcaatcgtgaggaagccgacgaacagcagcgggacagcgatgaaggcgagtcccgtcgtcgccgtgaggacgatgacgaggatgaaggcacggtgacccgtcgccgtcgtcgccgtcgtggcggtgcgaagacggatgaggcggaagagccgctcgtgcgtcgttcccgcaagcagcagtacatcgacgagatcaccgacgtcgaaggttccacccgacttgaggccaagaagcagcgtcgccgtgacaatcgccgtgagcgcagccgtcaaagccagctcatggagcaggacttcctggctcgccgcgagcatgtcgaccgcctgatggtggtgcgcgaacgcgaacgccacacgcagatttccgtgatcgaagacaatgtgctcgtcgaacattacgtgtccgacattcaggaagtcgccactgtgggcaacatctatctgggccgcgtgcagaacgtgctgccgagtatggaagccgcgttcgtcgacattgggcaggcgcgtaacggcgtgctctatgcgggtgaggtgaactgggattccgcacggttggaaggccagcctcgccgcatcgaactcgcgttcaagtcgggggacccggtgctcgtgcaggtcaccaaggatccgatcggacataagggtgcgcgactgacctcgcaggtcacccttgcgggccgtttcctggtgctcgtgccatccggtggcatgacgggcgtgagccgcaagctcagcgagcgtgaacgttcccgcctgaagaacatcgtgtcgaaggtcgcgccgaaagacatgggcgtgatcattcgtaccgcagcggaaggcgcctccgaagaggcgatcaccaaggatcttgaaagcctggtgcgccagtgggaacgcatcacctccaagcgagacgaattcctgcacggcaagcgtccgaagctgctgcaaggcgagccggacgtggcgatccgcgtggtgcgagacatcttcaacgacgacttctccaagatgatcgttgaaggtgaccgcgtgtacggccgtatcgaggaatacctcgacaccatggctcccgacttgaaagacaagctcgaaaagtgggatccggccgaacatgaaggcaaagacgtgttcgacaagtggcagatcgactcccagctgcgcaagggcatggaacgtcaggtctacctgccgtcgggcggctcgatcgtgatcgaccgcaccgaagccatgaccaccatcgacgtgaataccggccgtttcatcggccgcggcaagagtcttgaggagacggtgacccgctgcaacctcgaagcttccgaagagatcgcacgtcagctgcgcctgcgtgacatcggcggcatggtgatgatcgacttcgtcgacatggtcatgccagccaaccgtgatctggtgctgcgcagactggtggaatgcctggcccgcgaccgtaccaagcatcaggtggccgaagtcacctcgcttggcctggtgcagatgacgcgcaagcgcatcggacaggggctggtggaagccttttccgaggaatgcccgacctgcaaaggccgcggattcattcttcacgacgagccgaccgtgtctgctgactatgacgatccgtacgccctcaagggcggcgacccgttcgtcaagaccaacaagcatggtcacggcacggacgtgcaggtgccgaaaggctcctcgccggacgtgaaggccaaactcgcgcagatcgcggcggctgccgtggccgccaacaatgcggaactgggcgaggaagcatagaagaataaatgattattccggtctgtcaacctgacacgccggaaacagacttgcggttgtacgcgggtatgtgtaaattagattgctggtgtctggccgcgaggctcgaacgtgccgggcagtaagctttccaagttaataaaggaacggatatgtacgcgattgtgaaggccggcggccatcaggaaaaggttgaggtcggtgacgtcatctacgtcaaccgtctcgaggctaagaagggcgaaaccgtggaattcccggttgctctcgttgtggacggctccaaggttgtcctcggtgccaaggatctcgccaacgtcagcgtcaaggctgaggttgtcaacgatgaggccaagggtccgaagatcagcatcatgaagtataagaacaagaccggcgttgctcgtcgcaagggccatcgccagcagctgaccgctgtcaagatcacggctatcgcctgattggcgcagggttagagtcaaggaccgaaaggaacagacatggcacataagaagggcgcgtccagctcgcgcaacggtcgcgattcaaacgcgcaatacctcggtgtgaagaagttcggcggcgaagccgtcgtggccggcaacatcatcgttcgtcagcgtggcaccaagttccacccgggtgagaacgtcggcatgggcaaggaccacaccctgttcgccctcaaggacggcagcgtgaagttcggcgtgcgtcgtgaccgcaaggtcgtcgacgtgattgccgcctgaaatacgcgcaattaacgcttacaagataaagccgcgcccgttatggacgcggcttttctttattttgatgattgctgaggattggtttccttcagcccgtcccaaacgtcacgtaacgttgcatacagttgcataagacatatcaaacggacaataatcggaccgtttcgaacaaacgattaaggtagatacatgagtgatttcgtcgatcgcgtgaccgtccatgtgaagggcggcgacggcggcaacggttccgccggcatccgtagggaaaaatacaagccgttggcgggaccgaacggtggcaacggcggtgatggcggttccgtgatcttcatggccgaccagaacgccaacagcctgttggattaccgtttcatgccccaccgcgaggctggaagcggcaccatgggcttgggagacaccaaagacggttcgaaaggtgccgatctgatcctgcccgttcctgtgggcaccgtgattttcgaagccaaagggccgcaaggcaagtctaagcatccgggcgagcagctcgccgatcttcgccatgccggagacaagttcgtggtggcggccggcggcaacggcggtcttggcaacgccgcattggccaaccgcacccgtcgcgctccgggattcgcgttgcttggcgaaccaggcgaggaacgtgacgtcattctcgaactcaaatccatcgccgacgtggccttggtgggcttcccctccgcaggcaaatccagcctgatcgcagccatgagctccgccaagccgaaaatcgccgactatccgttcaccacgctcgtgccgaacctcggcgtggttatggccggagacatgcggtacaccatcgccgacgtgccgggcctgattccgggcgcatcccaaggcaagggcctcggccttgaattcctgcgccacatcgaacgcaccgaaatcatcgcccacgtcatcgactgtgccacgctggaacctgaccgtgatccgatgagcgactacaaggcgctcgaacatgagcttgccgaatatgccgacaagctggaactgccgttgggcgcaatcccaatccccgaacgcccccgaatcatcatcctcaacaaggtcgatatgccggaagccaaggaattggccgaattcgtcaaaccggaattcgaaaaactcggtctcaatgtgtatgtcatctccaccgcatcccacgaaggtttgaaggaactcaactgggcgttggcggccatggtcgccgacatgcgcaaggaagtcgccgaacgcgaacaggccgaagaagaagcgcgcgtggtcatcaagccgctcgaagagccgcgcaaccgccgtcgccgcaacgacgaaggcggcaccgcgcttgacttcaccgtggaacgcaaggaagccggcaacggcgacgtctggtacgaagtgctcggcaccaagccggaacgttgggtcatgcaaaccaacttcgacaacgacgaagcagtcggctacctggccgaccgcctcgccaaactcggtgtcgaagacgagctgcgcaacaagggagccaagcctggcgacgaagtacgcatcggcaagggtgcgcgagccgtggaattcgattgggatccgaccattgctgcgggcgcggaaatgctcgacggtgcccagcttggcgcacgaggcgtcgacctgcgactgcaggaacaggacggccgttcgcagcgccgcaccaacgcggaacgccgtcgccagtaccacgaaatgatggatgcgcgccaagccgtgcgtgaagccatgatggccgaacgcaaggccggacactgggccgatccttccgtggacgacgaccgccatgacgaaaccagcctcttcggacgcggtgaaaccaccgattccgaaaacgtggaacaatagaagcagcaaaacgcccgctgatgtgccgattggcatgtcggcgggttttcttttcggccattcgaacgcctggaggaaccatgaacacgccatcgcaagcccaagtgcgccgcgccatcgccgaagcgcaaaccatcgtggtgaaagtgggatccagctcgttgaccaaaccaagtggccacctcgatccggaacgactcaacgcgctcgtggcggccctcgcacgcgtgcgactcatgggcgggcgcgtggtgctcgtctcctccggcgccatcgcagccggattcggctccctcggcttcgactcacgcccaaccgacgtggctgaccagcaggcgtgcgcggccgtcggacaaggcctgctcatggcccaatacgagaacgctttctcacaatacggactgcgcgtcgggcaaatcctcatcaccgtgtccgacaccatcgccccacagcaataccgcaacgtgcgacgcaccctcgaccggctgctcgacctcggcgcggtgccgatcatcaacgaaaacgattccctcgcgtccaacgaaatccgtttcggagacaacgaccgactctccgcattgatcgccaacatcgtagtcgccgacgctttggtgctcctcaccgacgtggacgcgctctacacggcacccccaagcgaacccggatcgcgacgcatcagctacgtgccgaacgtggaggacgcgctcgccaaagtgcaggtcggcggcaccggatcaaacgtgggtaccggcggcatggtcaccaaaatggaagcggcgcgtgttgcggcggtctccggcattcccgcagtgctcacctgcgcggcaaacgcaggcccggccatgatgggcgacccagtcggcaccgcattcgcccccatcaacgaccgtggatcatcacgccgcctatggatcgggttcgcagcacacccgcaaggcacgctcgtggccgatgccggcgcttccaatgcggtacgcggaggggccgccagcctgcttgccgccggcgtactcgaagtgcggggcgattttgccgccggagacgcggtgtggatcgacgatgaagcgggcaatcacctcgcaaaaggcctcgtaggattcgattccgaagaaatcccgcaaatgctcggccgcaataccgcccagctcaagcgtttcctcggcgaagaatacgcccaccccctagtccaccgcgacaacctcgtcttggtttaatccctttccctcttttgttcggtgccctgtaaatagcaatatgccgcccctaccggtcaaaagggaaaaggaattccaaaatgtgctaaaaggctgttgtttttcgggcgggagggatagcatggcaaacatgactatggctgactggcagactctttccgaacgtattaaccgcgtggctccgagcgctactctggccgttgattccaaagcgaaagcgatgaaagctgaaggaatcgacgtcattggatttggcgcgggcgaaccgaactttccgactccggctgcgatcgtcgcggctgcggccgaagcggtgcaggatccgaagaactatcgttacactccgacggcaggtttgccggaattgcgcaaggcgatcgcagacaaaacgttgcgcgactcggggtatggagtcgatccgaatcaggtgatcgtgaccaatggcggcaagcaggccgtatacgaatcctttcaaatcctgctcaatgacggcgacgaagtcatcattccgacgccgtattggacgagctatccggaagccgtgaaactggctggaggcgtgcctgtcgaagtgttcgcgggagctgaccgcaatttcgagccaagcttggaagacctggaagcggcacgtaccgaacgtacgaaggccatcatcgtgaatacgccgaacaatccgacgggtgccgtgtggaatccggaaaccgtcaaggcgatcggcgaatgggctgtggaacaccatgtgtgggtgatctccgacgaaatctacgagcatctgaactacgatggtgcaaaaaccacgtatatcggcgctgcagtgcctgaagtgcgtgatcagctgctggtgctcaacggcgtggccaaaacctacgctatgcccggctggcgtgtcggctggatgatcgctccgctcgacgtggcgaaggccgcatccaagctgcaggggcatatgacgtcgaacgtgaacaatatctcccagcgtgccgcgatcgcagccgtgtccggatctcttgacgccgtgtacgagatgcgtgaggcgttcgacaggcgccgtcagaccatcgtcgccgcgttgaacgatatcgaaggtgtgaactgcccgacgccgaccggcgcattctatgcgttcgccgacgtgagcgcactgctgaacaagccgctcggcaccagcaaaaccgcttatgcgagcacgtccgaactggctgcggcactgcttgacgaaggtcatgtggcggccgttccaggcgaagcgttcggcgctcccggttacttgcgattctcgtacgcgcttgccgacgacgacctcgttgagggcatgaagcgtatgaagcagtgggtcgaggactgatactggcctgactgagacttttcacacgattcgcaccgcggtgacatgccgggtgcgaatctttttttcgttgaaaaatagcggttttgggacatttcttgaaaaaccggttggactaagtcgcaaatacccgctattatttcgacttggcggttttgccgcttacttcttgcgtggtttttcgcacaaaatcctcgccagcaagtagaaacggcagagtacacctagggaagtggcgcaattggtagcgcaacggtctccaaaaccgtaggttgtgggttcgagtcccgccttccctgccaagcttcttacaacaagctcagcggaggattattatggcgaaggcaaaaaatagcgaaaaggccgttaagccgaacatcttcatgcgtcttggcttgttcatcaaacagattatcgacgaactccgcaaggtcgtgaccccgaccagcaaagagctgttcttctgggcactcgccgtgttcatcttcgtgctgctcctgatggcactggtcaccggcatggacttcggtctgggcaagctgaccctgtggatcttcggctgatcaacgacttgaaggtgaaactgcatgactgacgaagtgttttccgacaacctcgacgaagctccagaagctgatctcgaggccgtagctgccgttgaggagctgcaggccgagggtgaaagcgttccggaagtcgctgaggccgagccgactgctgaagctgcttccgaagagtccgcggaggacgagggcggcgaagagctggatgctggcgccaaggccgtcgaagacttctccaacagcctgcgcaccctcgaaggcaagtggtacgtgctgcacacctactccggctatgagaagcgtgtgaagaccaacgttgaatcccgtgtggcaagcttcggcatggaagataagatcttccagattgaagttccgatggaagaagtcgaaaagcacaccgaaaagggcaagaaggtcatcacccgcgtgcgtgttcccggctatgtgctgattcgcatgcttccggatgagaacgcccgtcgtattgtgcgtgaaaccgaaggcgtcaccggcttcgtcggtccgaccaaggaaccggcgccactgagccgcaaggaagtcgtctccatgatggctccgatgatcgcttccgaagcgctcaagaaggctggtgacaagccggccgccaacaagaagcgcgtccttgaagtctcctacgccgttggcgatcaggtcaccgtcaccgacggtccgttcaccaccatggcagctgtcgtctccgacgttgagcccaccacccagaagctcacggtgctcgtgtccatcttcggtcgcgacacgccagtggagttgggcttcaaccaagtagaaaaactgtcctgataagtctttgaaagaccccgcgcattgcggggtcttttttgtctgggggagtgggcacaataggaaggcttgtgtctggagggtttggcgtgcctgaatgagggtacggaatccgctagcacagcacagcaatatacgttgcggaaggaaccggacgcgggaaacctactccggtgccgctaccaccgcttctacagaaagaagaaccatacaatggctcctaagaagaaagtctcggcgcttctcaagctccagattcaggctggcaaggccaacccggccccgccgctgggcccggcactgggttcccatggcgtgaacatcatggacttctgcaagcagtacaacgctgccacgcaggacaagatgggccaggtcatccctgttgagatcaccgttttcgaagatcgttccttcaccttcattctgaagaccccgccggcggcagctctgctgaagaaggccgcgggcatccagaagggtaccgaaaacccgctgacccacaaggtcggctccgtcaccaaggctcaggtccgtgagatcgccgaaatcaagatggctgatctgtccgcacgcgacgtcgaagccggcatgaagatcatcgagggcaccgcccgctcgatgggtatcacggttaccgactgagaggagagggacaaatggtaaagcgttccaagaagtaccgcgaagcttctgagaagatcgatcgcaacaatctttacaccgctaacgaagccatcgctctcgtcaagagcatgccggagtacaagttcgatcagaccgttgaggccgtgctgcgcctgaacgtggatccgcgtaaggccgaccagctggtccgcggttccgtcaacctgccgaacggcaccggtaagaccgccaaggtcctcgtgttcgcccgtggcccgaaggccaccgaggctctcgaggctggcgccgacatcgtcggtgacgacgatctcgtgcagaaggttgccgacggcttcctggacttcgattccgtggtggctaccccggacatgatgggcaaggtcggccgcctcggccgcgtgctcggtccgcgtggcctcatgccgaacccgaagaccggcaccgtgaccatggatgtcaccaaggccatcaaggacatcaagggcggcaaggtcgacttccgtgttgacaagaatggcaacctgagcttcctcatcggcaagctctccttcaccgagcaggctctcgacgagaacttcaaggctgttgccgacgaaatcaagcgtctgaagccgtccaccgtgaagggccgctacgtcaccaaggcgaccatcacctccacgatgaacccgggcgtcccggttgatccgacggtcatcgcctgagcaatatagcttgcagatagcttctatatagcttgcaaaagacccgcatcctgccccatcgcgagatgcgggtcttttcatatatatcttgcgattatctatctcatttaataaataatgatcctgcaatcgtctgactatcaaagaatctcaatgaaaccagatatcagatagatattaaaacagagaagtgatgttcaacgatcgcgcatacggccaatcgcaagcgccgtcgtcaacacgtatgcgtcacgcgggtcggtcgcatcccaaccggtcgtttccgcggcacgcttcaagcgataacgcaccgtattcggatgcacattcaattccttcgccgtgttttccaacgaactgccgttgcgcaaaaacgtggaaaccgtcacaaacgtcggatcgtcgggattctcgccatgaagcacctgatacacgttctgatacaactcttcacgagcgtaatcatcgcccaacagcgcccgttccggcagcaactcatcggcacgcaacgggcgggacggcgacgccaaagcgggagccgcctgcaaggaaaacagggtttcacgcaacacgtgcgaagcgccggcgacaccggaacgcaccggactcaaatacaccgattcgtcatctttgaaagcgggcataatcgacgtgcaggtcacttcggcagtggcggcgccactctgacagacaagcgccagcagaaaactgccgtatgtgccaacaatcacatgttctccgcccagatcgcgcaccgccttacgcgcaacgagcgaagccgaagcgggactcgtttccggtgtgccgccaatcgcgaaacaatcgaaatccccacgccaaccaagcacattcatcaacgaggcgacgcgatcatccgtaagagaagtcatcaggcattcgaaagcgagccgttcgatggttgaatcgtcggtgtgccctgccagaaggtcgagaatgtctgcctgatcggagttcataagcgtcaagtgtagccgcccaactggcgaatcgctgaacggaaagcgtcaacgaggtgaagttcattcggggagtgccgctattatgccgcttatgagcgaagtcaaacaaactggaaagcgtggcgagcgtatcggcacattcctcagctggatgctggccgtgctggcatgcctttgggtggcatggtgttgcgcgatcgggccgttgtattggttcggcgatgggctttccgacttcggctggctgaatgtgctgtatttggtggtcgctttcgcgatatggttttcgatagttgtcgcattggtcagattcggccgcggccgtcgcgtacttccgcaatatttcgcacgacggcatgaaaaactatgcaacgagattgcaggaacgccgaccaccgtgcttggcattatgttgcgacacttgcatgatgccgcgcacagccgcccagggcgcgccctgcatgcagtgatcgtatggacggggcgcaaactcatccgctgcaccgactgttggtggaaactcatgctggtgttcgtaatcggctggctgtggattccaaccacgctattggccgcgttcggcgccgacattcgctcgcagatccgtgaattcagctgggccttgaaccagtggacgggcttgaaacagccatatatcggcttcttctcgttcgtgcccatggatatttacccgaccgcgcattacatgtggccggacaatcccacatatctgaccgaccagcacaatgtcgtgctcaccgtgttctacggtgccgcagcggcggtttcgcgctacttcaccgactccaacgatgcgggcatcgtggtgctcgcagccttgcaatggctgttcgccgcattctgctgttcggccaccgccaaccggttcttcaacctgccgtggcgcaggcttggcgtcggcacgttcgacttctcgcatccggaacgccacgattgctggaatatgcgcgattacgcgcatcctgaagcaggcgttgtggcacgcccttccagactgcgggccggtgcgaaaacacgattcatgatactgctgttcttcatggtgtgcccgcttgcggtattcgccacgatttccctgacgaaatcgccgctgttcgctttcgcattcgtatggtggttcggcgtgtggtacgaactgcacatgacacatatcaaagcgctgcccaccatcaacggcaagccgacgtacctacgcaaacgctcgatcatggccttcaccatctcaagctgcgtgatgctgatcagcgcgaaatacgcgtggtacatcattctcttcaccctgatcctggcacttatcaacgatcgcaaacgttggaaaacctatcttgtggcacttctgctgccaaccatcctcattcatggcggcatcgtgttcctcaccaacacgggcgccatcatcggcggcgaccccatcgaaagccgtggcatccaactgcagcagatcgcgcgcgtcgccaaatacaatccgaaaggcattccggcggacgcggcgaaaaagcttgaaccggtcttcaacctcgaccagatggccgaagcgtacttccggcaggacgccgacccggtgaaatcctccggcatccaatcgaagaaagtcagttacaagtggcgcaccgtcaccgaagacgacatgacaaacttcaacgaggcctggcttgaaatcgttgtcgcaaatcctgttatcgcgctcgacgcgtttttcgccgaatgcttcggctatttcgacgtgaccgacctgccatacgtgtcgatggattactacgtgaacaacgattacgtgcagaacgacaatgcgtggatccacctgtataaccacgattggcgcgatgcggtggccggcttcgcgaaaggttggggcaatattcccgtgatcggctgggtgacgcacggcaatctgtacgtaacgctgatgctgctggtcggcgctgccgaagtggtgttgcggcgatggcgctcgctgtcatggcatctgcccctgctgctgctcatgggcgtgatgatcaccgctccggccaacaatttcgaacggcatatgctaccggtcgcgttcgtattcggtttcgtatgcctgcaattctggcgcgagtcgcgtaatgcgcgatcggctgccagcgcgaacgtggccagtgcgcatgaggccagccaggtgcggcaggacgagtagcggctgcgttggctgctgcatgagctgttgcgttgcggcgacattgcgtcggcgcgccgcgctgtagtaggtaggaggtaatgatggcgattttggattcggctgcgatcatgccgcgtacatgcgttgcggcggatcaggtgcttgttttggatacggtgggatccaccaacacgtatgccgcggatttggtgcgtgcaggtcggctgttcggcatggatggcatggacggcattgcagggaacctcgtgtggagcgggcgtgagatcgtggttgtcgcggcgaacgagcagacggccggtcgcgggcggctcgaccatacgtgggccagtgtgccgggggagtcattcatcgtgtcgctggtggtgagcgtgccggttgcgattgtgcgcgattcgtccgtcaatggttggctgcagatgattgccggttgcgagatgcgtgaggcgattgttggtgcggtatgcgatttcggcggcacgctcgatgaagatgttttgctgaaatggccgaacgatatttttgctggcggcaagaaacttggtggcgtactcgctgaaatggtgccgattccggattgcggggatcgcgttgccattgtgatcggcgtcggtttgaatcttgccgtcgctcaggaacgattgccgatagataagtccacatcgttgcagttggttgcgcgcaatctgcctgatgcgatggtgttgcgcgatgcgattgccgtacgttgggtgcaaggattgcgctcgcggttggctgatttcgaagaggaccctcaccgtgaggctgtgcgcgcccgggaagcgatgaccccgatctgctggacgctcggcaagcagtgcgaggctcattttgtggacggaaccactttgcagggcagggctgtcgcgttaaacgacgacgcctccctgaccattgaggatcaggaaggcgtattgcatcgggtgagcacggccgacgtaggcgtgctcagtaagtaaaaaattacttgattgctgaaatttgccgcaatctcacttcagcttggcaagacctgcgaccacggcggaagcgataacggccttgaccgcatcgcctgcgacgaatcccatggaagccacggccacaatcggcagtgcgatgccggtaatggcggactgcacgatgaaaccaagcagatagtcaagcgcaatgcagccggcgacacaggcaaacaggtaacgtgcggcggtcagcgcgccatgcttcagcgaatcggtgcgcgcctcacccttcagcagcgacgtgacgatggccgccggcaggaagccgatcaggaagccggcgctcgggccaaccaatgccatggtggaagcgccgccggcgaacaccggcagaccgaccgcgccggctgccagatacatgagcatcgcggcgccggcctgcttccacggcagcatcagcgcggccagcatcaccacgaacgtctgtagcgtgatcggcaccggcgtgcccggaatcggcacggcaccggccgcggaggcggtccacatgagcacggcgaacagcgccggcttgaggatggatccgacagtgccgctggtggcggttttcagcgtggttttgagtgtcagcattgcgttacgcacgataattctccttggatgtgattgcattacgttgatgaatcgacgattgttgacagccgaaatgatggcaagcgcgaaagtgacgaaaatgcaaggtttgtcaacttatgcccccaatcgtaggcttgccaagtttcggtaacgtttgtggagccttacaaaaagattgcgtgtcttttgtgagaaacgagttcacgatttttcgttcgcgcgaccaaacttgacgttatgcctaaaaatgtcaacaaacttctggtggcgaatcgcggcgaaatcgcgcttcgcgtagtgcgcaccgcccgtgagatggggattcccacggttgcggtgtacgcggagcaggatcgccatgcacaatacgtgcagatggctgacgacgcatatctgctttccggagacacgtataaagacacctatctcaacgaggatctgctgatcgacattctgcagcgcagcggtgccgacgcagtgcatccaggctacggattcctttccgaagtggccactttcgcgcagaaagtgatcgatgcgggtgcggcttgggttggtccgaatccgaaagccctcgtggatttgggggataagatcaccgcacgtcgtgtggccacgttcgccaaagttccgccggttcccggcatttcccagtcgatttccgacatgcgattgctgctggatttcgcgcacacgcacggttatccgctcatgcttaagcgtaccgatggcggcggcggtcgcggcatcacgctcgtgcacaacgatgacgagctgcgcggtttctacatgaatcatgatgcgctgcagggcggtgatctgaacgaatatttcgtggaacgattcatcgacaaaggacgtcacgtcgaaacgcagtgcggccgcgactcgcacggcaacttcaccgtgtattccacgcgcgactgctccgtgcagcgccgcaatcagaagcttgtcgaagaggcgccggcaccgttcctttcctccgaggtgaccgaccagctggaaacctactctcgccgactgttcgaagccgtcgattacgaggggcttggcacctgcgaattcatggtgaccgaacagggcaaagtgtacttcctggaagtcaatccgcgtctgcaggtggagcataccgtcagcgaggaggtctgcggacttgacctggtgcgcgagcagctgactatcgccaacggtggggaactgaccgtgaaccatccgcctcgtggacacagttttgaactgcgcctgacctgcgaggatccggcgaagaacctcgcgccaagctccggcacgctggcctcgttgcgctggccgtccggcccgggcatccgtgtggattccggcgtggtcgaaggcgacaccatttcgccgaaattcgattcgatgatgggcaaacttgtggtcaccgcatctgaccgagcggcagcagtggcccgcgtgcgccgcgccttgagcgagctgaaggtggaaggcgtgccgactccggcaagcttgttcgaacagattttcaacgacgacgaattcaccgccgaacacggtgttgcatacgatgtcagcaccaaatggctggaacgcaagtacctcaacaaggaagccgcatcatcgcaaggcgggcagccggcgtccatgtctggcgcttccgaggtcgacaagaaggaatccagcgaaaccttcgtcatcgaagtcaacaatcgcagagtgtcgctgaccgtgccgaacgacatcgtcgccaacctgacgggcggtgccaaggcgcgtgacgcgaaacgtgccatccagccgctgcgtgggcagggactgcatcatgcgcagaaaaaacagcaaagcaatgacggccaatccggtgtgatcgcaagcccgatgcaggccgtcgtgacgcgtatcaatgtggccgaaggccagcaggtggccaagggcgacctgctcgtcgtgctcgaatccatgaagatggaaaactacgtgtacgcgccggtcaaaggcactgtcaccaagattttcgtagggcccgcggcaggcgtggaagccggcgaaacgttgatgaccatcgacgtgaccggagcgaacggtacggaagccggcgaaaacggcgcaactggcgctgctgttgacggaaccgcaaccgacggaactatggaagggggtaagtgatgactgatatcatcgcaagcccggccgtcaaagaagccgtgaagatcgtaatggaacagcaggagcgactcggcaaaaacgcggccgaagccgtctccgcggccgacctgccgggcgcatcccagccaatccgcgcatccgtgcttcgtgcggcgcaactcgcgcacgaagcggaagatcatgcccgcaatcgccagcatgtcaaaggcaaactgacggcgcgcgaacgtcttgacctgctgcttgacaccggttccttcgaggaaatcggacgattctgcggcggcgacatcaacggcggacgcgcgggagcggcggtcatcaccggtttcggcgaagtgttcggacgcaaagtggccgtatacgcacaggacttttccgtgcgcggcggcacgctgggagtcgcggaaggccgcaagatctgccgattgatggacaaagcgctcgacttgaaagtgccgatcatcgcgcttatcgattcgggcggcgcccgcattcaagagggcgtggccgcgctgacgcaatacgggcatctgttccgtaaaacctgcgacgccagcggtttcgtgccgcagctctcgctgattctcggcccatgcgcgggtggagccgtgtactgcccggcactgaccgatctgatcatcatgacccgtgaaaactccaacatgttcgtcaccggtcctgacgtggtcaaagcggccacaggcgaagtgatcagcatggacgacctcggcggcggatatgtgcacaacgccacctccggtgtggcgcactacctgggcgaagacgaagccgacgcgatcgactacgcacgaaccgtgctcgcctacctgccgtccaactccgacctgcagccgcccacctacgcgtacgccgcaacccgcgccgaccgtgacgtggccaagcgacttgccaccatcgtgccggacaacgaccgccagccgtacgacgtgctcgacgtgatccgctgcatcgtggactacggcgaattcgtgcaggtgcacgagctgttcgcaagctccgcagtggtgggattcgcctgcgtgaacgggcatccggtcggcattgtggcaaaccagccgaacgtcaacgcgggcatccttgacgtggattcctccgaaaaagtggcacgattcgtgcgtctgtgcgacgcgttcaacctgccggtcgtcaccttggtggacacccccggatacaagcctggcgccgaacaggaacatgcgggcatcatccgccgcggcgcgaaagtgatctacgcctacgccaacgcgcaagtgccgctggtcaccgtgatcctacgcaaagccttcggcggagcctatatcgtgatgggatccaaagccatcggagccgacctcaactacgcgtggccatccagccaaatcgcagtgctcggcgcggccggagcggtgaacatcatccaccgcaaagacctgcagaaagccaaagacgcaggcaaagacgtcgaagcgctccgagccaaatacgtggccgactacgaacgcaccaccgtcaacgcgaatctatcgctggaaatgggcgaaatcgacgccatgatcgaccccgagcaaacccgcgaaaccatcatcgaatcgctcaaactgctctccagcaagaaacgcgtgcgcaaaaccaccaaacaccacggcaaccagccattgtgacgggcgcaaagtgcgcggatgaatcgtaagcaaacgtaaacgcaagaacacatcgcaagatttttgaaacaagtaaggaacatcatgaacaccttttttcttgaccgactgaacagcgagccgcacgcactcgccttcgcaggccaatccaccccatggccggtgacgctcgccgaccagagcgccaatccggtgctcgacgaagccctgcatacccacgccgacgcagcccaggcactgctgtacccggtgtcagccgacctgctcgccaccaccgggcgcccggtcgacctgtttggattcgaaccgaatccggcacgactcggcgctgccgcagcggcttccgccagcgttccgggcattgctctcgcccagttgggtgcgctacttgacgctgcttccctcggctacaatcccgccgttgccaagccggttgccgtgctcggtcactcccaaggcgtgctcgccgtgcacatggtgcaggcgatcgtcgaagcgggttccattgaggcggcttccgcgcaaatcgatgaaattcttgcgattgccacgctgatcggcgttgccggcacccgtcaggcgcgtcagcttggccttgccgcacgtcacggcgaagccacgccgatgctgtctgtcaaggacatcacccgcgcccaggtggatgcgctgatcaagcgtgtttccggtgcccgaggcccgatcgccgtggcagtcaccaattccgccacgcattatgtgctctccggctacccggaggatctggccgcgttcggcgtggaagtggccaaggagcacaagcaccaggccaagctgcgcgaagagaaggtgcgtggcggtcgcgtgttcgaaccggtgctcgaataccttgacgtgaccctgccgttccacagcccgcttatggccgaggctgtttcacaggctgtttcatgggcggaatcctgcggaatcaacgccgaccacgctcgcgagctcgccgccgaagtgctgctcaaccatgtggattgggccgcccgcgtgcgtgcgctcatgaaatccaccgatccgagcgccctgtgggtgttggactttggcccgggaaccaccgttggcaagctgttctccaccgttgcccaaggcactggcgtcggcgtggtggaagcctccaccgtggccgatcgcggcgaactctccacgctggaaaccctgccggagcgcacccagaactggacccgcttcgcaccaagcatcatccacacctccgccggagacaaggtgcgtaccgcattcaccgaactgaccggcaaagcgccggtgctgctcgccggcatgaccccgaccaccgtggaaccggaaatcgtggcggcggccgccaacgccggctactgggcggaactcgcaggcggcggtcaggtgaccgccagcgtgttcgaccgtcatgtcgccaagctggaagaagagcttgaagaaggccgtaccgttgaattcaacgcgatgttcatggaccgctacctgtggaacctgcagttcggatcccagcgcatcgtgccgaagaagcgtgccagcggcaccccgatcgacggcgtggtcgtgtccgcgggcattccggaacttgacgaggccgtggaactcatccacactctcaacgccgacggattcccgtacgtgagcttcaagccgggcaccgtcgaccagattcgccaggtggtgcgcatcgccaaggccgtcgctccggtcaaggtgctcatcgaagtcgaaggtggttccgcaggtggacaccattcgtgggaatcattggacgatctgctgctgagcacctatgccgaagtgcgtgaacaggccaatctggtgctcgtggtcggcggtggcatcggcacgccggaacgtggcgccgactacatcaccggcgaatggtccgccgaatacggtcgcccgctcatgccggtggacggcgtgcttgtcggcaccgccgtgatgaccgccaaagaggcgcacaccagccctgaagtcaagcagatgctcgtcaacaccccaggcattcccgccaagggagcagacgtcgatccgttcgctccgctgggcgaacagtgggtgccgagcggccaagccaagggtggagtcacctccggcctgagccacctgcatgccgatatgtacgagctggaaaactcttccgcgcgttgcggacgcctgctggtgcgcgtgatgaagcatccggaagagctggaaagccgccgtgaggaaatcatcgatgcgttgaacgccaccgcgaagccgtatttcggtgacctgaaggccatgacctatctcgcatgggcgcagcgtttcgccgatctcgctttcccgtggatagatgaaacctatgccgatcgcttcctgcacttgctacagcgtatcgaagcccgcgtcaccacgaaggaaagcggcgaattcgcatcgctgttcgcatcccgtgccgatgtggaatccgatccgcatgcggccatcgccaagcttgccgaagcctatccgcaagctgatgaactgaccgtcaccccgatggatgaagcttggttcccggtgctcgtgcgtgaatacccgaagccaatgccgttcgtgcccgtcatcgacaacgacctgctgcgttggtggggtcaggatcagctgtggcagtccgaagactcccgttactccgccgattccgtgcgtattattcctggtccgatctccgttgcgggcatcaccaccgttgacgaaccggtcgccgacattcttggccgtttcgaagaggccatggtcaagcgcgtttccgccgaatcgccaagcgcagacaaaaccgcgtttgcccagctcggcgcggcatcttccgcagaagaattcattcgcaaatccccgaacatctcgtgggtgggccatctcatggcaaacccggcgtacggtaccagcaacggtgacgccaactacgaaatccgcaagatttccagcgaaggaagcatcgaaaagtacgatctcgacattcatctcgatacctactgggacaacgatcctgacagtggcgcatccaagcacgccgtacgcgacatcgtcatcccgctgaacgtggacggcaacgaatccgggctcttcccggtggtcgaccgcgaccgcctgccggaacacgtgtaccgcatgcttgccgacaccgcgggcatcggcaatactgccatcaccggcgacaagctcaccgccatgcccgttattgagcaggtggcagacaaagccgcccatccgttcggacaggcgcataccagctacacgctgtccgccaacctcggcttcgaccatgaagcggccaccggcggcgcgctgccgagcaatctggtgccgtcgcgcatcgcaccggacgcactcgtcggaccggcatggcccgccatctacgcggccctcggatccgtatacgtcaacggcttcccggtgatcgaaggcctgctcaacgcagtgcatctcgaccatctcatcgaactggaagtcagcgaagacgagctgctcaagcacactggcgaacagatcgcactgaccagctgggccgaaaactacttcgaatcggcatccggccgtgtggtgaccatccacgtcacccacagcgcacaagacggcaccgtgcttgccaacgaaaccgagcgtttcgccatccgtggccgcgcatattccgacgcactgccgccggaagcgccggactacggcggaatcgaagcggaaatcgaaagcactccgcgccgactgctgcgccgcgtcaaggtgaccgctccgcacgagatgaccgccttcgcccgtacttccggcgatttcaacccgatccacacctcgcatcgtggcgctgccgtttccggtcttgcggcaccgctcgtgcacggcatgtggctctccgcaaccgcgcaatacgcggtgcaggcgcttgacggcaagggtgcgcactacgaaatcgcaggctggacctacaacatgtacggcatggtgcagctcgacgacgaagtggaaatctccgtcgagcgtgtcggacgcgtggcacactccggcatggtgctcgaagtgaccagccgcatcgacggcaatatcgtgtctcgtggcaccgccatcgtacgtgcgccgaagtccgccttcgtctacccgggccagggcatacagcagcagggcatggtgctcgacgagcgtgccaagtccccggccgcacgagacgtgtgggagcgtgccgacaaggtgacctgcgagaagcttggattctcgatcctcgccgtcgtgcgtgacaatccgaaggaactgaccgccaacggcgtgacctaccgccatccggaaggactgctcaacctgacccagttcacgcaggtggcgctcgccaccgtggcattcgcccagaccgcacgtctgcgcgaagccggcgccgacatttggccggcctatttcgcgggccactcgctgggcgaatacaacgccctgagctccttcgccggcgtgattccgctggaaaccgtgatcgaactcgtgttccaccgcggttccaccatgcaccaccttattccgcgtgatgcgaagggtcgctccaactaccgcatgggtgcgctgcgtccgaaccagttcggtgtgggcgacgacggcgtacgcgaatacgtcgaatccgtgtcgaaggcttccggcgagttcctgcagatcgtgaactacaacctggctggccagcagtatgccgtggcaggcaccatcgccggtctgaaggcgctgaaggccgattccgaccgccgcgtagccgaatatggcggcaagccggcattcatgctggtgccgggcatcgatgtgccgttccattccacgctgctgcgcaagggtgtgccggaattccgcgacaagcttgacgcgctcctgccgcagaccatcgattaccgtggtcgcttggtcggacgctacattccgaacctggttgcggctccgttcgaaatgacgaaggaattcgcggccaagattctcgaagtcgtgccgtccgagcgcattcaggccgctttggatgatccgcagatttgggattcctatgctgctgatgatcagaagctcggtcgattgctgcttacggaactgctgtcttggcagttcgcctccccggtgcgttggattgagacgcaggctctgctgttcggttccgccgagcagggcggtcttggtgtggaagagtatgttgaggttggtctcggcaatgctccgacactcgccaatcttggtgccaagacgttgcgtctgccacagtttgccggtcgcgatgtgacggtgtacaacgttggtcgcgatgagggccgcgtatatatgaccgattccgattcgttggttccggaagaagatgccgacgattctgcagttgcggctgcggcttcttctgcggctgctgctccggctgttgcctcagctcctgcggcggctcctgcagccgttgcggaagttccggttgccgcagcttccgctggcgctccgtctggtgccgccgttgcggatattccattcaaggcatccgatgcgatcgccacattgctggcttactcggccaaggttcgccccgatcagatcggcgaaagcgataccaccgatacgctgactaatggcgtgtcttcccgccgtaaccagttgcttatggacatcagctccgaactgggcgtggcttccgtggacggtgccgccgaagcgacggtcaaggcgctgagcgctttggtcaacaaggtcgctccgaactacaaggcgttcggtccggtgctgtctgacatcgtgcgcgaccgtgtgcgtggcatgttcggtgccgccggtgtgaagctcggccagatcaccaagcgtgtgaccgatacatggcagcttggtgaagggtggacttcccatgtggtggctgcgctcgtgctcgaaacccgtgagggggccagctctcgtggcggtgatcttgcctcgttgagcacggatgccgcttccaatgcggccgctgccaacgcgctgatcgatgcggccgtgcagaaggttgccgccgacaagggcatcgccgttgccatgccgagcgctggtggcgcagctggcggggctgtggttgattccgccgctttggacgcgttcgcggccaaggtgaccggtgccgatggcgtgctcgcctccacggcgaagttcgtgctgaaccagctgggcgttgccgctccggttgccgaagaaactgctgatgagaacgcggctgttgtggctgcggtcgaagccgaactcggtgctgactggccgaagcaggtcgaacctcgttttgacgagcgcaaggccattctgttcgacgatcgttgggcatccgcacgtgaggatctggcacgcgcctactacaacaacgatgaatccgcattgaacggtagcttcatcggtctcggcaagaccattgccgacgaagccgcctggtatgcaggcaagagcgacaacgcggatctgaaggccgcattcaatcgtgtcgctgccgaagcaggagaaaacgcttccgaatcggcggaaaccagccgtttcgctggagatatcgccgtggtgacgggcgtggctccgaactccatcgcagcccaggtggtcaacggcctgcttgcaggcggtgcgaccgtggtggccacctcgcacagcttcaagccaagcgtgaaggcatgggccaagcagacctaccgtgagcatgcggccggtgacgccaagttgtggctggttcctgcgaacctgtcaagctaccgtgacgtggacgcgttggtcacttgggtcggcaatgtgcagaagaagacttccggtgcgaccaccacgattctcaaacctgcttacgagccgagcctgttcttcccgttcgcggctccgccggtgcatggcagcctcgccgattccggcgaactgttcgaatcccaggctcgcctcatgctgtggggtgttgagcgtgcgattgccggacttgcgaagatcggtgccgacaccgatgtgcagcataagttgcatgtggtgttgccgggatcgccgaaccgcggtattttcggcggcgacggtgcctacggcgaagtgaagagcgcgtttgatgcgattgtgaaccgtgctcgcgccgaaaaggtgtggtcgagccgtgtgaccttcgcccatccgaagatcggctgggtgcgcggcacgggcttgatgggcggcaatgatccgctggtcgaagtggtggagcgtcacggtctgaagacctattccaccgccgaaatcgcggtagaactgctgaacctttccacccgcgaatcccgtatcgaagcagccaaggccccgctcgacgtggatctgaccggcggactcggcaacgagccgatcgacatcaaggcactgcgtgcggaagccatggaagacgcggcccaagcggaagcggcgaatgccaagaacgcaatcgcaagcaacgaatccgataccgcggccaagacgctcatcaaggcgctgccaagcccgcgtgctccgcgtcaggccaaggtcgatcttgccgattggcagaacgtcagcgcacgtccggaagacgaaatcgtcatcgtgtccgtgggtgaacttggcccatggggctccggccgcacccgtttcgaagccgaactcggcatccattccgacggacaggtggatctgtctgccggcgcggtgctcgaactggcatggaatatgggcctgctgacgtggaacgacagccccaagccgggctggtacgacgttgatggcaacctcgtgcctgaggaggatatcgcggaacgttaccatgacgaggtcgtggcccgttccggcgtgcgtccgttcgacgaaggcatgggcaacgactacaaggacggcactgacgaggaagaggccgaggtgttccttgaccacgatgtgaccttctcggttccgactcgtgagattgccgaagagtacgtcaagcttgatgaagcgcacaccagcttcgcggccgatgtggaatccggcgaatggaacgtgacccgccatgccggctccatgattcgcgtgcctcgtcgcgcggccatgacccgcacggtcggcggccagttcccgaagggcttcgatccggtcaagtggggcattccggcttccatggtcggcgatgtcgacaagatcgccttgtggaacatcgttactacggtcgacgcctacctgtccgcaggcttcacgccgaccgaaatcctcgaggcggtgcatccgtcgatggtggcctccacgcagggcaccggtttcggcggcatggcctccatgcgcaagctgtacttggatcgcttcctcaaccatgagattccgaccgacattctgcaggaggctctgccgaatgttgtcgcagcccacgtgatgcagtcctacatcggcggctatggcaatatggttcagccggtttccgcctgcgccacggctgccgtctcccttgaagagggtgccgacaagatcgcgctcggcaaggccgacttcgtggtcaccggtgcgatcgacgacatcggtgtggaatccgtgatcggcttcggcaacatgaacgccaccgccaattcggaggaaatgtacgccaagggcatcgacgcgcgcttcttctcccgtgccaacgatcgtcgtcgtggcggattcgtggaatcccagggcggcggcaccatcctgctgacccgtggcgatatcgcgttgaagctcggcctgccggtcgccggcgtaatcggattcgtgcactcctacgccgacggcgcgcacacttccattccggctccgggcttgggtgcgcttgcagcgggcatgggcggcaaggattccaagctggtgcgcgatctggctcgtcttggcgtcaccccggatgacatcgccgtggtttccaagcacgatacgtccaccaacgccaacgatccgaacgagtccgaactgcacaacacgttggcccacgccattggccgcgccgacggcaatccgctgttcgtgatctcgcagaagacgcttaccggtcatgccaagggcggtgcctgcatcttccaggtcaacggtctgacccagctgttcaagtccggcgtgattccggccaatgccgcccttgactgcgttgatccgaagctcatgcgcgacgaccacatggtctggctgcgcgaaccgttgaaggtcggctccgtcaaggctggtctggccacgtcgctcggcttcggccacgtgtccggctttgcggcgatcgtcaatccgggcgcgttcgaagcggccgtggccaacaccgcgggcgtcgaggcactgaatgcatggcgtgatcgcgccaacgagcgtttggcggccggccagcgtcgtcttgaggaaggcatgatgggtcgcgccgcgctctacgagccgatcgacaaccgtcgtttccatgaggatagccgcggctacaacgcgcacgaggtggagaaggccatgctgctcgacccgaacgcgcgcctgggcgcctccggctacttcgaagcctgattcccgcgtctgagcgcctgaaatttctggcgctcagacgcgcgatcatcaaaatcccgtatctgtcgcaatctcagtatttcgcggcagatacgggattttcatattcttgaatcactctactttccgtctgcacgatttccgtttggtgtcgtattttcacttgtgcagacgcgaaacgaggggcgcgcaatgcgggtggcagaggatgaagcgcttaggtaggatggtgtccttgcatgaaagcgaagtgtcgcccgcctgtttcgcggaagtcgacatggttcgtttcttcctgaaaactttcgaaaggctggaaaatgctgggtttagggcatgacgtcgtggatgtgcctgcgttcgccgagcaactgggcgaaccggggtcgcgcatgcgaaacctgttctccatgcgcgagctatggcagaccgctcaacgtgtgcaggtcaaaagggacggtgaggcggtgcatcttgcggcccgatgggcgggcaaggaagcttttctcaaggcgtggtgcgaagcgatttcacgcagggcaaatgccgatggagacattgcctatccgtacacgctcgacgattttccttgggcgcgcatcgaaatacttgacgattcccacggcgtgccccgtgtcatgctctcgcccgaggtgcgacgcaagttgcggcaatcgttgggattgccggttgatggggatgatcaatcgtgcgcaatccatatttccatgagtcatgacggatccgtcgcatccgcggtggtgacgatagaagcgtgaccgcaagtgattgcgtcaatcgattgacgtcaatcgcgacaacacctcgaaccggtttgataaaaccgtaaaatcacgctacactggtgccaacgtcgtggcaacgaacgctgcggaatccaactcataacaacgaagttccctgggaagaggagtcaaggaatggcacggtccaaatccgacaaagcatttgacgagcgcgtcgcacaatatagtgaggaactgcgcgaactattgacggatctgtatggggagcaggccgacgaagccttccgcaacctcaccgagctgatggccaaagcccacgatgcgcgccccgccgatctgaagcgtctcgacaccaagcgtctcgccgatccggaatggtacaagcgcggcaacatgttcggtatgaccatgtacaccgatctgttcgccggggatctgaagaaactcgccgacaaagtgccgtacctgaaggaacagaaactcacctatctgcacctgatgccactgctgaaaatgccgcatccgcagaatgacggcggttacgcagtggaggatttcgacaccgtcgacccgtcgctcggcaccaacgaagacctcgccgcgctcaccaagaaactgcgtgcggcgggcatcagcctgtgcctcgacttcgtgatgaaccacaccgcatccagccatcgctgggccaaagccgctcaagcgggcgatccgaaatatcaggactactactactgccacgacgaccgcaccatccccgaccagtatgacgccgtggtgccggaagtctttccggccaccgcgcccggcaacttcacctggaacgagcagatgcacaagtgggtgctcacctcgttctatccgttccagtgggatctgaactaccgcaacccgaacgtgctcgtgtcggtgctctccagtgtgcttggcctcgccaatcttggcgtcgaagtgttccgcatcgacgcggtgccttacatctggaaggaactcggcaccaactgccgcaatctgccgcaagtgcacgccatcgtgcgtatgctgcgcatcgtgctcgaatgcgtctgcccggccgtagtgctgaagggcgaagtggtgatggcccccaaggagcttgccgcctacttcggcacgccggaaaagccggaatgccacatgctttacaacgtgtcgatcatggtgaatctgtggagtgcgcttgccagtggggacgtgcgcctgctcaaagaccagctcgacaagcttaacgcgctgccggagaactgctggttcgtcaactacctgcgctgccatgacgacatcggctggggcttggacgagccggtggaggagagcctcggcatcgacccgctcaagcataaggaattcctgtaccacttctacgagggatcggtgcctggcagctgggctatgggagagctgtacaactacgacgaggcatcgaaggacgcgcgcagctgcggcaccacggccagcctgtgcggtgtggaacgtgcgctgatcacgcatgacaagccgctgctcgacatttcgatgaaacgcgatctgatgatgcattccgccatgtcgttcctgcgtggcttccccatgctgagctgcggcgacgaaatcgtgcagctcaacggctgggaatacaaggaggatcccgatcgcgtcgaggattcgcgcaatctgcatcgcagccccttcaattgggagaatgcggccaagcgcaagcaggcgggcacgctgcagaagcagatgtgggacggtttgaagagcgttcgtgagatgcgcgacgatcccgcgttcgctccggaagcatgggtcactacttgggatgcgtataatgatgcggttcttgcggtggtgcgccacgttgaaggacgtacggtattgggattgttcaatttctcgtccgcacgtcagatcgcgcgtcttgattcggacggcgatatcgagcttcctgccgaagttgcgttggagccgtaccaggtttgcgtggtcgaaaaataattattacgatttcgacttgcgattgttgagggagtgtgtataatggctcgagtcgtttcgtgttggcttcggctggcatagacggtgcgcggatgtagctcaatggtagagcctcagtcttccaaactgattacgcgggttcgattcccgtcatccgctccacacaatcgttagagaagaagaaaggcgtgcttgacggcacgccttttgcatatctgccgtacgattgcttcgacgactgggtatgctggacgtgtcgtgacagcggtgcggcaatcgcaatacaacggagcgggtatggcacaaacgcaaggcaacaaggtgacggaagtcgtcgacggcgtggtcgaacaggtcgacgtttccaagcatccaacggcatccattgaggcgtccgatctttccttggccgatatcgaacggcgcaaatcgcatccggggcattgggcgctgttcatcgcgctggtgctggtggctttgatcgcgccttactggtggggacgtgtcatcgcagtcaaggatgcggcttggatggtggccaatctcagcttcctcgatcccaaaggcgtggcgctgatttcgtggacggtcaccattatggcgatggccggtttgggattgatggttgcggatgtgaagaaatggctgtggggcacggttttcgtggtgggactcgccgccgaacagttcgtcgccggcgtatgtctgctgagcttcaacttttggaacgccacctacgtgatgtacggcgattcctcagggctggccaacgcggcgaaccttggcattatcgcagccggatgcggtgtcgccttctatgcggtgctctgggtcggattgctggtatgcatcaaaaaggaatcgaaattcaatgtgctgacgcgcagttgggcatcgttcctgctgttcttcgcgattgagatcatcgcgctcgccgtggtgttgttcggaggtctgctgaacgtggtctgatccgccatttgttgtggattcgatttggtctgcccttcgtgtatgatttccccttggcgtgtttcgcccgcggatagagagcgcgccggtattggaccggcagcaccgcgcagcaatataaggaggatgccgtggcacttacggctgaggaaaagcaggaaatcatcaagacttacgctacccacgagggtgacaccggctccccggaggtccaggttgctctgctgaccaagcgtatcgctgatctgaccgagcacctcaaggagcacaagcatgatcaccactcccgtcgtggtctgctgctgatggtcggcgatcgtcgtcgtatgcttgattacctcaagcgcgtcgacatcaaccgttaccgctccctgattgagcgtctgggtctgcgccgatagttacattcttccgcccgaatgccttccttggcgttcgggcgtttttgcatgacagccgcgttgaggaaaagacagtttgaaagcccaaggtttagggtgcatgaggtctagaatctaaagatgaggaagcgacgaaggtaacgtcgcgtcacgcatgcagaaatcggttggagtccgctgaagaggactgccgatagttggtaaaagaaaagaaaaaggaggaaccctatggagggtcccgaaatcaaggctgttgaagccgtaatcgataatggttcatttggcaagcgcacgttgcgcttcgagaccggtcgtctcgcccagcaggcggatggtgccgtcgccgcctatcttgacgatgattcgatgattctgtcgaccaccaccgccggttccagcccgaaggagaactacgacttcttcccgctgaccgtggacgtggaagagaagatgtacgccgccggcaagattccgggctcgttcttccgtcgtgaaggccgtccgagctccgaggcgattctggcttgccgtatcatcgaccgtccgctgcgcccgctgttcccgcacacgctgcgcaacgaagtgcaggttgtggaaaccgtgctcgccgtcaacccggacgatgcctacgatgttatcgctctgaacgctgcttccgcttccaccatgatttccggtctgccgttcgaaggcccggtttccggcgttcgcctggctctgatcgacggccagtgggtcgctttcccgcgttggagcgagcgtgagcgcgccgtgttcgaaatcgtggttgccggccgtgtcgtcgaaaacggcgacgtcgccatcgccatgatcgaagccggcgcaggcaagaacgcctggcacctcatctacgacgaaggccagaccaagccggacgaggaagtcgtcgccggtggtctcgaagccgccaagccgttcatcaaggtgatctgcgaggctcaggccgaactcaagaagatcgctgcgaaggaaaccaaggaattccagctcttcccggagtacgccgaagatctgtacaaccgtatcgatgagatcgcccacgccgatctcgacgaagccctctccattgccgagaagctgcctcgccaggatcgcatccatgagatcaaggagggcgtcaaggccacgctcgccggtgaattcaccgacatggacgatgccgagaaggaaaaggagatcggcaatgcgttcaaggagctgcagcgccagatcgtgcgtcgccgcatcctgacccaggattaccgcatcgatggccgtggcctgcgtgacatccgcaccctgtccgctgaagtggacatcgttccgcgcgtgcacggttccgcactgttccagcgtggcgaaacccagattctgggcgtcaccaccctgaacatgctcaagatggaacagcagatcgacgcactgtccggtccgcagtccaagcgttacatgcacaactatgagatgccgccgtactccaccggtgaaaccggccgcgtcggctccccgaagcgccgcgaaatcggccacggtgcgctggcggagaaggctctcgtgccggtgctgccgaaccgcgaagagttcccttacgccatccgtcaggtctccgaagccattggttccaacggttccacctccatgggttccgtgtgcgcgtccacactgtcgctgctcgccgcaggcgtgccgctgaaggccccggttgcgggcatcgccatgggcctcgtgtccggcgatgttgacggccagcacatcttcaagaccctgaccgatattctcggcgccgaagacgccttcggcgatatggacttcaaggttgccggtacttccgagttcatcaccgctctgcagctcgataccaagctcgacggcattccggctgacattctggcctctgctctgcagcaggccaaggaagcccgtaccaccattctcgaagtcatcaacgagtgcatcgatggtccggccgagatgagcccgtacgcaccgcgcatcatcaccaccaccgttccggtcgacaagatcggcgaagtcatcggtccgaagggcaagatgatcaaccagattcaggaagagaccggtgcggagatcgccatcgaagatgacggtaccgtgttcatctcctccgaaggtggcgacggcgctgaaaaggccaagcagatcatcgaccagatcgccaacccgcacgttcctgaagccggcgaaacctacaacggcaaggttgtgaagaccacctccttcggtgccttcgtgaacctgaccccgggcaccgacggcctgttgcacatctcccagatccgtaatctggccaacggcgagcgtatcgacgccgtcgaagacgtgctcaaggaaggcgacaccgttgaggtagtcgtgcagggcgttgacgatcgcggtaagatctccctggccattccaggcttcgaagatcaggaatcctccgctccgcgccgtgagcgttccgatcgcgatgaccgtcgcggcagccgtggccgtcgtgatgaccgtcgttccgatcgtgacgatcgtgattatgatgatcgtccgcgtcgtcgtcgttaacccctgaccctctccatgccatggagatgcgctaccagctgcgccatagccccaaagtctgccctgcaaactctgtataatatacatcgcagacataagtcacgcaaatttcggcgtgtcgcccgcactgaggaattggcatgagtaaaaccgcactacgcaatcaccttatgtgaaccttatgcgggcgacatgggaagtgcgccaccagcgacattagttactacttgcatctcccgtcgagccggtagtaccgtcggtggatcccgacgtgccagtgccagtcgaaccatcggttccgctgtttccggatccggatgatgagccatcaccagtggtgccggacgtgcctccgtttgagccagtgccgttggacgaatccgttccgttctggctggaaccattgctggaattatcggatgacgacccgctgtttccggacgtggatccattggtattgctcgatgtgccgttggaagtggacgagtcggtggatccgttggtggttttgtcgctgccgtccgtggtggtttcgtcgttcgaatccgtggaatcggacttaggcttttgcacggggggctgcccgtcgccagtctgatagtcatcggtatttccatgcgaaggtacaaccttctcatgcaccacgtcacgcaccacggtgtccgtcccctgaccgccggtgaaagcaagaatcaatcccgcgctcactcccacaccaaccaaagcactgacgaatgcgatgatcgccggagcgtacttgctatgcaaccaattcgaggaacgctgcccagcatgctgtactcgggcatcatgcgcgcttccgagtgttccggtcttaccggtaactacgccaacatcgctgacgccacgctgtccgttcgggaaaacggaagtctcccctgccccggcaatatcgccgagcgcacgagtcgcatccgcatattcctgtccggaggaaatgacgcgcggtaaaccggactgcgctaccgcagccgtatcggcagacaataccatcgtgacatccgacgcaacaggagacgatccaataatcctcgtctcatcatcctgttcggaagagccaagcacctgcgtttcatccgcagctcgctcattcgaaaccgtctcgctactcgacgggaacggcacggcctgttggatcttctcccctgatgccttcaaaacgttcttgtagacctgcgtggcaaccgcggaaacaaccgaacccgcggccacaccaatcaccgatcccgcgataccaattttcgcggaaagtaggaatgacgtgaccgccgccagcgcacccgcgcaaatcgacgaaaaagagattcccttaaaaaagtttttcacaagccatgacgatagctaatttcgctatgaaagtactggcgattctgtgaaaagcttgaaaaagcggtgacagaccagcgtccgacatcatgtatcggccggctacaggctggctacaggctgggatgctcccattcctcggaatcggcgatagcgggaccgtgattgtagtccatcaaacgccaacgcaatgtggaaccgatctccaatggaatgagccgcacccagtgagcgttgcgcatcgacaaaatgtcggcgaaatcgccatgcgcatccgccattcccagcagcgtctgcaacgtttgggaaatccatgcaccatgcgagaacacgtacaagtccgtgtcggatccggcacggaacgcccaatcgttcaacgcttcgacgccacgacgtccgacttcctccttgggttcggcaccgtatttgagttcgccgccacggaattcagcccaggaacgatagtcttccgggtaccgttgcgcgagttcctcaaccggaatgccttcccaatcgccgaagctgcgttcacgcacgcggatgtcgggatgcacttccaagcccagcgggtcggcgaacgcatgcgcggtggctgcggcacgccccagatcggaacagatgaccagccggttcggaatatcgggacgacgatcaacatacagttcacgcaatgcgtcggccgtctggcgaacctgccattgtccgacttcgtcgaggggaatgtcgatctggccttgcagacgatgctgcgcattgtaggcggtacgtccgtgacgcaccagcgtgatggcgtgcacgtgttccggtactgcgctgttatgctcaagttcgacgttttgaggcatgctgctgctctccgttgctttctcgattatggaatgtttgcgaaaactgcttcgcttgatatgaaaacatgccttccgcatctatacgggaaggcatgttcatacgtgttattccgcggtttccgcggtctcttcgtcggaagtctccggatgttcgagctgcaggtcgatgctcgggcaatccttccacaagcgttcgaggcgatagaagtcgcgggactcctgatgcatgacgtggatcacgaaatcaccatagtcgagcagcacccactggccttcggtcaagccttcgcgggaacgcggttgacgcttgccgcttttgagatacaggtccttttcgatctcttcggcaaccgccaacacctgacgttcgttcgaagcggtggcgacgagcatcgcgtcggtaatggccaatggttcggtgacgtcgaaggcaacaaggtcggtggccttcatacggtcggccgcggcggcggcgatgcggatggcgtcgatggaatcttgtactgccggcatattcagcgctcccattcgggcttccagccctctactacatgttgtgtgttttcggaatagaccatggaatcgtccggaacgtcgtggcgtaccacggaaccggctccggtagtgacgccgctgccgacttcgacaggggccacgaacaggttgccggcaccgacgtgcacgttcgatccgatggtggtgtggtgcttgtgcacgccatcatagttggcggtgatggtaccgccgccgatattggtgtgctcacccaagtcggcgtcgccgacatagctcagatgcggcaccttggtgccgttgccgatgtgcgccttcttcatttccacaaaggcgccggccttggactcctcgccaagatcgttgcccggacgcaggtacgtccacggaccgatgttggccgcgcgaccgatgtgggtttcctgcacgcgggaacgctccacatgggcgtcggcatcgatgaccgcgctgataagtgttgtgtatgggccgacctgcgcgccctcgccgatcacggtctggccttccaggaagcatccgggaaggatcaccgcatcgcgttcgatacgcacgtcatcttcgatccacgtggtttcagagtcgagaatggtcacgcccttacgcatccaatgctcgcagatacgcttgttgtgagctttggcgagcgctgcgagctgcacgcggtcgttgacaccttcgacgctcaacgggtcgggggcggcgaacgcaccgacggcaccgttggctttggcggtttcgagtgcgtcggtcaggtagaactcgccttgggcgttgttggatttgaggttggcgatcgcttcagccagcagtttggcatcgaacacgtagacggacgtgttcacttcatgcacggccagttcgctgctgttggcgtccttctgttccacgatgcgcagcacgttgcctttgctgtcgcggatgatgcgaccatagccagtaggatcgtcaagaatggtggtgagcacggtggctccgttgccgctttgctcatggaaggcaagcagctggttcaacgtgtcggcgtcgagcagcggcatatccgaagctgcgatcagcaccgagccgtcaagaccgccttgctccttcaactgcgtcatggcgcactgcacggctcgcccggtgccgggaatgtcgtcctgattgacgatggtgacacgctcattgtaggagcgggccgcttcggcgactcgttccgcctggtagtgcacgaccacggccaacgtttcagggtcgagcgccgacacggagtccatcacacggttcaaaaacgtctttccggccaaagtgtgcagcactttcggcttgttggaacgcatgcgggtgccctcacccgccgcaagaataatcgcggcacttaatgccatgtctaatctccaattcctccggctctcacaaatccagacacgaagccagttatccgacgttccatcttaaaacgagccctccctaaacgcaaaacaaccacgtctcggaatgacttgtggagcgctggaatgtcagcatgcgtgcctcggaatgactaccgtctgatagacgactatggaaaacagcaataactacaaggcgttgcgccggagacggagcggatagattgatgtccgacatgaacgtgggggtatctcacgtaatgtatcaccattttttgggaagggaatgatagtaatgtcagacatcgcatatgattggatcgccctcggcgtagccgcgatcctgttcgtcatcctggcgtttctcaaacgtaagaaaaacgcgggtttcaccacacgcgtgttgcttgcaacggcattcggtatcattttgggaatcgctttcaacggccacactgattatgtcggcgcggtgggttccatctggtccaacgcaattaccgcactggtggttccgctgctgctgttcagcatcatctccagcatcacgaaccttggagagtccatgcgcttaaagagtattggtgcgaaaaccgtattcttcctgctgcttaacactgacgaagttgaatccaatccacttcttcaaagcgttcttccctgccggagtggtcgcgttcacctcggaaagcagcatcggcacgattccagtcaccgtgcgtcagttacgtagcgcaggcgttccatgagatatcgcctcgttcgttgccggaacggagccctcacagagggcaaatatcacgaatgacgccaaatccgattcagccaacgtctcccaccaacagagcggtttcgctctgaacttcgcacccaatgcaatgttctccgccagtggagatgacgcctgctgcggcacgaagccgaacaaataatccatccacaaatcaacagacacctgtgggagaataccggatcgaagtgttcgaacgacgttaggctgtcagagcatgccgagcagctcggcctcgtcacgcatggcgcggtacagcatccactcctgcctggcgtcggacaatgcgcggtgctcctccatgtcggcgatgtggtagtcgacgatgagggtggaaactttgtggcttcgtttttccggatgcagtcgacggctgaggtccagagtgtcgacgaaatggtgcgcaaagcgcgcgtctcgctccgagtaagcgagctgtacagcattgtcgaggaacgacatgtcgaaggacgcattgtgcgccatgaccacggctgtgtccgaacaccagcgtgcaaactcatccatgacttcacgcacatccggtttgccgagcagcatgccatcgtcgattcccgtcaaaccagtgattcttgacgggacgtgttcgaacgggttgatgagctggtcgaattcgtcaaccagctcatcattacggattttgaccgcgccgatctcaatgagcttggcacctttgcgcacactcaatccggttgtttccgtatcgatcacgatgtaatccgtgaatcgtccggacaacgggtccaaacgtcgggaatcgccacttctatgcgctgccattcatctcacctctgctctttcatttgcgatgtatagcttaatcattccaacctgactttcttagccggggaaacataacaaaaaaaaagatcctgcagcatgacgctacaggatcaatgaaccgttattcaggctttaccgcaaagctcgttcagcgggtcggagcgaccgtgaccgggcaacgctggaagctcttgagatcgacatagccggtggttgccatggcacgacggagcgcgccaatgtaattggtggtgccgtccgcattgtggctggggccaaacatgatatcttccagggtgccgacggtgccgacgttcgtgcggaagccgcgcggaagcgtctgatgacgggcttcggcaccccaatgcatgcccttgcccggagcttcctcggcacgggccagcggagagccaagcatcacggcatcggcgccaagcgcgaacgccttgatgaagctgccggagtcgcccatgccgccgtcggcgatcacttggacgtaacggccgccggactcgtccatgtagtcgcggcgggcttcggccacgtcggcgatggcggtggccatcggagcgtgaacaccgatggtgttgcggttcgcggatactgcgccgccgccgaagccgacgagcacgccggccgcgccggtacgcatcaagtgcagggccgcggtgtagttggcggcgccgcctacgatgacgggcacatccagatcgtagatgaacttcttcaggttcaatggctcgtgatcctgggagacgtgctcggcggaaacgaccgtgccgcggatgacgaacaggtcgacgcccgcttcgagcacggtcgaataatagtcctgcgtgcgctgcggggacagggcgcccgcaacggtgacgccggcgtcacgaatctcatgcagacgctcgacaatgagctccggcttgatcggctcggcgtagatctgctgaatacgctcggtcgcgctttcggccggcagttcggcgatctcgtcaagcagcggctgcggatcgtcgtagcgggtccacaggccttcgaggtcgagcacgccaagcgcgcccatcttgcccatggcgatggcggtggccgggctggtcaccgaatccatcggagcgccgataaccggcacgtcgaattcataagcgtcaacctgccacgaggtggacacatcctgcggatcgcgagtacgacgggagggaacaatggaaacgtcgtccagagagtatgccagacggcccttcttgcccaaaccgatttcaatttcctgagacatgttttcaaggctaatgctcagcaatgacagtatgcaagagcgtgtcacctgccgccacaccgtttttttggacattaacaggtgccgttaacacgttcgttataagacaggaacttatcaccttcaatcccgacaggagggcaacacatggccaaaatcaaggtcgaaggcaaggtcgtcgaactcgacggcgacgaaatgacccgcgtcatctggaaagatatcaaggatcgcctgatccttccatacctcgacgtggatctcgaatattacgatctcggcatcgaaaaccgcgatgccaccgacgatcaggtgaccgtcgacgcggcgaaggccatccagcgtgagcatgtcggtgtaaagtgcgccaccatcacgccggatgaggcgcgtgtcaaggaattcggcctgaagaagatgtggaagtcccccaatggcaccatccgcaatattctcggcggaaccattttccgcgagccgatcgtgatgagcaacgttccgcgtctggttcccggctggaccaagccgattgtagtagcccgccatgcgttcggcgaccagtataaggccactgatttcaaggtcccgggggcaggcacgctcaccgtcaccttcactccggaagatggttccgagccgatcgaacatgtcgtgtacaactatggtgccgacggcggcgtggcccaggtgcagtacaacgtgaacgattccatccgtggtttcgcccgcgcctgctttaactatggtctgatgcgcggctatccggtgtatctttccaccaagaacacgattctcaaggcatacgacggccagttcaaggatacgttcgccgaagtgttcgaaaacgaatacaaagacaagtacgccgcagcgggcctgacttatgagcatcgtctgatcgacgacatggtggccagctccctcaagtggcatggcggctacatttgggcctgcaagaactatgatggcgacgtgcagtccgattccgtggcgcaaggcttcggctctctcggcctcatgacctccgtgctcatgacccctgacggccagaccgtcgaggccgaggccgcacacggcactgtgacccgccactaccgccgctggcagaagggagagaagacctccaccaatccgatcgcatcgattttcgcttggaccggcggtctcaagcaccgcgccgacttggataacactccggaagtcaagtatttcgccgaaactttggagaaggtcatcgtgtctaccgttgaaggcggtcagatgaccaaggatctcgccatgctcgttggtccggatcaggcctggcttgacaccgaaggcttcatgaacgctttggacgagaatctcgccaaggctctggccgaatgacctagccgaataacctttggctgaacggccagcagcaggctcaaaagggctggatatgtatggttcacacgcatatccagccctttttgacgtccggatattacaatcggagctcagcataggaatcatcattcgattttcatgaaggaaacggcatgacactgcaccgcacgaccgtgacgaaacgtctgttcgcactgttggcatcgacctcgctcatcatgaccatgggcgcctgctcatccgccaatgaaacgcaatcgcatgaaacggactcccccagcaccgccactgccaccgatgccggcaacgtggtgatcttcaccccttcggacggcatcaccatctcccagcagacgcctctgagcaaatgggagaagctggtgccggaaatcgtttcatcattgaaagacaatgatgtcaaaggcgccaacatcaccgtcaaagcggcgccaagtctcgacaagcaaagccaaagcgtgcaggattacgtggtgaatcacgtcaacagcaccagcgacgatgcggattcctccgacaaaaccactctggtagtggcgccggtggccgacaccaccgaatccgaccgccaatatggagactatgtgtcgcacgccatcacatggaatgggagctcctccgacgaagacgcccaggactacgcccaatccgcggaacgtttggtttccgcattgcagctcgctcaaaacgagggcatgaaagtcgtgttagtgtcgaacacgctgcagggtttcactccggatgtgtacgtgccgatgaccacggccgagcagatcggccagcttcaagccaaacagctggtcagcaagctcgagctcgacaaaaccagctccgacaatccgaagcatatcgaagtgctactcccctacgatgccgccaatgaaagcggcagcacagcggacgcgactttcgcgcaaggcgtgttcaaaggcatttggtcagtgcttggaccgtatttcaaagatgggaaggccgtttccccatccggcacgctgacctcgtcgagcacggaatccgattgggtgtccgtggcgttcgacgcggcgaaaagtgagcgggtcaaatccacgctcgccggacgtctcggcatggataaggacacatcgcgccatacccgcatcgacggcatcatctcctgcaatgattatgtggccggctatgcttccgaagagctcaacgatcttggatataccggttcggcggccgacatcaacccatccatcaccatttccggcatcgtagacaatatcaccggcaagaaagacctgaaaaaacagtccgttcccgatcctgcgcaggcgcctgaatccgatgacggcgattccgatacggaggataccagcgattcccttgacgagcagaactcgcaatggccgatcatcaccggttacggcgcctacgtcagctccataccgaatatcgtgaacggcaaacagtggatgaccgctttggaaaatcgcaagaccttagcatccgacatcgcacagacctgcgtgcagctcaacacgtcgggcaaacttgcgaagctgacgttcatctcatccgtcgccatggaagacatgaaagtgccgaccattcaggaagaggcgcttgcggtcagcgccagcaatctgaagaaaacgctgatcgaaccgggatatatctcgctcgccgaagcaggcttgtagaccggcaacaaggtaatccggattatcagacataggaaatccgacaagagatggaaaaagctggcctccgtcgaaccgccgcgacggaagccagctttttatgttgcggccggcacattcctaccgccgatcatcgcattctacttcttcggaacgtagatgacggtgtcgatcagcatgcggtagtgatcaaccaccgcctgacggcgtgccttcatgctcggcgtgaccaagccgttttcttcggtgaactcgtccggcacgatttcgaacttacggatcgattcggcacgggatgcgagctcgttggctttgttgacggcacgttccacttcggcgcgcacgatcggattgcgggaggcctcctcgagggatgccgcgcattccgcgcctttcgatgcaagccatgcgttcgtttcgccaagatccaacgcaatgatggccgctatgaacggcttgcggtcgccgatcatcacgcattgactcaccacgggcgacgtcatgatcgacgcttccatttcgcatggagagacgttcttgccgccggcggtgatgatgaggtccttcttacgtccgacgatggagacgaagccttcgtcgtcgatggaaccaagatcaccggtatgcagccagccgtcgacaatctgctgcctggtgacgtcgggattgttgtggtagccggcgcatacggccgggctcttgatgcacagttcaccttcctcgtcgacacccatggccacgccctgcagaggcagtccgatggtgccaatcttgtatccggaggtcggattgacgcttgacggagcgcaggtttcggtcatgccatagccttccagcagcggcagtccgacgccattgaaaaaatgcgcgatggatgaatcaagcggagcgcctccggaaaccgcgtattccacatggccgccgaacacgtccatgatcgaggagtacaccagcttgttgtacagcgcatgcttgagattcaagacaaccggaatgccttcgcctgactgctgtgcgtacgaccagtcgcgcgccgtctgcgtggcacctgcgaaaatacgtcctttgaggccggctccggccttttgcgacgccgcattgtatatcttttcgaagatacgcggcacggcaaggatgaacgtcggcttgaacgctttgaaatcagccaggatcgtcttcaagttgctggataggccgagcgagacgttacctgcgaagcagaagaactgcatgtagcgtgcgaacacgtgcgccagtggaaggaacagcagcagacgacggttcggcttcatcgcgatatcgggcatggagctaatgcccgaataggtgatgaacacgaaattggaatgggtgagctcaatgccttttggcgtgcctgtggagccggaggtgtacacgatggtggcgaggtccgatcctttgactgcatgttcgcgctcttggaattcggcgtcggacacggcatgtccgtattcgatcatcgtgtcgatcgcgccaagtccgatgacgtagacgtcgccaagattggagcattcgtttctgatggattcgatcttgtcgcgttgcgcgtcatcttctgcgaacgccattttgacgttggcgtcgttgaagatcattttgacctgcgcgggagaattcgtctcgtatacgggaacggtgagcgctccgatcgacatgatggccacgtcgagcgcagtccactgccagcaggtgtgagagatgatggacaccgattcgccgggcatgatgccttgggcgatcaggcctttggcgatggcgatgaccttggcacggaattcggtggcgctgaacgacgaccactcgccatgctcgttcttgtattcgaccaatgaatcgttcggagtgcggttcgctcgttcatcaagcaccgagaaaatgttcttatccgtgtcgatctgctgttccaaaggccgcgtgtattccttgtacatggcatttctcccctgcgtaatcgtcgtacatgtagcatcatagcctgagagcttcacttttttcgacgaggccacgacgtatggacaaaatcaatggttctgtcgacccctgtttcacaggcctttcaatccgattctcaccgtacgggttttgctttccggattggtgtattgccgtccttccgattttatcccccaatgcaggcaccgctcgtcgcaatggtcggattcgccctccacacgcgcgaaacgctccccttgcgcaacatgtgcgccgacatcgcgttccgcaatggcgggttcgaacgtcgaggtcaggccggaaaggtcgcctccatgccggatggtgaccacggctttgcctcccacgttgccgctgaaggcgatcacgccgtccgcgggcgcgacgatggcttcctgagggtccgcaagcaggtcgacaccccgatggcctggaagccactgttgtttcggcgcatcgtacttgccgaccacctgcgcgccgttcagcggccatcgcatcaggacggcgcaggaaccggacgcggtcgccgcattcgttttcgcatacgtcggttcggccgaccataggcagcacacgagcagcatgacacacgccagagcgcatacgaccatggtttggcgcaactgctggcggatgcgcttcttttcctcctgtgcgattctgttccgtcggattcgcctgcgatattcacgttcgtccatgatggctccttcacgttgctgtgtttgcgccgttgcgttgtgctgtggtaaatcgccagcatgacagtgtgaagttgtgcttgtccagctgaaacggccctgtggtcggaggatgagttatccacaggctccgggcgtgtctcggcatacgatggaacgtatgagcgataacacgtcacagcgcaaagcgttgcagcaactggaaagcgagtccgattacgatcggatcacctactatcagaagccttttatggtgctgtgggcggccgtgcaggaagcgtcaagcgaattgcaggacgattacgcgctctcccccgaactggcgcagttgtgggttgccgagcagatccgcaaggtgtcggactcgctggtggaccgtcttgcggaaacggctttggcgcacggcgagtcgaaatcgaatgtggcgcgcgcggccggagcaagtcccgccaacgcgttgcggcgctttcctcggctcaagaccgatggaccgcacgagcgcacgctgatcgacgacgtgcttgattcgttagagtaacaaaaagcccttgatttccaagggctttcatgtggctcctgcgactgggcttgaaccagtgaccgtccgattaacagtcggatgctcaacccctgaccctctccatgccatggagatgcgctaccagctgcgccatagccccgtggagctagccgggttcgaaccggcgaccctctgcttgcaaagcagatgcgctaccagctgcgctatagccccatagttgaaaaaaagcggccgcgccgctcttaatcaccgtgggcccgggaggacttgaacctccgacctcatccttatcagggatgcgctctaaccacctgagctacgggcccgttcctgctgcactgttaagcacaacgaattgaaataatacgcgaatttcagagaaagtcaatacaaggtgtgtcttcggcgtgtcgtgacataatgcagccatgccgaacaatcatcgtagccagcgtaacaacagtgggagagccagcaggggagtgcgcaaccgtaatcgcacgctatccgaagaaaccacgcaaatcgctggaatgacggtgaccatcgtgcgtaaagccatcaaaaacatgtacctgcgcatcaaaccgccgaacgcgcaaatcgtcatctccgcaccttctcgcatgtcgcaagcggcaatcgcacgatttgtgacggaacgcaaaccatggatcgaacgtgcgcgacgcaccatgctgcaagccaaggatgaacagatccgtcaaagcgatttcaatggtttggaccgtgtgaatggttcgcatggtccggataatctgaatggcctggaaaattcgggcggcgtgggcgatcgaaacaatccaggcgatcccaatagcttgaataatccgcgcgttttcgtgtggaacgacgcggcgaaggaacgggccgtacgggccatcaatgcgcaactgccggtgctgcttgcgaaatggtcgccgattatcgggcggaagccgacgcatgtcacgttacgcatcatgacgtcgcgatgggggtcatgcacgccgaaaaccggccgcatccgactcaacctgcaacttggtcttatggatcccagattcctggaatacgtgcttgtgcacgaaatgacgcacctgtgggaaaacgggcacggagaggactttcagcggcgtatgagcgcatatttgccgcaatggaggcaattgcggcgggagctgaaccgtcatgttgtgttgtgatgctcgcgatgctgttgcgttcgccgtcacgctgccatgctgcgatgagcttgcgtagggcgatgttgttgcgttgcctgtgatgttgaaatacttgcgatatcacgccactgccgtcacattgcgcggattgcaatgactagccacggcttacgcacgtttgataacgacgtataggtgattcgtatagctttttgttcataagatgtacagaacgcttaacatccgcgatttgcaagcctacaatcgtgacgactgaaacgtttgcgtgcaaacagtccacgcagaaagatcgaataagtgagggaggggtcgattgtggctgtattgagaaaagtcggcattatcggcatcggacacgtgggcgcgcatgtcgcaaatgccgtgctttccgcaggacttgccgaagaactgaagctgtgcgacatcaacgagcaaaaagtagtcagcgaatgtcaggatttaagtgacacgttgggtttctatccgcataactgcgtgatcggcaactacggcacgcaatacgagcagctagccgactgcgacgtggtaatcaacgctgccggcgacgtgaaaaccagcgccaaagatcgtgacggcgaactgttcgtcaccaccgacattgcacgcacctggatctcccgactgttcaacgcaggcttccacggtgtgatcatcaccatctcaaatccttgcgatgtggtcgcaaccgaaatctggcacatcaccggctacgatccgcgcaaaatcatcggaacgggaaccgcgttggattccgcacgactgcgcaacgccatcgcgaaacgcgtcaacgtggatcagaaatcaatcggcgcatatatgctgggggagcatggcaattcgcagttcgcctattggtcgaacgtgaacatcgcaggcaagccgcttgatcaactcgcacaagacgatccgcaacgattcgccctcgacaaggacgaaaccgagcaggacgcccgtcgaggcggataccgcgtgtacgccggcaaagagtgcacggaatacgctattgcagccactgcggcacgccttacgcaggctgtgctctgcgatgaacactatgcgaccgcctgctccacgctgcttaccggcgaacaaggcgaaagcggcaattacgccagcctgccgtgcatcatcggtgcgaacggcgttgaagaagtcctcaatcccacactcaccgaaagcgaacgggccaaattccatgcgtcctgcgagcatatccgcgccaatatcgcgcagcttgcatggtggaacgacgaatgccatcccatgctgcgcggctgaatctgcaataactcagcggatttaataacagagcagacttgcgattactgatgttgattgcataaaaaatcagcatttacataatcgcaagtctgttttattttcattttattttcgttttatttttgattatttcgtagctttcgcagcatcgccgtcaacagtatgcttgcggatttccaacgtttcgatacgacggccatccacttgcgtgacggtcatgtcataaccgtcgtcggaaggtagcacgtcgccgatttcgcccatctttccagtatgcgccaggaaatagccggcaaccgtctcgtacggaccgtcttccagctcaataccggtcaaatcggcgaaatcctcaatcgtcatgccgccttcgatcgtggcgacgccattgacgaacgtggtacgttccgtgcgttcgccgcctttctcttccggcagatcatattcgtcgcggatgtcgccgaccaattcctcggtcatgtcttccaacgtgacgatgccgtcggtgccgccgtattcgtcgatcaccacggccaggtgaatgcctcgtttgcgcagcagctcaaggcttggcagcagcttcgacgtgcccggcagggaaatgccctcgcgcgtcacgtcggcaaccgtcttcgcctcgggatcgcgaatgtcaagcaggtcgcgcacatgcacgaaaccaagcacatcgtcgaaatccttgccggtcaccggatagcgggaatacggcatttctctcacatatgcggccgccttctcaatcggcatatcgccatccaaaaaaaccacgtcggcacgcgggcgcatcacttcggccacaatcgtttcggacgcgtcgaacacgtcgtcgagaatcgtgcgttcgtccttgctcaagttcgtattggtgttgacgagtacgcgcagctcttcgtcggacacttcgctgtcggtttcgttcgggtcgaaaccaagcaagcgcacgataatgttcgtgttcttgccgatcagccaaataatcggcttgcacaccttcgcaaacacatgaatcgcaggtaccacggcacgcgcgatctgctcgttgcgttgcatggcgatacgcttcggcaccaactccgaaatcacgatcgaacagtacgaaatgatcaacgtcagcacaatggtggtcaggggagcggccacactcgtcggcacgccccaactttcaacgatcggcacaatataaggcgaaatcgacgattcgccgaacgatgcggaaaggaaaccgctcaacgtcacgccgatctgcacggtcgacaaaaacgtgttcggatctcgcgcgatctgtgcgacgcgctttccgcgggcatcctcctgttccatctggtcgatctgcgatccacgcaggctgaccaacgccagttcggtgccggcgaaaaccgatccgagcaacagaaaaacgaaaatcaggagaatgttcaaacctagagacatggttccactctatcggggcggtatgtcaaagtgtctgtatctcctgattttcttggattttctcaattattcttagattgcttagcttcggattgttcttttttggatctctgtttcgcaaatctccgttttccgaattgtaatccgtttcagaagctaagaacctcgactttgccggagtccagctggtaccttgcgccgacgatcatgagtttgtcggatgccagcgcctgctggatcgcttcggattgttccaccaagagttcgatggtgcgcgcgatgtgcacgcgttcgaaatcctcgctggattccaattccgactcgtgcgcctgccagattgagaaaccgacggtgcgcatcatgagcgaatccgaagcgcagatgcgttcgtcgatgtcggcaatgctgtcggcggccatcagcgaatcctcggcatcggcggtcagtttgtgcagtaacgcctcgtaatccttggaagcttgcttgatcgcaccgcaattctggtggccgagcaccaccagcaaacgtacgccgagcacggtcaccgcgtattccagggatgcaagcacggcttcgtcgatgatttgaccggccgtgcgaaccgtgaacaggtcgccaagaccggaatcgaaaataatatccgggcttacccgcgcgtcggagcagctcagtacggccgcttccggtgcgtgtgtgtccacaagtgctgcgcgtgcttcggcgccacgattcggatgttccggtttgccttccgcaaacctgcgattgcctgccagcatgcggctccatgcgccgcttgccgtaccttcgacctcgttctggtctacaaacagttcgtctgccattgactccacccctcattgttcaggctagccaacatcatacgttttggtctgaccgttcgctgggaaatagagcgatatctcgcttatgtatggcagatttcgtgttctgtccggtgatatttcgcttatgtatggcagtcccaaaggtgaaaaaccggaaaaatgtacccccgaagtgggtttttcgcatgatggtctgccatatataagcgagaaggctcatgacaaggctccgattctgccatatataaggcagatataggtatgaaaaagggtccccgatcggcagtgcgaacggggaccctgaaagaaactggctacaatcagccggtgttctgcaggcctgctgcgacacccgacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggaaaaataagcatacataatcctagcagggcaagtgctgtgagatatatgtactgcactgttctccttattttaggtagtcggagatgcaagggtatggtccttgtttatttattccgttgcttgaatctttgaagaaatcgatactctcaaatgtaatccctttatattgcttcacggtaattactttaaaatgaaggttaattctgtcttctttcttgtacttgttggtgatattttcattaaatttccattcaatatattcgttgtctaataaaaagaagagtgatgtattgttttcatcgagcgtcccatgttccggtgccatcgctgcttgatctggtgtatgagacatactggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgccaccaatttacagcaaaggctggagtggtcataactgtgcataggcaaactgagataattgtggagataaaaaaactcttctggatttcataatttcctccatgtgaaaatttaatctcaatcgacaatgattaagatattaagagtattctaatggaaaatgagtaggggtgcactttagggtgtgattttctagtgaaaatagcaaaggttctctctcgtggaagttacaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgccgagaatataagtctgaccgaaccagttgtataagcccacgatggctgtcggtgtcgcggcgtgggtaaacgcggacaggcgccgggttacgtcggatgattgggagtctgtcgctcggcctgcgtgcctgttttgtgcgctgtcgccggccaggctagggccgcgcgacgcgaacggggaggcccgcgccgtttatcggcacggaacctccccgctcgcttttgtcaggcggtcagccgaagatcagcccgtgttctgcaggcctgctgcgacaccggacacggtgcacaggatcaggtaggtgtagttctccttctgtccgtgcgtgagctcttccttgtccacgcgcttgcgtagcgagccgagggcgagcacctgagtggcggacagcgcatccacgtacggcgagcggatgcggatggcctggccgagcacgtggcggtgctgcagaggccacttgtcgcctacgatctcgagcacccacttgcgggtgagctccatctcgtcgaggaccttcttgttgaggtcctcacggtctccgagggcaaggtacatcttggcgatgcgctcgtcagtcttggccagcgacatttcgatgttgtcgatgaacgtggagaacagaggccattcctcatacgcttgacgcaaggtgttcaaatcgccgaactgttcgcacgcggtgcccaggccgtaccatgcggccagattgatgcgtgcctgcgcccaggagaagatccacggaatggtacgcagatcgtcgagggacttggctccaaggccacgtttggccggacgggagccgatcggcagcaggccgatttcggtcagcggcgtgacggtggagaaccacggtgcgaagccgtcggtgttcagcaggtcgaggaagcggttatgcgcggcctcgtcgagcttgttggccatgtcggcgtacttggcggtcatgtccgtattgcgcttctccacgcttggagcggactgcagcagcgttgcagccgcaacggactcgacgtggcggatggccagtgccgggttgccgtagcgtgcgaagatgacctcgccctgctcagtgagcttgaagcggcactttacggagccgaccggctgtgcgagtacggcacggttagctgggccgccgccgcggccgacggcaccaccgcggccatggaacagggtcagatcgatgtcatgcgattccgcccacttggcgatgcgttcctgtgcggaatgcagggccagggttgcggaggtcgggccagcgtccttcgaggagtcggagtagccgagcatgacttccatcttgccgccggtggccttcagacgagcctggacctccggaatcttgatcatttcctcgagtacgtctaccgagttctgcagatcctcaagctgttcgaacagcgggatcacgtcgatggttggaacatccttgggatgggagaacgccagacggttcagctcgtacacgtccctgatgttttgggcgctcttggtgaaggagatgatgtaacgacgggcggccttgatgccgttgcgcttctggatggaaccaagggcgcggaaggtgtcgagcacctcgtgggtcatcggctgcagttcgccacgctcaccgtgcagaccatgttcgcggatatcctccagcgctcgggaatgcacgacggagtgctggcggaactccatctcgaccatatggaagccaaaggtctctgcctgccagatgaggtcctgcagcgggccgtaggcggaacgtttggcgttggcttcggcgagggagcgctgcacgaccttcaggtcggcgatgtaatcctcgcaggagtggtacatgagatcagcatcgcggtcgatggtggccttcagacgatcggccatgaccagcatgacggcacggtgcagctccttggtggagatcagtgcggccttgtcggtcaggcgctcgctcatttccttctgatggttccacaggctcttgagctcggcactcggcggagtggtctcagcttccatcgtcaggttcttgccaacgcggcgggtctcgatttgcaacgcgcccagcacgtggtcgctgaacttgcgggccacctgacggctcaccttggcggtgacattcgggttgccgtcacggtcggagccgatccagcttcccgggtggaagaacgccgggcataccggcggcacgaggccagccttatctccgaggatccaatcgtcgaaacgacggtacacctgtggaatggtatagaacaacgtattgtcgaaaatatcgagaatggtttcagattcctcaaccggagtcggcttcttcagtgcgatcggagaggtgcggaacagcgcgtcaatctcgttgaagagtcgacgggagttttccttcttgtctgaaccgccaagcagcttgtgcgttgcgagcagctgggagatgcgacggattttgccttccacggctttgcggcgggcttcagtcggatgcgcggtgaacaccggatggaactcgagctggtcgagcagttccttggctttggccggacccatttcgttaatgagctggtggtaggcgcaggtcatttcgttcactgggtcgacggcttgggtgtcatctacggcggcctcacggctgtgcagcacggagacacggtagttctcctcgcataggttggccagatggaagtaggtggtgaaggcgcgggccagcagttgtgcctcatgcacatccgttttatcgatgatgtcgacgaccttctgcaggtcatcctgattcggattcgtatccgtcagaataccggagaagcgttcggcgctagcgttcagtgcgtgttcgcgcacttcatcgaacttggccagcagcttttcatcgaattcgccgagcacctcgcgaagaatctgcaaacacagatccatttcctctttgagggaagcgggaagatcacgctcctcggggcctttggtgccggtgccggacgagacgatagctgcgtcggcaggcgtgatctgttcgttttctattgtcatcagacctccttctccaaaccatcgggttgcccggtctgtcggtccttcgcggcacctccgcgattgttttggccgtctgttgcgagcccacagccctaagttcggtcggtaatgcacgaccattgtatgcgcggcaaatcgacagtttggttacggaaataccgaaaatgtccgcatcgtggtccagtggtgtccacaaggtgaaatcgacggaaatttcgaaaatcctccgaccagcccacacgttagacctgaacttgtgagcgcacaatacgaacatgaacatgagacgaatttcgatagcgcggaaaaaagcgcttcggccgtcagcaaattccatacacactccattccgctcgatatggaagatatcgaacgggattgggacaagccggtcgctgaagcgggaatcgcagcaaaagccagcgtgatcgtacgcgtcggcatgctcgatctcggcgcgggcaccggaagcttccgcgtacgcgaaatgatgcaccgcatcgcctatccgctgggcgtgcacgtgcgcgccgacgtgaacctcaccgacatcgaagcctcctgcaccgacggcaaagaccgtatcaccgaagtcgtcgacctgccaaccaccggcgtcaacacggaacgcatttggctgctcgaacacttcgctgactggttcaacgtgaacctcggcaaaggatcgatgtaccacagccaatccgacgtgtccgaaggacttatgcagcatctcgacaagcgtgatgcgtcgcaggtgtcggctgacctgtcgaagcgtcttcgcgaacgtcagaaagccgaacagaatcaggagggatctgacgatcccgtgctcgacgcgcttgaaatggtgacggaacgcgccgaagtgaccgataccaccgcgcagccgttgcacttgcgtgatatcgaagcggcaagcgagcagcataatcgcggtgaacgtgaagccgaacgtgaaaccaagcgtgaaactgccggtacggccaacgttacgtcaagcgaatcgaccacgaaaaaagcgcgcaaaaatcgcaatcacaagccgccaaaaggtcaatacgccgaacatttcgaccacgtcggaaaagaagcggaccaatcgcaaggcatcaccgttcgccaagcccacgaacgactcgacatgatcgaacgacgcaaacccctgtattcgccggcgttcgcgggattcgcctcggcctgcgcctgcgcatccttcgtgttcctgcttggtggcggtcccttcgacatgatcggcgcgttcatcggcgcgggacttggccactggctgcgccgccgcctgttcgcccaccacctcaaccagttcttcgtgacgttcgtatgcgtggccgtcgcggcactcgcctgcacgggcaccctgcgattgattggtattttcgagcccgtcgcattgcagcatgatacggcttacatcggtgccatgctgtttgtgattcctggattcccgctgattacgggtggacttgatatggcgaaaattgattttccgtcaggtattcagcgcgttgcgtacgtgttgtgcattattttgatggcgacgctcgcaggctggatggtcgcttcgatcgtgcatttgaatccggaaggattcgagccgttgggactcaatccggttgtcaattgcctgttgcgtttcgtgttcgcattcatcggcgtctggggcttctccaccatgttcaactcgccgcagcgcatgtgccttgtcgccgccaccattggcgccattactgacaccttgcgtttggaaatcgttgacatgggcgttcccgccgaagccggcgcattcatcggcgcactgctcgcaggcctgcttgcctccgcatggcgttctgcggttcatcgcagctggctcgccccgcatctcggctacccgcgcatctgcctgaccgtgccgtccatcgtgatcatggttcccggtttgtacatgtatcaagccatgttccacctcggccaattcgacaccttgaacgccctcgactgggctttccgcgcgttcatggtgattatctgtctgccgatcggcctagccatggctcgcgttatcaccgataagtcttggagatacgatatttgatccgtttcggcatttgggtgcgtaaatgagataaatgcgattgtcgcaatgttcgaccggtacattgggacaatcgcatattttttttcagaagagattcgaaagaaattcgtttcgacagagatttgaagaaagagattcgaaagaaattcggctagcaatctaagaagagagaattcatggttaccaaagatttttgggtgctgctggcgatggtcatctattttgtggccatgctcaccatcggcttcatctactccaagcggtccaattcctccactcgtcagtatttcgcgggtggtcgaggcgttggtccatggctgacggcattgagcgccgaagcctccgatatgagcggctggctgctcatgggactgccgggcgtcgcctacttcaccggtgccgccgacccgctgtggacggccctcggcctggctctcggcacctacctcaactggaagctcgtcgcacgccgtttgcgccgctactccgtggtggcaggtgacgcgatcaccattccggacttcttctccaaacgattccatgacaaacgcaatatcgtctccaccatcgcggcgctgatcatcctcgtatttttctgtgtgtatgtcggtagctgcttcgtgacggtcggcaaacttttctcgaccctgttcggctgggactaccacctgaccatggtgatcggcgctgccatcgtgttcgcctacaccgtgatcggaggctatctttccgtggtcgtgaccgacttcatccaaggcttgctcatgttcttcgcgctggcagtggtgttcatcggttccgtcgcatccgtcggcggcgtcgacaacaccgtcgccttcctcaaaggcattccaggcttccttgacggcacgcaaatggccacgccgattctgaacgatgccggcgagcagattgtcaaggctggccaggccatgttcggcgcgcctaccgaatacggcgtgatcaccatgatttccatgcttgcgtggggtcttggctatttcggcatgccgcaggtgctcgtgcgattcctgtcgatccgcagttccgaagagatcaagaagtctcgcatcatcgccactacatggtgtgtggtgtcgctggcgtgcggcgtgtgcatcggtttggttggccgtgcgatgatgccgacgcagttcgtcacgcagtccgctgcggagaacattttcatcgtggtttcgcaggcgctgctgccgagcttcatgtgcggcatcgtggtgtcgggcattttcgccgcgtccatgagctcgtcgtcgtcatacctgattatcggcgcttccgcggtcggtgagaatattttccgcggattgctctatcgcaaggccaccgatcgtcaggtgatgatggttgcgcgcatcacattgctggttatgttcattttcggcattgtggttgcgttcgatcagaattcgtcgattttccaggttgtttcgtatgcatgggccggtttgggcgcttcgttcggtccgctgatgctctgctcgctgtattggcgtcgtaccaataaattcggtgcgattgcgggcatgctttccggtactgcgaccgtgctgatctggcataatttcatcaagccgcttggtggtgtcttcgctatttacgagctgcttccggcgttcatcatctcgctgctgttcattgtggtggtgtcgctgctgactccggctcccgatgctgaagtgctgcacgagttcgatcattatcttgatgatcccgatgaccgcaaggtggatgacgatttggtcgcagcggaaatcgcttccggcgaaaagcgcgcgaaaatctaatcaaacataatgtggcacatgccactcaaacgcaacaaaggccggattgtataatacgcaatccggcctttgtcgatgctgaaacgctgtttaaagcgtgattatggtgtttctggagctttagtagcgcatacccatggcgtcgcgcacctgctccaacgtttcgttggcgatggcgttggccttcttgttgccttcggcgagcacgtcgcgcacgtaatccatatccttggcgagttcctcgcgacgggcgcgatgcggctcaaggaagctgttcaccgattcgatcacatacgccttcagcgcgcccgcaccggaatcgccgatctcctcggcgatctccttcggatcgcgaccggtgaccaaaccggcggtcgtcagcagtgcggaaacctgcggacgtgcgatcggatcgaacgtgatgcggcgctcggaatcggtcggactcttcttgatgagcttggcggtctcctgcgctgtggcgcccaacatgatggaattgccgtacgacttgctcatcttgcggccatccaagcctggaatctccggcgcttcagacagaatcgcggccggctcggggaacaccggatgcttcttggcgtagcgttcgttgaaacgacgcgcgatggtgcgcgtgatctcgacatgcggcaggttatccttgccgatcggcaccacattggccttgcagaacagaatgtcgcatgcctgatgcaccggataagtcagcagcaggccggtcagcgcatggccggaagcttccatttccgacttcaccgtaggattgcgatgcagctcggcctcagtcaccaatgacaggaacggcagcatcagctggttctccgcaggaacggcggaatgcgtgaaaatcatggtcttttccggatcgatgccggcagccatgtagtcaagcaccaaattgagcacattgtcttcgatgtgcgcggtcgtgtcacgatcggtgatcacctgataatcggcgatgatgatattcgaattcacgccgcgattctgcatggcgacgcgctcacgaatcgaaccaaaataatggccgagatgcagacgtccggtcggacggtcgccggtcagcatggtgaacttgcccggattctgttcgattgcggcgagcgttgcgtcggaacgcttcttcgctgcgaggaagctcgcgctcatttcattgccgacagcggtgatctgctgctcctgggtttcgtccgtcatacgtgtccttttcttaagaaaatcagcgattttatcgtaaaagtctgagccgacaacgaaatatggcacagcaagtggtactctcttgtttgatgaattgatagcacagtaatcctcagggggtcagatgggccgcggacgtcagaaagccaaacagcagaaaatagcccgaaagctcaagtacctgaccaccgacaccgattatgatgagctcgccaaggagctcggtgcccaggagcctggttcgggttcttttgatcctttcgccgatatcgaagcaaaatattctcacgatgcggacgctgaagatgagatttctgaagatgctcaggagtccgcgcaaaccgacgccgaggatgacctcgacgagtatgcaaagtgggccgcagaggcggcggcgaaggccacgagcggagagttcccggcagccaagtccgccgcgccgaagccacacaagcccatcccgatgccgatgcccagcgcactgaagccgaagaagcaggactgatcggcatatcaggtactttgtgaaaccgcgatgcggatatgcctgccaggtgtatccacatcgcggttttgctatgcgtttttgcgcctgtgacggtcttctcgcagcctgtcacaccaacggcagcaagctactcaaatcgtcgcgttcgccaacggccgtgatgcgtcctgcctccttctcctcagcccagctggtgatgcccgtggcgagtctcatccacacgtccggttccagttcgatcacgtccggcggtgtgagattatgcggatcggatgccggtccgtcgagaatcttgatggcaccccacggcgcgacacgaacttccacgcccgccccgggcgcttttttctccagcagatgcagcgagtagcgcaccgccatcgcccacagctggcgtggcaatcgtggagagaattccagacggaaatcgcgggccgcgtcggtatttgcgggaatattgtcggcgatcatgcgatgagacgtttgcagccattgtgcaaatgcgtcatgccccttatgcagatcttgttctcgaataacagccatacgtgttattttgccgtttgcgagcgactatgatggggtgttgcagacaacgtagtcacaactgaataggggtgtgaagagagggaaaatacttgcgattcttgacagcgttcgcaatgttgttgcatgtcgtttgcatgttgctcgcaacgtttttgcagccggtttgcattatttctgcaaacgaatgcttgcttgtaattgcttgaaatttcatctttttatgattacgtagtatgctatgtatgagaacgtatgcatgatgttacttagtgttcatgcggccgctaatgcaaggacgctggggtaaggcataatgttcctggagagtaatccgtcaaagggagtcgattaatgactgaaattaccgcaccgaagtccgcggtcaccgcggagcagttcgcagacgagatccgcgagcagctgaagtacacccagggcgtcaccgtcgagcaggccaagccggccgacgtgtacgtcgccgcgtccgccgcagtgcgccgccacctcatggattcctggttcaagacccagtccgacatggtcaacggcaacaccaaggcagtcggctacctgtccgcagaattcctgatgggcaagcagctgcgcaacgcgctgctcaacgccggtctgaccgagcagttcgacgccgcggtcaaggaactcggcttctccgtgcaggacgtcgtcgacgccgagcacgagccgggcctcggcaacggtggcctcggccgtctggccgcctgcttcatcgattcgctcgcctcgctgggcgtgccggcattcggttatggcattcagtacaagtacggcatcttcgagcagaagttcgatgaaaacggcaagcagatcgaaaccccggactactggctgaccaatgaagagccgtggggacacatcgattacaaccgcgaccagaaggtttccttcggcggcgaagtcgttgaggaagatggcaagaaggtatggaagccggcttggtccgtgcgtgcggtgccggtcgactacatggttccgggctatgcctccggtcgtgtgaacaccctgcgtctgtggaccgccaagagctacgacgagttcgacctgctcaccttcaacaagtccgagtaccttgacgccgtcaagccgcaggttgaagctgagaacatctccaagatcctgtatccggaagattccaccccgcagggcaaggcactgcgtctcgagcagcagtacttcttcgtgtccgcctccatccacgacgccatccgcgtcttctacccgggtcaggacaagccggatctgaccaccttcgcggacaagatcaccttccagctcaacgacacccacccggtcatcggcattccggagctcatgcgcgtcctcatggacgagtacggctacgattgggacaccgcctggaccgtcaccaacaagaccttcaactacacctgccacaccctgcttccggaagccctggaagtgtggccgtccaagctcatcggcgaactcctgccgcgtcacctcgaaatcatcgagaagatccaggaccagttcgcagccgagctcaaggccaagggcgtcgacgaagccaccatcaaggacatggccatctacaccggcgactccgtgcgcatggcctacctggccacctacggcggctcccacgtcaacggcgttgccgagctgcactcccagctgctcaaggacgtcaccctgaagaacttctccgacgtgtatccggacaagttcaccaacgtgaccaacggcgtgacccctcgccgcttcgtcaagctcgccaacccgcgtctgtccgacctcatcaccgaaggcctcggcaccgacaagtgggtgagcgacctcgaactgctcaagggcctcgaaccgctcgcagccgatgacgaattcgtcaagaagttcgccgccgtcaagcaggccaacaaggttgacttctccaactacgccaagcgcgaatacggcttcgacatcgacccgaacaccatgatcaacaccatggtcaagcgtctgcacgaatacaagcgtcaggcactgaagatcctcgccgtgatcgcacgctacgccgacatcaagtccggcaaggtcgccgccgacgatgtcatgccgcgcaccatcgtgttcggcgccaaggccgctccgggctactacctcgccaagcagaccatccagctgatcaacaacgtcgcccgcgtcatcaacaacgacccggacgtcaagggcaagctgaacgtctacttcccgtggaactacaacgtgcgtctcgcacagcacctcatcccggcaaccgacctcgacgagcagatctcccaggccggcaaggaagcctccggtaccggcaacatgaagttcgctctcaacggcgccatgaccgtcggtaccctcgacggtgccaacgtcgaaatccgtgagcgcgtcggcgctgagaacttcttcctcttcggcatgaccgtcgacgaggtggacgccctctacgccgaaggctacgatccgaagaagtactacgaggccgatcctcgtctcaaagccgccatcgacatggtcgcggacggcaccttctccaacggcgacaagaccgtgtacgaagaccttgtccacgattggcttaccaaggactggttcatgaccctcgccgacttcggcgcctacaccgccatccagtcggaaatcgaggccctctacgcccagccgctcgaatggaaccgcaaggccctcatcaacgtggcgaactcgggctacttcagctccgaccgctcgatggaggattacctcgagcgcatttggatgaccggtccgctcaagtaatgacggagcgttatctgcgttgtggaaggcttgacgtatcttcgtacgctttcgccttccacgccttgtgatactgcgctcgtcattactttcgcttcgcacgggccatatgtgacgtgaattatcgcgtgatgtatgactcgtagcgttagatagggcgtgatgacgaagggacgattccgttttggaatcgtcccttttcgttttccagggcaaaacaaaaagccctgcgcgtggggcgcagggcttgaaagaaagagaaatcaggcagcttctggggtggtgggagcgacttcggcttcgccatcctcggcatccttggtcaggccaagatcgacaggagacgagctgttctcccatggctcctcccacggatcgtaatccggattctgctgcttgtacacatacagaccgacgacaccggcaagcaaagctccgaagagcagtgcgaagaacttccaaccgttagaagacttgttctccatgacggatcctttcccaaatatcggcgaacattggctgacctgctcgttcaagccaactctgttcactatattaattccttgaatgtgttgattgggtggatttacgcgccggggattcacaagaatgcaatcatttgcaatgatttcgcagattcgcggattcgcacgttccagtagggttgaaacatggcttatcaacgtttcagtctgtttcccgattccccgtcgttcaaagacttcttctctgcacgttccatgcgataccgttggcgtaacggcgatcctgtgatcaccgttacgatcatggcgatatgcgtcgcggtctggattgtcgaaacactattgaaaatcgtctggccgaccggctgcaacgcattcgtcggctcaggcgcattcatgcccgcgctggcgactcaccgcccatggaccttcattacgtcaatgttcctgcaccagccggcctccctatggcacattcttttcaacatgctgaccttgtggtgcgtcgggcctgtattggaacgcatgatggggcatctgccatatctcgcgttatacgtgctgtcaggactcggcggaagcgccggcatgatggtctggtcactgttctcgcaagacggttggctgacatccgcatacggcgcttccggcgcgctattcggcctgttcgcggcaattctggtggtataccagcgcattggcatcgacattcgatccatgctgatctggatgctcatcaacttcctgatgccaatcatcacgccgaacatcgcatggcaggcgcatgtcggcggattcatcatcggaggagtgttcacctggctgctggtttccggtctgcacgcgttgcgcggcaaaagtctgcagcagcgcacgctgatgtacggcgtaatcatgttggccgtgattattgcgattgtcgtcgcatgcaatatgagcaatccacttcgcgcaaacccccttcttggcatgttcttctagttggcaggcaggagaaaaaacagatttggggaatcgcagacacacacttatccacaaatgtggataagtgtgtggataagtgagggttgagctgtgggtaagtcggggataactcggtgcattatccacaaggatattcacaaaacggtggattccccggcttttcaacggtggaaaatgtggataacccgactatgcatagtggaaaaatggggaaaaacaccatcctatatattgtggacggtcataaaactgcctacaagatatagacgctatccacattcgtccacaataatccacgacttatccacatcgtgtgaaaccagaaaatccccagaatgacgacgaatcaacacaacgaaatcaggtacgtcaccaatgacaatcatgaatgacgagacgcgcgaattcgtggcgatgcatcgcaacgaggacgtgcgcgaactggcgttgaaggccaaacgtgtggaagggctcgacctgccgttggcgctcgaccagattgccggatggcagatcgcacgcaaaaaactgccacaatgggcctcctgcgagggaatcgtataccctccgcacatttccatggaacagtgctcatcgcagttcacagcccaatacaagtcagaaatcgcacaaacactgctcgcgccggccgcaaccgtgcgcgccagagtgtccgattctggagaatcggacaaccaaaccacgaaaagtgagccacagttgtccgattctgccgaatcggtcatgcaaacggcaaaaagtgcgttccagttgtccgattctccagaatcggacacgcaagagatgaaaatgggcgcgtggatgtccgattcgccagaatcggacacattggtggcgagaagttcgatggtggatctgacgggcggattcggcgtggacttctcgtatctggcgcgcggattcagccaagccacttatgtggaacggcagcggcatctgtgcgatctggccgaacacaatatggccgcactgggactcgaccaggcgcgtatcgtgtgcggcgacggcgtggaatacctcaggcagatgggtccggtggacttcatctaccttgatccggcccgccgcgacgagcatggatcgcgcacttacgcgatcgaggattgcacgccgaacgtactcgaattgcgtgacctgttgctcgccaaatcgcagtacacgctggtcaagctttcgccgatgttggattggcgcaaggtggtcgccgatttcgacgggaccgtacgcgaagtgcatatcgtggccaccggcaacgaatgcaaggaactgttgctggtattgggtcagcaggtgcatgaggaaccatccgcgccgcgcgtgttctgcgtgaacgacaatcagcggatcgactatgattccgccgcatatacgcagggcctgcgcattggcggcaaaccgctgccggagacgaaaaactacttgtatgagccgaatgcgtcgattatgaaggccggttgcttcgatctggtggaggaacgattcggtgtgacgcaggtcggtccaagtagtcaccttttcgtgtcggcaacgccggttgccgattttcccggcagaggattcgcgattgaagcgatcggcggcatgaataaaaaggatataaaacgactgctgaatggcacgaaacaggccaatatcgcggtacgtaacttcccgcttaccgcaccgcagctacgcaagaaattgaagcttgccgacggtggtccggtctatctgttcggcactaccatgcaaggctgcgatcatgtgctgctgcgcacgtcgaaaatctgaaaaacaaaccggaatcgaaaaaagaaacaggcgaaccgggattggcaaggcagtcgcgaaagaccgcgtacgtttgcgaaagagcgtgaaacctacgaagaaaacctacgaaaagattgcgagataatcgtaaaagggcatgcgaaaagggcgtctgaccgcacgttgtacagacgccctcaaatcgcaggaaaggcgaaactacgctttagcgccaccacatggtcatgatgaatccgatcatgatgatcgcgaatgcgatggccagattccacgcgccgatgttcggaatcgggtagtcggaagtcaggtagtagacgaccgcccagatcagaccgatgatcatcagcgcgcagaacagcggcacgaaccagcgtggattggacttggtgcccttgatggtttcctccacgcggcgggtgttctccgcctgacggttcatcatgcgctgcatctgcgggctcagggagtccttatcggcggtagcgttcagcaccgcttcgacgcgatccatcggaatgtcgtgatcgtcatcgtcgtcggaatcagcggattcgtcagaagtggaatcgacggtggtttcctcagcggcatcctgaacggtttcgttgctctcttcaacggcagcggtgtcgtccgtggactgcagatcgttctgatcgtccgcggtggtttcgtgcagctcttcgtcagccatcagcatagtctcctttaataggctaaaagtcataatagtgggtagactcgaaagcggcgaactcacagcgcaaaactgttcataatcagagcaaatgcttaatgggaatcaggaaggtccgcatggcgaagcacaccggcaagcacaccgcgaaacggtcgaaagcggccggagtggcggcattccttgtgctcatgttctccggattcctgctcgccacgaacctgcgcgtgaaccgttccgtcgtggtgaccaacgacaccgccgaactcgtggaacaacgcgtgaaaaaagtcaactccctgcagacggaagtcgacgcgctcagctcccgcgtgaacgatctgagcaaaaccctgaacagccaggacgacgccgaccagcaagacagcgaaagcgccggcaacggcaccatgctgcccgcggtggaaggccccggactcgtggtgacgctcgacgattcaccactctgggaaaacatggtcgattccagcggctccacctccaacatcaacgattacgtggtgcaccagcaagacgtcgaagccgtggtgaacgcgctttgggcgggcggcgcggaatccatgatgatcatggaccagcgtgtgctgttcaattccgcagtgcgctgttccggcaacgtgctgcttttgcagggcaaaaagtattcgccgccattcaccatttccgcgatcggcccggtcgagacaatgaaaaaggcgctcgacaattcgcaggaagtgaccatataccggcagtacgtcagcacgttcggcttgggatggcaggtcgacgaaaaagaaaaactccatttcgacgcgaccgacgcattgcaacagccgctgcaatacgcgcaggcgatgaacaacgaaacagacggatcgcagcaaacggacgaaacgcaggaatcgcaagaggggaagtaaccgatgaagcacgtggcaccaaaacagcgtcgcaaaagcgtggtctggacgatacttggcatcctcgccgaactcatgctgaccgcggcggccgtctgcgcgctctacatcgcatggcaaatgtggtggacgggcgtgcaggccgaacacaaccaaatcgaaacacgccaatccgtatcatggtccgaccccggacaatccgacagcgtcaccattgcacaagcgcaggaaggcgacccgccaacgcaaccgcaaagcgcacaggaaggcgagctcatcgcccaggtctacattccgcgattcggcagccaatggcagcgcaacctcgttgaaggcacctctctcaccgaactcaacaagcatggactcggccactacaaggattcgcaaatgcctggccaagtcggcaatttcgccttcgcagggcaccgcaacggctacggacagccactcggcgacgtcgacaaactgcaggaaggcgacccgatcatcgtgcgcacgcaggattactggtacgtctaccactacaccagctacaaaatcgtgctgccgaccgacatcgaagtggtcgccgccaaccccgaaaaccccggcgcgacgccaaccaaacgcatgctgaccatgaccacatgcgaaccgaaatactccacgccaacacaccgctggatcagctacgcggaattctcatactgggcgaaggtgtccgacggcatcccccaggagctcgcctccaccgactccaacggcaaagtcaaattcgtcaacaacgaaaaatcgtcgatcgtcgcatccgtcagctcactcaaaccgtggattctcggcgcgctcgccgcatatgcgatcatcttcctttccgcgctggtggcatggcgttggccgtatctcgccgacgtgcgcgcaggacgccgcgaaaagccggaattcagcttgtacggcggattgatgcgattgcagccgggtgtgcttccgattcgacttgtgctcatggcgttgctgattttcgcggcggccgcatcgtgctttgaatggctgttcccgtgggctgcgacgaatattccggcattgcaggaaatgtcgaattacacggccatataaagctgtattcaggtgccttccggcggtctgctggcagttttgctggcagacgtgaaagcgattgctgcgattgctgcgatctgcgattatcacgattgctgcgtgagacgcgcgccgcgtcacgacatgttgcgcacgtacactgctatgcaaacgcaaatattcgcgcaacgtaagtattcgaagcattcgaacgccgacattccgacgttgataggagcatgatgaccgattccgcacgcattttggtcgtggacaactacgattcgttcgtttacacgattgtcggctatttgaagacgttgggtgccgcggtgacggtggtgcgcaacgatgcgatcgatccgggcgaagccgatgtgatcgacgaatacgacggcgtgcttatttctcccggcccgggcgctccggccgattccggtgccagcgaaggcatgattcgcctgtgcgcggagcagtccaagcccatgttcggcgtgtgcctcggcatgcaggcgctggccgaagtgttcggcgcgaccgtaagccacgcgccgaccatcatgcacggcaaaaccagcttggtggagcatatcgacgatgagatcttcgaaggcgtcgccaatccgatgaccgccactcgctaccattcgctggccgtggagcccgattccgtgccggaagagctggtggtgaccgcgtggacgcaggtcgaccacatcgtgcagggcatcaagcattgcagcaagccgatgtatgcggtgcagttccaccccgaatccgtgatgacgcaggacggctaccgtctgcttgcgaactggctgaaggtgtgcggccaggagaacgccgtggaacgttccaagggattgcagcccaaggtcgcggcctaaggtcgcagcaagaagacgtgggaagtgcgaaaacgcatggtacaagcgtggaaacgtaagtcgcgcaatctcaatcgcaagaaaatacaaaatcgtaagaaaacacgaatcgcaaaagaacataagaccgtaatgaggaaggcccagctggcatttcagctgggccttccttgtgaatgatggcggttatctcgaccgatcagttgccttcgggagtgttgttgcctccgtcggtgttgccgccgttgttgccgttgccgccgttgttgccgccattattggtgctggacgacttcgtggtcaacgtgatcgtggctccgctgtcggactgggtgccggcgatcggtgacatgcctgtgaccgtgccatcctccgggccggaaaccgtgacctggaaaccgtagctttccaacaggctcttggcgttcgcatagcccatgccgaccacgctgggcacgctgatctgctgcttgccggtagacacccaaatcgtgaccgcggtaccggcctcgaccgtgcttccaacacccggctcgacgcgggtgacggcgccggaagcgatggaatcggaatattcgctttcgatggtgatctgcgtcagaccggcctgcttcagctgctcgataaccgtgtctttcggctgtccgatcagattatcgggaatcttggtcatgccggacgaaatgtacagcgtgatgatcgtgcccttagtctgcttcgaattggcggcaggatccgtgcttaccaccttgtctttttcgatggaggcattgtcgaccgtgcgcacgttacccaccttgaagccggcggcctcaagaatggatttcgcgtcatcctggctcttgttcgacacatccggaacggcgactgactgagggccggtggagaaccatacggaaaccgtggagcccttggcgaccttcttgccgcccgtcggattctgcttggtgatggtgcccttcggctcgctcgaatcggaatcctctcgggcatcgagcttcagacccttggccgcgagctgctcttcgacacgcgcctcggaaatattcgccgtggcggtgaaatcaggaacttccaccatgtcggcggtggagtcgctcttgttcagcatgaagaacacacccagaatgaccagcagcgccaccagaccgcccaccacggagccgatgatgatctgcttcttcttacgcgccttagcggcctcggcacgctgttccgcgcgggtttttgtggatacgccgttctgtgggttcggcacggcctcgaactggcccgtaacgggattgaacgcctgcgtcgcggcggtttcaccggcaggagtcatggccacggtgttcgcgtccatttcggcctgcttgcgtgccttcatattggtcagatcggtcaacggattgaacgcggccgccatcggcacgccgccgttcatgaacgtcagcaaatcgttcttgaactcggaagccgtggcgtaacggttctgacgatccttcgccatcgctttcgcgcaaatcgaatcccacatcttcggcaagccgggaacgaccgaacttgggggagtggcgacctccgaaacatgctggtaggcgatcgcaaccgcggaatcgccggtaaacggcggccttccggtaagcatttcatacagcacgcagcctgcggaatacaggtcggaacgcatgtcgacgctttcgccgcgcgcctgctcgggagacaggtattgcgcggtgccgaccacaccctgcgactgcgtcatcgtggcggcggaatcgtcgagcgcgcgggcgatgccgaagtccatgaccttgaccacgccctgctcggaaatcatgatgttgccgggcttgatgtcgcggtggatgatgcccatgcgatgcgaatactcaagcgcgttgagcacgcccatcatcacctgttcggcgtcgcgctggctcagagcgccattcactttgagaatgtcgcgcaaggtctggcccttgacatattccatcaccagatacggcagatgttcggtctggccggtttccgtggcgacgacctcttcgcccgaatcgtagatgttcacgatattcggattgttcatctgcgccacggaatgggcttcgcgacggaaacgctcaaggaagatcttgtcgttggcgaagtcggcgcgcatgatcttgaccgcgacggtacgcccaaggcgcgtatcgagcgccacgtgcacttcggccatgccgccacggccgaccagttggccgagctggtaacgtccaccagccaaagaggtaggcatgttgatgttcatccctgttccttcccatcagtgctcaaggagatatgaggtctgctgaccacgcgtcgcggaagtcttccgcctgtaggcaccaccatcgtgtcagccaattgtgtctgctggtcgagcagacggcgttcgatgcgggacaacgtgcgcgacaccgtcaacgcgtccttcggacggtcaagcgggtctttggacagcatcgacatgacgaattcacgcagctgcacgtcgacggagtctggcagcggcggaaccggattgttgacatgtgctgcggcgatgtcgactggcgtggcacccgtgaacggacgatgcccgcacaggccctcgtaggcgacgatgccaagcgaatagatatcggattgaggcgtggcatgctggccctgcgcctgctccggggaaatgtactgtgcggtgcccaccaccatgccgtcctgcgtgatctgctcctgattggtggagtaggagacgccgaaatcggtgattttcacctcgccggaatcggacaccatgatgttcgcaggcttcacgtcgcggtggatcacgccatgcgaatgcgcgacgaacaggccacgcgcggtctggatgagaatcggcagcagacgggtcggctccatcgggccgttctgctcgtggaacaggtcggccagcgacttgctgggcacgtactccataacgaggaagccgatgccgtcatgttcgtaatattcgaacaacgcagcgatattcgggtgtgcaagattggcggaattatgcgcttccgcacgcaggcgaagcagcttggcctcctgcgtgacgcccaagtcgccgcgcaacgccttaatggccacgggacgacccaactggatatcatagcctttccatacttcgcccatgccaccctgggccagacgggcatccaacctgtagcgtcggtggatgagctgtccttcaatcagttgcactctgccagcgcctcctgcatcatcgccttcataatcggacccgccgcgaacgagccatacaaatccacattgtgcaccaccacggcaacagcgatcttcggatcgtccgccggggcgaagccgaccacccagccgtcgatggacgtattgccgtcaccgatctgcgcggtgccggttttcgcagtcacctgcacgccgtcgatggccagattcgggttctccttggtgaccaccgcctccatcatctgcgtgagcttgttggcggtgcccgaactgaacgcgcggctcatcacctgcggcttggtctgcgaaataacagacaggtcggaggaacgcacgcgatccaccagcgtcggctgcatgaccttgcccccgttcgccacggtggccgccaccagcgcgttctgcagcggagtcaccacggtgtctccttggccgatggacgccaaagcgagcttgtcgtcggtcgtgtcggtcgggaacttcgacgccacgctcatccacggcgtgcccgtggaatcggatccgtcaaccgtgatcggactgtcgaaaccaagcttcttggccatggacgacaccttgtcatcgcctaaagccacgcccagctgggcgaacgcggtgttcgacgaatacgccatcgcgtcttccaacgtgatcttgccgtccgaaccgtcggcctgcgacaccgcgttcgtcaactgtgtgaccgtgcccggaagcgtgtagctcgatccggccggaatctcggtgtcggtctggtattcgccagtttccagcgcggccgccgccaccaccgttttgaacgtggatcccggaggatacagctgcgaggtggcacggttgagcatcggattcgactcgtcttgcgaaagcgtggaataattgccgttcgcttcggacgtgtcgtggctcgccagctggttcgggtcgtagcttggcgtgcttgccatggcgagaatacgaccggttttcacttcgatggccacggccgcgccgtcattgttggcaagaccgttgtaggcggcctgctggattttcggatcaatggacgtttcgatggtcgcgcccttgttttcctggccggtgaacagcgatttgaaccgctgccataccagctggtcggattggcccgacagcagcgagctacgcgacgcttcgataccgttccagccgcgttggctgatcgagaagaagccggtgaccggcgcgtacagttcgccggcggtataggaacgctggtaggagaacgcgtcgttcgaagggtcggatttggcgatgacggagccgtccgaagcgaggatcgcaccgcgcggagcgccatactcgtggtagagggcgcgggtgttgcgcgggtcgttgttgagctggttcgcgcgaatcgccgtgatgatggtggtggacatgcccaggatgacgaacagcgccaccacgatggtgaagagttggcggagtgacttattcatgcttggctcccctctgacatgctgtccgatacgttcggagtgcccgatgggggagcgggtggtacgactggcgtgcctgaaaccggcgtctccgtggagatgatttcagtggcctgcgcggaggcctgcgcggaggccacgcttctgcgggcgcggctctgcttgcgggcgcgcagcgcctgcatcgcctcatattggaacgtgtcgctatcgatatcggattcgggtttgttcgccgagttggaaatcaccactaggagtgctgccaacatgtaattcgctatgagtgaggatccgccggcggccatgtacggaagagtcaaacccgtaagtgggatgactaacgtgatgcctcccaccacggtgaacacctggaaggccatggtgaacacgaggcccgatgcgagaagcttgccgaacccatccttgattttcatcgcagtgatcatcccggcggcgatgatgagcagatagagcatcagaatggccatcagaccggtgaggcccagctcttcgccaagtgccgcgtagatgtagtcggagttggcgatcggagtgagcgacgggtgaccttgcccaaggccggtgcccatcaagccgcctgatgccaggccgaaaatacccgtgacgagctggtaggatccgccgtactccttgttgtactgcgccgagtcgaacgggtgcagccaggcgtcgacgcgcgcgccgacatggctgaaaatattggccgcggcgaacgcgcccacggcgaacgcgatgaaaccaatcacaatccaactggtgcgccccgtggccacgtacaacatggacacgaacatggcgaagaacatcaacgacgtgcccaaatcatgctgcacgaccagcacgcccatcgacacgatccacaccacgatgataggcccaagatccttgatgcgcggcagctgcaggcccagcaccttcttgccaccgaccgccagctggtcgcggtggtcatacaggtaggaggcgaagaaaaacgcgaggaacagcttcgcgaactcgcttggctggaacgatcccaaaccgggaatcttcacccaaatgcgcgcgccatactgttcggaaccgatcaccggaagcatcggtgacagcagcaacaccaaaccgatcaccatgctgacgtacgagaaccgcctcagcacacggtaatccttcatgaagatcaccagcagattcgccaaaaccagcgctatcgacagccaaagcaactgtttgaacgcgacggacgtgttcaaatcctggtcgatgcgggcgatcatcatgatgccggtgccagtcagcaccatcacacaacacatgatcgcctggttggcatacggctggaaacgcagcggcaatccccaggaagtcaggaacaatgcgccgacaaaagcgagcatccacaaataattctgcggaaaaccgccggtggtgcgttcgaacatctggaagaacgcgacgccgcaaatcagcatgctgaacagcagcaggccgaattgcttcagacgggttgccatcatgactggtcaccgcctgacttgtttgccgaagcgtcgtccgatttgtctgatttgcccgacgacttgtcggaagtcgtaccagaggatttgttgtcggattcgccgtttgccttgtcttgttccttctgcgcggcttcgtcctgctgttgcttcagctgctttttgatcagtcgcgtatgcgttttcgcctcgccgtacgtgtcgaaggaaatgccctgcgcaagctgttcctgccagcttggcggcagttcgctcgtcttcatatgggtgtcggtgacggcgtgcgacagctggaagccgaacaggcttgtcggcacgccttggaaaatcgccacttcgccgttgtcgtcgccgatgtagtacttggtttggctccaacggtaggttgcgaacgcgccgcccgccagtcccagcagtaccacgatggtgacgatgatggcgatcacacggttgcgtcgggtgcgcgtgcgcttcgttttgcgctgctcgatatgctcgttgcggatggctttggcgacttccggatcgttcggatcggcggaaatgcggccgtcgtccttctgtacgacggggatttcaccggtgtcgggattggtgcggtcgccgttctcctcgcgtaccgtggacggttgcgccacgcgctgttccggaggattgtcgtcctcgttgggattcttgccgttgcgcagtgcggcggcacgggcggccggcgacttcttgccctcgcgcagtgcgggagcggatgcgaccggctcgttgatgatgtcggcgatcggctcaaggcttgcgctggccgcgccgccaaccaatggcgtctgatgcggcagatcgaacgcgtccgcgtcaagggcgagcgtcgcgtcggcgatgaccgcggtgacgttgtcggtgctgccggcacgaagcgccatcgaaaccagctgttgcgcgcactcctcctgatcggagcaggcggacagcacctcctgcaatgtggaatcctcaagcacgccgcacaaaccgtcggagcagagcagccagcggtcggccggatgtgccttgcgtatggcgatgtccggactcgaatcgatatcgaaatcacccagaacgcgcatcacgacgttgcgctgcggatggttgcgcgcctcggcctcgctgatgcggccggtgtcgatcagatgctgcacgtagctgtggtcggacgtcatgcggatcagacggccgtcatgcagcagatatgcgcgggaatcgccgatatgcgccaaaacccaatatccggccaccaatgcgaccgacgtgacggtggtgcccatgcccgcgagacgacgttcgcgcttcgctttgccaacgatcgcgtcatgcgcggccataaccgaggtttccatcatgtgggcgataatctggacatcgccctgcacgttgtcttgctcgatatgcgccaatgaacggatggcgatggtggaggcggtgtcgcctcccgcatggcctcccatgccatcgcagatggcgatcagatgctcgccggcgaacgcggaatcctggttgttggaacgtacggtacccacatcggaaacgacggtggaatacatgaacagcggttgtgaagcgggagaagtcggcaaacgggtcacctcaattcaaaggtggttgcgccaatgcgtacgggaacgcgcgatccgagaatcatcggagcgttcagacgctgctggttgaccacagtgccgttggtggaacccaggtcttcgatggcccacttgccggtggcgggatccgtatagacgcgcgcatggtgggacgagacgaattcgtcgtccagaaccacggtgttcgaagcggaacggccaagcgtgatggtgttgccggacaaagggacggaactgccggcaagggggccatcgatgatgaccagcaaggtgggtttggcgcttgatgtggcgctgacgactggtgccggggcggccacgggcgcgggcgcttcgacggccttgcgcgcgcgacgctccttacggcgatgagcccgcgacttgcgcgggctgagcgtttccacatccctgtacagcgaacgcaccgtacaggccacgaagatccagagcagtacgaggaagccgtacttgaggatcgcgaaagtaagttcagtgagcatagaggcaactcccgaggttggggttggttactcctgatcctgcgaagaggcccaatacaggattcgggtgcggccgatggtgatcgtgttgccgtcgagcaacgtggccgcctcgacatgatggccttcgacatacatgccgttggtggagcccagatcgcgtgcgatgacggtgttgccgttgtcggtgatgtcgatctgcatgtggcggcgggagatgcccggatcgtcgatcacgatatcgcagtcggatccgcggccgatgatggtcttgctttccgtgagcagatactggtgttcgccgatttccagcatcgggcagtcttcggtctgcgcgtcggtggtgacgggcacggtattgccttgcacggattcgctcgtcagcttgaaattgctcttggtgaggtcaaggtcctcttcgaagatcaccacgaccggaccgacgaacgcgtaatgctggtccttcgcgtactgggtgaggttgtcggccagctcattggccaacgcttccgcgccccattcgacgatgttgttgaaatccggcgtgctcagcttgaaacggtactcattcggcgccacggtacggtctcgcgtgacgggcatggcctctttgtcaatctcacgttccagagcgctggaaaggtcgacgggctgcaggtccttggacccgaacttggcgaaaaccccgttgacggcgccttccacgcttttctcaaatcggtcgagaacactcatgcttgtccctttctatcctcacccatcctacgcggtagagcgccgagcgccaattcgtaagtcctttaattgcaaaaatttcatgcataaatccatcaccagcatcatttagggggtatttatccgcgaatatgactaccttcgcccccgatttccacgatgcacgaattcacggaaggtggaattgggatggtgataggttgggagcatgacagatgcgattcgacagttcccccgtaaaaaagcacgtaccttgcgattttcctgcggcgctccgcgttcggcgcgcgtgattgcagacggctcccgcgcgctgttcctgcgttccgacggtccggaagacaccgtcacctcgctgtggatgagcgtgatcgacgaagacggcaacatcggtgagattccgctcgccgatccgcgcgtattgcttgccgacgccgacgcggaagacgttccggcggaagagaaggcgcgacgcgaacgtgcgcgcgaaggcggatccggcatcgtctcgtattgcgtcgacggtgccggcaaccgcgtgaccttcaccatcaacgggcagcttttcctcaccgaccttacggcgggcgcgacgcgagccatcacgatagaggaagatgaactcaaaccggtgctgaacccgcgcatcagtcccgacggacggcacatcatgtacaccaccggcacgtatctggtggacgtggatctcgctaacgatgaagaaaccggcgacgcgatttcggtggtcgcctcggcaccgcagaacggcgaatggaagatcggattggcggaattcgccgcaggcgaggaaatggaccgctacgacggattctggtggtccccggactccaaatatgtgctgttcgaaacctacgacgaatcccccgaaccaatctggcatctgtcggaccccgcgaatccaaccaatcctgcgcaagccaaccgctatccgcaagcgttgaccgccaatgccgacgtgcacctgaccctgctggaactcggctttgacagcgataactgctgctacggggcaatcgccaacgaagtggtttgggatcgcgaatcctacgaatatctggccgtcgtcagctggacggacgggcatgagccagtcattctcgtgcaagatcgccttcagcagcacgatcaggtgctcgccatccacgtaggcgagccgatcgccaccatgcgcgacgcggagaacgacttcaccgatagcgatggcgaccaggtcgaaaccttctccatcgccatccccgaatacgcggaaggcgaacggccgggcaccacgcgcgtgctcgaggaacatagaaacgactactggctcgacctgatccacggcacccccgcattcacgccggacggacgcctgatttgcgcgatgaacgacatggacgccgacacgaaccgcctcaccgtcgacggcgtgcccttcacgccagccggactgcaggtgcgcgaagtgctcgacgtgaccgacgacgacgtgctctgcgtagtgcagcgcacccctgaactgttgcctgacgacagcctgccattcctctggcagtccaacgccgccgaacacgacgcccgcagcttcgacgtggtgtcaatccgctatgacggcacatgggagcccctcacctacacgcccggccagtggagcatgtcccgcgcaggaaacggctgcgtggtgaccggccgtggcatggataacgcaaccgtgcaaatgcagcattgcatgaacaccgccacaaccgacgaaaatggcacggacatggcgtcaatggtggtcgcaccaatcgaaaaccatgccgaaacccccggattcacgccgaacgtacacttcacccgactcggcgaacgcgggctgtacacggcgatcgtgatgccttcagccggcagcgaatacgcgcacgcaaccaccctgccggtacttatgaagccttacggaggtccaggattccagcaagtcgtcgaaagccaatccttctactgggatgcgcaatggtgggccgaccaaggctacatcgtggtcaccgccgacggacgcggcaccaccggacgcgggccgaaatgggaccgtgccatctacgaaaccatgaaatccgtgacgctcgaagaccaagtagacgccgtacgtgcgctgccggaagcgttggcaatactggctgcgcaagaaaacaagaaatcctcggaaaccaccatcccgcaacccgacctcaatcgcgttgccatgatcggctggtcgtatggcggattcctttccgcgctcgccgtgttggaagcgccggaaacgttcgctgcggcctgcgcgggtgcacctccgaccgactggacgctgtacgacacgcattacaccgagcgttacctcggcctcgacccggccgtgtacgaacgtaacagcatcatcgccgacgcgccgcaactcgatcgaccgctcatgatcatccatggattcgccgatgacaatgtgacgatcgcgcacagcctgcgtttgagccaagcgctgatggctgccggacgcaagcacacgttcctgccgttgaccggcatcacgcacatgaccaacgatgagacggtcgccgaaaatctgctgatcctgcagcgcgatttcctcgcggaagcgttggagcggtagtgctgctccgatagcgctgtaatgataactgcaaaagcacaagcaaaagcaaaacgcgttcccctgcgacttccggactgccaagcatccgagcgtcgtgggcgaacgcgttcccttctcgattgccaacataaaacaggcgaaaacgacttcgcaagcgagggggtaccacatttgtgtacccctctctcaatttgggcttgagaaagccgaaaatcgtagaaaataagcaaatatgaagcaagagcaaacgaatagcgtcagatctgcaatgcagatgcggtcaaacctgcacttgttcaagcaaaccgggcgaatcgtcgatgacggtcaccggaatgtacgcaaacaacgtccaactgccgtcctgcgcagacgtggtgagcgtgccctgatacgattcgagctgcttcttgaacgaggcgagcccgtggccgcccggtagttcgtcatcgcgctcgtcagctccagccatgtcctctttcatgggattgatttgcgtgatttcgatggcattcggccggagcatcaccgaaagatcgaccttgcttcccggagcggcatggcgtgcgatattcgcatagatctcgcgcagcagattattggcaagttcggcgattgcttgcgatgcgctcggcttgccgcccgcgcagtgccggatggacgtgatattgaagccaagcttgcgcaagcgacgatcgccgtcatccagtgttgctcgcagcagattggccaacgcttcgccgtcggcgtcgccggggagagtggtggcgtccatattcaattcgtcgatgacgcgatgcacgttcgtcaatgcggaaagaatatattcgttgatttgacgccagtcttcggcatcggctgttgtggttgccgtagttgtggttgcgttggcagggtcagcagcgacgccagggccgctagagttgccaccgatatgccgttgcgccacaaacgacgccgctgacaaatcgcccgtcaccgcatcgtgaatggcatcggcaatgcgtgcgcggctttccaattcctgcagacgattcttgttctgcgccgcttcgaagcttttctgcgttgttttttcgctccaactcaacgtccgaccaagcagtagcaccatggcatacatgctgaccatggcgacggggttggtatttgggtcaggggggtcaatcagcagaatgttaacaacgtaatatatgagtaacgttgccacgataatggcattagtgctgtatgcgagcatgccataggcgtaaagctgcgcgggaagagaatttcccaaatgcgcgtagggagtaaacagatcgcctatggaggcaatcacgagaatcgccaccgatgtacttttcagaaacagcggagacagtacgagcgccgtaaccagcatcgcaacccatatcacgccaaatatgtcggtaggaggctcgtagcaaacgccgtatatggtccatgcaagcacgatcagcataatggcgaaacggattggatgccacaggttcggatgctgcgtgcgcatacggttgcgccacgcaatgtactgagttgcgggtttagagcgcattggacctcacccacagtgccactgcctgacgcgaggtcttgcagttgagttttcttaaaatactttgcatatgtttgcggatggtggcttcggaaatccccaaacgctcggcgatgtcccggtcaagcatgccctccgcgcacaaggaaataatctgctcctcacgaacggtaagcgcgggagtggtctcagcctccctgctgatacgcagattggccaacgcaggcggctcaaatccctccatcacctcgccattgcacatacgcataataatctgcgccaactggtcggcattctccttaccaaccaacccttgcgcaccagcctcaaccagcttgtcccgataactattgatggaaaaactggttacaccgagaatcggcatgcgctggcccatcaaacgcaaccgacgacacgtggcggggccttgcaatccctccatcgacatatcgagaatcaacaaactgacatggccgttcgcatcctggcaacgttctatcgcctcacagcctgaagtcgccgtccacaccacatacgcggtcggcactttgctggcaatgacggcactgagcgaatccagcgctcgcggatcattgtcgaccagtgcgatgcggtgaatcttgggatgcttttcccgcgtggacatcatgcgatcactttccttttccgcacagccattgcagccatgttgggcagttggaatcttgggcagcggagatatcaccgttgttgtcaacgggagttgccgccgcgtacgcatacgttggtgtgccggtgagagacagcgttaccaccatcagcagtgaaacgaacttcatacctccatagtatgcgaggatggcgcgcgggggtgacgattcggttgttccggtacgccgttgatgcactgacgcatcgttatacagcgcgtatgcctgtgcttagtttcgtcttggcgccgttcgcctaagatggaaccatgactatcacgctcatcgacgaggcgcgctatgacgccgaaatggacgctacggtgctgcctgcgctgcaggcttgcatgacggaaggttggatggaaccggccaccgtcgattgggaaggcaaggcgttgcccaagttggagcgccccggccggttgcattactaccgctacgacgcgcgcacattcgacgcgttgcgcgaggaaggcgcttcgggcgtatttcgtggcacgatcgtcatttcgcacggattcaccgaattcggacgcaaatacagcgaaatggtgtggtactttctgttggccggctattcggtgtgcgtgttcgagcatcgcgggcatggccattccgcgcacgatatgagcaatccaagtttggtatggattgacgattggcggcgatatgtggccgatttcgccacgtttgcacagactgtggggcgtgaggcggcggatggtggcccaatgtacctgtactgccattccatgggcggcggcatcggcgcggccgcgctggaacgttacccgtcgctgttcgacaaggcggtgctgtccgcgccgatgatcgcgccggtggtcggcatgccgacgtgggtcgcacgcattgtggtcggcgtaatctgcgggcttggcttcggcaaatcgcgtgtgttcgggcatgccgatttcgacggcaacctcaatctcgacgactaccgcggggcctcggaggcacgcatccgctggttccacaagcaacgtttggcggacgtgacgtgccagaccaacgcggccacgttcgattgggcaaaccaggcgatggcgctttcccgagccgtgctcaaacctgacatgtgtggagctatcgaagctccggtattgctattccaagccggacgcgacgtgtgggtgctcaacggaccacaagatgacttcgtcgaacgtgtgcgagaaggcggcggttccatcgaaaaagtgcgatacagccagtcattgcacgaaattttctccatgccgaatgccgtgctcggatcatatctcggcaaaatcctcgattttttgtcagcgccgaacgcaagcttggcggaataaatctgttttgcataactgacgtttaatatgcgtaccgtgtgcgttacaatcgccgtgaatttgccgtgaaagccgtggagagagcgagggcaggccgtggcaaagcaaacgtcgggacaggcgtcgcaatcgcagaaaacttccgaatcgcaaaaaaccgcgaaaaaaactacgaaaaaaacggaacatgtgctggaacagacgccgaaaagcctgctcatcggcactggcatgacattgctgggcggtgccatgtggggtatgaacagcaccgtggccaaactgctgatgcgcgactaccagctggatccgatctggctttcctgcgtacgcgcgctattcgccagcctgatcttcctggtcggatcggccatcaccacaccgcagaaactcgccggagcggtcaaagacgtcaaatcgtatccgaaatatctggtcacgacactgatctgcgtgcttctggtgcaggtctcctacctgatgaccatcgactggacgaactccggaaccgccaccgtattgcagacgctcaacctgatcttcgtgctcgcctgggtatgcctgcgcggcaaacgactgcccctcaagcgtgaattggtcggcgtgctcctggcgttcgcaggcacgttcctcatcgccaccggcggcaacttcgcctcgctgtcgttgccatggcaggggctcgcatggggactggttgacgcggtgagcaccgcggccatgtccatcctgccggtcgtgctcatgctcaaatggggcaacatgaccatcaacggcatcacattcctcatgtccggactcatattatgcccgttcgcgcaaccgtgggcgaacattcccgcactggacgcgcgaggcgtgcttctgctgctctacaccatcgtatgcggcacgttcctcgcgttctggctctacatggcaggcgtgatgcgcgtcggcgcggtgcgtgccaccatgctcggcaccagcgaaccggtcatggccaccatcaccgcagtggcatgggccggcgaaacgttcaccttcaccgacctgaccggcttcgccatgatcatcatcatggtcttcctcgtgcgctgaccgctcgccatagccataaactgtccgattctggagaatcggacatccagaacgcaaaacccataccttagttgtccgattcaccagaaacggacaactaaacaggtaaaactgccccacagttgtccgtttctccagaatcggacacttatggtgcgcacgtcggtgccggcgagcacgtcggccagatgcttggcagtgttcgggattgccggcagagtctcttcggtccaagcgccgaccgcgttcacgaccacgtcgaatactcgctgactgaagtcggcgaaagcctgcgcccgatcatcgatgcgatgaagacatgggggaaccattaccgaaacgaacacgagttctgattgttccagtcactggagttgtcgggagccgctgagctctactgccgcttgggaaacgaaaaggccggaacctttcggctccgacctttcaccatggtgcgagcggggggagttgaacccccacgagcatacactcactgccacctgaagacagcgcgtctaccattccgccacgctcgcaaacaatcgactaatctacacctatcgttccgataccgcaattacggcgtgtcgcgatggttacggtgtccgattcacccgaatcggacagtctggggcgttcggatgatgcgtgcatgactgatttacccgaatcggacactcgggtgagtggaggatgcgctgcgagtgaccgattctggagaatcggacaaatagacatgcgaatacgcggctgtgaacgggcgtgaatcaaggcagcatcaaatcggtaccgccgagaaaacggtagccgccgtcatccagcaatcgggttttcgcaaaatgtaagcccaggagcgtggcttgtacctcgtcgatgccgtaaatgacatgctcccagacggtctgtccagaagcgtcttccagacgaacgtttacactccaggcgtcctcgtcgatttgcggttcggaaaccgacaacacccgatctccacccgcgtattggaattgtcgctgcatgctcgtctcccatcaaatgcgcgtatcttcgattgcgggttgttcgctcttcgggtcggaagatagtgtttggctatttgtcgcattggaactttttcccgctaggcaggcggcataggctgtggctgccccggcccagcatactgcggccgcagcaccgtgtaggcgtttgcatttttagtggggaatattccggaagcctccgcctctgccgggtaagcatattgtttgtcggctgtgggctggacggagaggctatgtgcttcgtgttcgattgctgcgctgttcggcacctcatccatgctgggaagcgaagcttcatctgccattgctgtcgcgctccccgatgcaagtgtcgcacaagccaaaagagtcgcaataacacgtaacgtgttctttttcatatatatgtcctttcgtcaagttgacgtgacatcagtcgagagtagaagcgtgttcgcaattgtgatagagtgctgtcacctgttagggggacatgtcgcattaaatattcaaacgggtgacattgctgttgtacggaaccgcattgcgtgatttacatgatgacggaatgtgtcccccggtgaaaggtgtgaatatgcgacggaagcaaaatgcatgcgattcgaacggtggcgtacatgctgagcgcgtgacggccaacatgcatgaccttacatatggcttgaaagattttttccgcgaggtctttcttgataaggatgatatcgactatgagcgccgctttgacgtgcgttccttgccattgctggttgtagcgatggctgcaggatggctctattctcgtgatggaaacggattctatgcgtgtgtcagcgcgatttttgctgtttcctatactgtgtatttcatcgtcaatcgaggcgtgtacatcgtgcgcctgttccgtggggaaaatattttcggtaaacggcgtgtgagatgcatgaaataccgtggcacgatacattcgtcggttgcgggcgggctggcaaaagccttggaaaaattcgttgataacgatacgctgtatgcgtatatcggcggatatggtgttccgttgctgggcactgcgacaatgattgcttatgatgcgtcgcactggttatggttggcattagttgggggagtcttgtgcgttgtatatgcgctgtattggctgatatatgcatttgttgccgcgcatcgggcgcttatcgcagtgcttgcggatcgcgataggagattggaacaggcgggttatcgcatgacggttatgcgccgagatgcaaaattggccagcaggacgcatgatacggttaccggtggtctgtcgtatattgcctttattgcgcagcagcagctggagggtaaaaccttatcggacgaggaacgggttgcgtggaaacatatcgatgatgtggcttaacgtacgatggacaatgttcatgaagttattgatattcttggacgagatatcgaccccgcaaatcccgttggcggcgaagggtttgattgcgaatcgcaagaaatacagatgccagatgtttcttcattggagagaattattcgcgagcattgtgatgagggggattctcggcttaagacgctcgggtttgttggaacaagtgagattcagctggatgttgcggatgctgatgatactggtgaaagtgtttgtgcggatctgattgatgagtgtacaagtctgattgatgagttatacaccaatatttcttgtcacgctgatacgagtcagccatacgctgtttttgtcagtagcgagaacggatgcctccgcatcacgcaggtaaacgctatagcgtgcccgcgcaatgcgcagagcggctataagaagaaggtttcaggaaggggacttgcgtttcatcggaggatgcttgacgcgatgagcgggtcgattactacttgtgaagagggtgatacttggacgctgcatgtggtcataccgttgtgaaaacaataggttttggcgtagatatttgataattattcatgctgaatctttataaaatatcgcaagtaatttggtggttaatgtaatggaaactaatgtggaaagaattaacaaattagttgaacatataggaatagtcgacaatgatgtgttgacgttgggtgcgttgtctagctatttgactcaacgatttggagacgagaaaattttatggcgatgcacgcttggtaaaaaagctgcggaattatgtagtaattcgcaaacacgtccccagatattactcatggatatgtcattatctgatgccgatggcgtgcagatttgccaggagattcggcgtactgttgacgatatgccgattttggcgattacttcttttccgttgcgccgatatgctgctgcggtggctcaggctggagtgcaaggcattgtcgcgaaacgaaatttgcgcactattgccgctgctctcgagtgcgttgtatctggacacgtttatctgccggatgagttagcggaaaccatgccggatctgcattttgagttgcccgtacaggcgcatcgtaggatcgtagcagagactcttggcgggcaggccgtgaaaccagttttgtccgatcgggaaacggcgattatagccagatatgcgcgagggcagaccacacttcaagtgggggagtgcttaggattatcggagaacactgtcaagacttataccaagcgtgccatggcgaagcttggggcgaaaacgcgaggtcaggcaatagccctctggctgatgcaaaccatgaggcatggtgtgtgatttaggcagctttatctctgataaacgtatatgtgctgtgaccgattctggagaaacggacacattgggtggtgggtggctggggtgaaacggctagatgtatgcatgacacgcgcggaacacatgaaaaaaggcgccgacgggtttgtttgtcggtgccttgaaatgtggaagtgtggcctagcgtccgtttggacggaacatctggcagcgcatcatccgcgggaaccgttggcgtagaagcgggccagggtttcgtcgcggaattcgtcgaaatatccgtcgtcaatcgacgcgcgaatatcgtccagcagcttcacgaagaaatgctcgttgtggatcgtcgccaatgtgaaaccgttgaattcgcgggcacgcaacgcatgatccacgtaagcgcgcgaataatgcgtgcatgtgtagcaatcgcagccctcttcaagtgggccaaaatcatgcttgaattgcgcgcgcttgatgttgtaacgtccgccgcgcgtgaaaatcgcgccatttcggccgcaacgcgccggtgcgacgcaatcgaacgtgtctccaccattctcgacgcatgcgaaaatatcgtcgactgcagcgatgccgagcacgtggcgcggtcggctttccggcatcgcatcgcaaatccaggcgcaagtgtcgccgataatgcgcttttcaatcgcacctccaataccgacgccgtcgaaatccaacgaagcgatctgttcggccgcatgcctgcgcaaatcctcataattcgcgccctgtaccacgccatacagcgcctgatacggcttgccgacgcgctcttcggtaagtctcttatgctcggcaacgcaacgctgcgcccaacggtaggtgcgttccacggaacgctcctggtagccgcgcgtgttcatcagtgtggtcagctcgtcgaacgcgaacatgatgtcggcgccgatcttatgctggattcccattgaaatttcggcggaaaaacggtgcagtgagccgttgagcggcgatttgaacgttacaccgtcctcgtccacgaacgcgagacgctccttgccttcggcgatcacgtcgtctgatttcatgccggtcacatccatggcgagggttttcttgaagcctgcgccgagcgaaagcacttggaaaccgccggaatcggtgaaggtcggaccgttccagttcatgaatttggcaaggccgccggcttcgtcgagcacttgttcgccggggcgttcatacaggtgaaacgcgttggacagcaggcattgcgcgccgaggtccttcatggtttcgggcagaacggctttcatcgcggcctgcgtggccacgggcacgaacgctggagtgtgaatatcgccgtggggggtgtgaataatgccggtgcgaccatatcgtgcgccgcctcgccccttaccgtccgccgcgtcgggaaggcggtttttctgttcgaaatagaaggcgtcgcggcggcccggcttgcctggttccgctccacgcggatgttcgatgagattttcggacactgcggttgccgcgttttgcgtgtcttgcgctgtgccggtagatgattcggtaaggcttgtcatgcggaatattttatgcgatagcagcgattcttgaaagtgctgcaaagaatgcgatcggtgaaatgaaaataaggaagatgtggaaagtgcgatgaaggtgccgatcgcattttggtgcgattttcagattcaatggtgatgttgaacgtatttggctgctactttcaacaaacattcaggaaacttccagagcgagtatctttactcatagatagcagttcgagcggcacgattgctgatttgtgaaatgccgcgagacgaataaggagcgaaaatggctgaagagaacgaccagaacgccgtgcagccgcagaatgacgaacaacagaccgtgccgatgccgtcggttgatgcggaacagacgcaaacttacgcaggtgagccgtatgctgcagagtcggctaccgaaccgattgacgtgcagggcggtattgaggatcagccgacggccgccatgcctgttgcgaacgatggcgcttcggcggaatccgcggctgcggcgggcaatacgccggattatgcttccgcggcgggcgaacgtaccgtggttggcggttccacgcaggatgcgccggcccagcagtaccgtccggcaccggaatatggtgcgtacggtcccgtgccgacgcagccggctgatggcaccgcagccgcgaacgatactgcgaatggtgcgccgaacatgcctccgcagccgcaatatggcgcgtacgggcaggcttccggacagcagccgcagcggcctcgcaatcctttcttcgggaatccgtatgtgggtggaaatcagcagaacgatcagcagaatacgcaatcgaataacggcaatccattcatgaagcccgctgcgcaaggcggagccaacgtgccgccagcagcgccgaatactcccaataacggcaacccgtttgggaatccgaataacggtaatccgttcggtgccccgcagcagaatggcgcagcaaccaagccgaagtccgcttccggcgtgaccgggcatgtgatgaccggcgtggtggcggccctcgtctccgcggcattgtgcctcggcgtcggctacgcggcaatcaccaatggatgggtgaccgtacccacctccagctcactgaccagcgtgaagtccaacacgtccggatccggttcggcgaaagccaaatccggcgaggccgcggactggagcgcggtggcgaaagaagtgtccgattctgtggtgtccattgacgtggcaaccagcgacggcagcgccaaaggctctggtgcaatcatcagcgacaaaggctacatcgtcaccaacaaccatgtgatttccggcgcgaagcagattcaagtgacgctcgccaacggcaccatctactcagcgcaaatcgtcggcaccgacaccaccaccgatctggccgtaatcaaactcgacaatccgccgagcaatctgaaagccgcagaatttgccgattccgacaatcttgccgtgggtgaatccgtgatggccatcggcaatccgctcggctacgatgacaccgcaaccgtcggcatcgtttccgcgctcaaccgcccggtgaccgtgtccgatgacaacaacaacgacatcgtcaccaacgccgtgcagattgacgcggccgtcaacccaggcaattccggcggtccgaccttcaatgcggccggccaggtgatcggcatcaactcatccatcgcatccaccacaacgtcttccggcaccgccggatccatcggcatcggcttcgccattccgtcgaacctggtaaagcgtgtggctaacgagatcatcgacaacggcaccgtgcagcatgtggcgctcggcgtcaccatcaagagctccacggtcgaggcggacggcgtgacccgcggttgcacgcaggtgcagtccgtggtcgacaacagcccggcggccaaggccggagtgaaggccggcgactccatcgtggcgttcaacggcaaggcggtgaacaacaactattcgctgctcggctacgtgcgcgcctccgccatgaacgacaaggtgacattgacggtcgtgcgcgacggcaacaccatggagcttgacgtgacactcgaccaggaggaatcccaaacgaactcctccaacagccagaaccagcagaacaacggcaatgatggccagagccagaacggcaatggcaacggttacggtaatgacggcaacggcaacggaaatggacagagcgacggcaacggcagcaacggctacggtgacggtggcggcctgttcgacccgttcggcctgtggtaaagcgagatgttgatgcggtgcgtgaattgacggacgcaagttgttgcggtgcgcaagtcaagactgttgggctggctaaaacgtttcgcgacatgcgaacggacggaagccacccgataggctgacggcgaagacgcggctggcaccacgaaatcgcaagtacaacgaaaaccgcgaaaatcaacaaaaagcaagccaaaagaagaatgcaataagggctgtgtgagcaatcgcacagcccttattgctgtattgcggcacaaaaatcgcaaatatttgctatgctgaaaatatctttttacgccgtgtatcgatggctcgcgcgggcgaggcgccgatgggttaacaaggcgtccgatacgagcgtaaggagattctcatgcgtagaatcatcgatatttgctggcgactgtgcaaacaggttccgttactgccgattaccattctgtccgcgattccgttggcattgctgggggagtggaagccgtggggcgaggctgcgtgggattcgtggatttcgcaagtcggcgttgacgggttgagtgcgttcaatccgggcgttggacagtggattgtgatcgcgttggttgcgtacacgattgtggtgacggtacgcggcatgatcgacgatctgcggcacgggcatgttggcgtcgatctgctggcggtcgtcgcgattgcgtcgacggtcgcagtgcaggaatattgggccgcatgggccgtggtgctgatgatctcgtccggcgaggcgatcgaggaattcgcgcagtcaaaggccgaaagcaacctgaccgcgctgatcgacgcggcaccgcgaaccgcgcacgtggtcgtgctgcccggcatgcgggggcatgtgcacgcgtcgggcagcgagcatacggccgacgtgaccgccgacggatttcgtactgtcagagtgtccgattctggagaaacggacaaccaagacggtgaaaagcgtgcttttgcgtctgaatctccagaaacggacacaaaaggtgccgcgcagacgtatgatgcggctggagagcgtttcgaaacggtccccgttgatcaggtacagctcggcgacgtgatcctggtgttgcccggcgaaacggtgccggtcgacggtgagctgctgtcgggcgtggccacgttggacctaagcaacatcaacggcgagcccgttccccgcgaagtatatgcgggcgctcgcgtgatgtccggtgcggtcaatggctccacaacattgaccatgcgcgccacgcaacttgcgcacgattcgcaataccagaagatcctggagctggtctcgtcggcgcaagagtcgcgccccgctgtcgtgaagaccgcggatatgcttgcagtgccgtttaccgtgctttcgcttgcgattgctgggattgcatgggcgatttccggattgccgctgcgatttgcgcaagtattggtgcttgctacgccgtgtccgctgttgattgccgcgccggtcgcatatgtggctggaaccgggcgacttgccaaagcgggaatcctgatcaaagcgcaggatgtgctggaaaatctaggtcgcgtatcgcatattttcttcgacaaaaccggcacgctcaccgtcaagcagccgcaggtcgtacgtgtggagaagccgtttgagacgagttcgccgttcaatgaggaccatattctcatgatggctagcgtggtggaaggctattcggtgcacattctgtcgaaaggcatcgcggcggccggacgcaaggctatggatgatttgtatgcgcggtatgcggcggggcagaggctgtgcgtcgagcgcgatttgccggggcacgggcgcgactatccggtggtgaagaacattgtagaggagtccggcaagggtatatccggcgaagtgaacgggcatcaggtgcgcgtggggcggttcgcatacgtgacggctgacgaatccggattcatgccggtgctgcatatgccggatgcgacgtattacgtgtccgattctgccgaatcggacaaacgggagactcagaatgcgctgcggatgtccgattcaccagaaacggacatccagagggctaaaacgtgtgtttacttgtccgattctccagaatcggacactatgggagtgaggaacggggtgcctgacgatgcgcagcctgcagccgcgccctctacttccgcgtccgtcgcaacccaatccgccgctcgcaagcctgaaaccgcaaactcgctgtttgccccgctcgctcctgacgaaatggctgcatacgtggcgattgacggccgtcttgccgcccgcatcgtacttcgtgacgtgcctcgcgagaatgcgaagcgttctttgactcgcctgcacgagttgggtgtcaaggaactgtccatgcttaccggcgacaaggctgcgtccgcccgcatcatcgcaaacgaagtcggtatcgacgacgtgcagtccgaactgttccctgaagacaaggttgccgccgtcaagagcgccactgaatccaagcaccagaagctgtcgttgtggaatcgcatcaagcaacgcgtaaccggcgaatccaagaatcgtcaaatcaccatgatggtcggtgacggcgtcaacgacgcccccgtacttgcggttgccgatatcggcatggccatgaccgacggcacgtccaccgcggcttccgaatctgcgcaagtggtcatcatgaatgacgacatcgcgtccgttccgcgggccatcgccatcgcgcgccgcacgaaaaaggtgatgttgcaggcggtgctgatcggcctcggccttgcgattatcggcatgatcgcggccgcgttcaatctgattcccgtggttgtcggcgcgttcatgcaggaagcgattgatgttgtcagcattctgtgggcgctcaccgtgcttttcgaccgtggcgaatcagcctgattgcgcctcgaaaccccgtatctcgcctatatatggcagatttggaggtctgtcagcaagtatttcgcttatatctggcaggtccatatgaaaaaaccggacttagggggcgagaatacaccctctaagtccggtttctcaaaacagctctgctatatataacgcagatagctccggacgaacttcggaatctgccatacataaggcatgtataaggcagattcggaagttttgggattgtttacagcgagctcggggagatttctccagcgatcgatgtgtgcatccacttgccgaagtcggctccggtcacgccttgagacagcaggaacatgattttcgcatacgtggcttccagcgtcatatcgccagatccaattgcgccggcgcgtgcgatcgcatcacccgtctcgtaatggccgagcagtacttccgcctgctggcactgcgatgcaatcacaacgggaacgccatcatgcagcacgtcggcaatcacgtcagtcagtccaggctcgtcgcttggcacattgccgacgccgtacgcacgcaacaaaaccgcttccggccgcggcgtaagcatcgcttccaaccgtgccgcggaaatgccgggtgccatatcgatcaccgcaacatcatggcgagagtaaggctgaggcgacgtccaaccgcagccaaccgcagcggaatcgcccgcataccaatgccatggcgtgccagtgcgtgccagcgggccgacggaaggcgccgaaaaaccttcaaatgcccagctcgacgacttgctcacacgattgcccgcaaacaggtgatgtccaaaaaacagtcccacaccgtggaatcgtccgctcatcgcggcattcagcgcgcccgtgacattcgcagtggcgtccgactcgatcttgccaagcggatgctgtgaacccgtgaaaatcaccggcttgccaaaatcagccaacgcatacgcaagcgcggcgctcgaatagctcatcgtatcggtgccatgcaacaccacgaacgcgtcggcatcatcgcggtgcgcacgcaaatcgtcgaccatcgtctgccaattgtcgggagtcgcattcgacgagtcgataagaggatcaagctcggtgaacgtgaacaggctcgcgtccatgtgcgcgtcctccagcagacggaacagccatccgcgagtgtcggcgcccggaatcaggccgttcggcgagtcaatcatgccgatagtgccgccggtatatgtgatgtgaatgcgcattgccaccttcttacgattgcctggtacttaataagtacttgcttgcgattgcgggatggacgaattccgatatttcggattcctacatcccgcgattctgcgactacttgcgattgtacgtgcatctgccgcgctcatcgcgtacgattaatgcagccacacgttggattcatctggattcagcgcaaacaccaacgccagtgcgcacaaggcgaagaagtcgtaagaaagtacatgagcgcccctgtcgcaaatgcagggaatgcattaggctagagcgcgtgactgaaactcatgaacttcgtattgctgtaatcggcgccggccctgcaggcgtctactcctctgacattttcctgcgccagttgaagaagctcggcgaggagctcggccttggcactgccgcccgaatcgacctgttcgaaaagctgccggtgccgttcggtctggtgcgctacggcgtggcccccgatcatccgtccatcaaattcattgcgtcggcactcgaaaagacgctcgacaatccggacatccacctgtactgcgacgtggaattcggcaaggacgtgacgctcgacgaactgctcgaacgttacgatgccgtgctgttcgccaccggtgccgtcgaagacaagccgctcggactgccgggcgccgatctggacggcgtgtacggcgcagccaagttcgtggaatggtacgacggttatccgaccggcgctcgcgaatggccgcttgaagctgaggaagtcgccgtgatcggcggcggcaacgtggccatggacgtggctcgcgagctcatgcgcaatgccgatgatctgaaggagcgcaccgacattccggacaacgtatatgagggcatcaagtccaacaaggcgcgtgtgcttcacttgttcatccgtcgcggtgtggcgcaggccaagttctccgtgcaggaattgcgtgagatggagaagctgccgggagtgcagctgatcatcaacgaagacgatttcgatttggatgaagacacgattgaagaggccggcaaagacaagctgactcgtcagatggtcgaagagctgttcacgattcgtgagatggcggaagacatggaagatgacggtgacgtggattatgagggtaatccggctgaccgcaaatattacgtgcacttcaattccgctccggtcgaagtgttgggtgaggacggcaaggtcgttggcatccgtgtggaaaagaccgagacgtcggcggacggcaagatgagccgtaccggcgaattcgaagagtatccggtgcaggctgtgtaccatgcgatcggctacaaaccggccaccgcgccgggcattgcgtacgacgagcgtcatgcgcacttggcgaacgcgaacggtgacggtcgtatcactacggccgctgaagccacggatgaagtgcgcgagcgtctgtatgcgaccggttgggcgaagcgtggcccggttggcctgatcggctccaccaagtccgacgcactgctgatcgtgaccaatatgctggaggatttgtcgaaggctgctgaaggcggtcgtgtggctgccgatcgtgatccggagtccatcgaccggctgctggaatcgcgcggtgtcaagccgatcgacttcgctggctggaagaagatcgatgcgttcgaacgtgccgagggtgcgaaggaaggccgtgagcacaagaaggtcatcgatccggagcagatgcgcgccctggctcacgcttaaggtgggtgtttgggatctgatctgataggtcccaggtttctttcatgcgtcttggatgtccgattctggagaatcggtcacccaagacgcattttttatcctgtgcttgtctgtttctggtgaatcggacatctggagtgtccgaaacatgttctgtatgtctgtttctggtgaattggacatgtgatgtggacgaaggacttgctacttgtccgattctcccgattcggtcacccaaaggcctcttggcatgcatcggatgtccgtttctgcagaatcggatatccggggagaagctgagtatgcgaacttccgcaactgccccctagtcctttccgcagtccagtctccagcacatatccagcaaaaactcaggctccgtttctacgctagtgaccatgaacggcaaattgcgggtgcatggccattgcaatggcttgaagacaacgctgttattcgcgttgatgtggggcgtcatcatgctcatttggtgggcgaccggtggcggccagcgtacgcttggcatctacattctcatcggacttggctcaacgttcgcatcctactggttttccgacaaacttgcgatcgcatccatgcatgcgcaggaagtcagcgagcaggaagcgccggtactgtacaaaatcgtgcgcgaactgtcggcgaaggcgggcaagccgatgccgcgtatttatatcgccccaaccatgagccccaatgcgttcgcaacgggacgcaatgaacgtcatgcggcggtctgctgcacgcagggcattctgcagatgctgaacgaacgcgagattcgcggcgtacttgggcacgagctcatgcacgtgtacaatcatgacattctgacgtccgcgatcgcttccgcaatggcgacggtcatttcgtatctcggctattcgctcatgtatttcggcggcggcaattcgcgtgacgatcgcaatggttcatcttctaatggtcttggattgctgggtgtgctgttgagcgcgattcttgcgccgattgccgcttcgcttattcagatggcgatttcgcgtacgcgagaatatgatgccgacgaagatggttccatgcttacggaagatccggaagcgctcgcgtccgcattgaataagatctcgaacggcgctgagacgatgccgatgcagaagactgccggtacgcagtcggttgctgcgatgatgattgcgaatccgttctctgcggaaggtttttctcgcttgttttccacgcatccggcgactgaggatcgtattgcccggttgatgcagatgagtcaggagatgaaggcgcggggcgtgcagtccggctatttggctggcggttatgcgacgagcgggtatgcttcggaggatattcgtcggcagaatgggggtgtctctggtgccggcgccggtgcgggtgcagggggatactccggtgggggctattcgcgagattattcgcagcatcccgtgcaaggcgggtatggtcgctgatcggcggcgattgcaatgtgcgcaggttgcgcaagtcatgcgtgattgcataggattccgctgattctgacgcgaattgtgtgtgtttcctgcggtgatgtattgcagaatattctgatgtcatctgatgagtgacattaatgctgttgtggttgttgcgcgttgattgatatgcgatttggcaagtgggtgacggtatcgaatatcggttgatggccgtgaatcctgcgaatgcatgctagactaaatgattgtgtccaaaaggcacattttttgcggatgtagttcatcggtagaacgaaagcttcccaagctttaaaggcgggttcgactcccgtcatccgctccattcgaaacccttggaatcgttggaattccaagggtttttctattaccgtaaaagacccgtgaagtcaacttcacgccgcgcaactgtcggttgcgtcgcaaaatttggttgcgaatcgcaatgcaaccgaaagatggtggcgtggaacgcgacgtttatgacaagctgttgcttggcaatcgccaataatcgcaagtcgaggcgatatggaaactcgacgaaagggcggacatgagtttcaaagagaatctgcagtatctgcgcggttcgcgcaacatgacgcaggaacagctggcaatgctgctgggcgtttcccggcaggcaatttcgaaatgggagtccgagaaggcataccccgaaatggataagctgctgatgctttgcgacatgttcggcgtgacattggatgatttggtcatgggcgacgtgcgcgcgtcggcgggctgtgggggtgcgggacgcgtggacttggctgctgatacggatggtgtggccgcgtcggttggggtggccgacgctgctgttggcgcggttccgggggtaatcgggtttgcggcatcgcaggtcgcaggaatgtccgattctggtgaatcggacgtgagggatacgaatccgaatgtttgtgcgtccttccgtaacccagtcgggtgaatgggtcgtagtcgcgcgccctagaggctatgacgcctactccgtcgcaagcatggttttcaaaccgaatacgaacacgtcaatagacatcaagctgccgatcgaagcggcaaactgggattcatactccgtcgaattgcagttgatgaacgacgttaaaaacaaagtgccgtcgttcaacaacatctcgatgattacgaacagtcattcggcaaaaggatttcagcttgtcgcatggaacgccagcggcacgtcgctgagctatcgcatcgccgtgactgtccacgtcttcgacgcgaagcagtagttttccgtaaccctcacgaaatcaaacgtcaactgggacgtgaattatcgcaccgcgtttgtcggcgggatgttgatcgtcgcgtttcatgccatccggctcaacacggactggaatgccgcgagggaatgggagtcgtccaagcttttcacgcttccggctggattggaggccgcgttcgaggtgcattgcgccgcggtgtccaattcgagcgtggggcttcatggcatcgaggtgcaggccgctggcaacgagatcgtccttcgctcgtccgcgaagatgacgatcggcaaaggcggttgggtcgagggctgcatcacggtgccgctctgatcggcgattagacgaccggatagcagagcgagccgacgcaaccctgattgctacccgcggctcccatgttcgcgcatctgatggtgccgttcggattgacgacgagcattctcgccgtctgcccgttcgatacgcacaccatcgcattgacttcgaccggagggcgcaattcggcgggcagcacgtattcgcattgcactgaatcccaactgccattaccgatattgccggaatatctgacgagcatcatcatgccggtgcggatgacagtgaagcccttcgcgttatacagagttacggaaaactattccgtcatccaacagccgtgcgccgtggagtaggcggatttcgggtcgccaagcatctgcaccgtcccgtcacgcatgacaagcaggctgaaatcgcaggacggaaacgcgatgatgctctggttggcgagcggacggaacgcttctgggatggtctcattcgccgtcgagtagttctgctgtccactgccgtcgaactttacgttgccgttgatcgtgacgatgcgtccgacgcgacatagagtgagtctgctgttcgtatacggcggcttccatggctgggttacggaa
